United States Patent 11,549,145 (METHODS AND COMPOSITIONS FOR INHIBITING AND TREATING NEUROLOGICAL CONDITIONS) - sequence listing, part 124

SEQ ID NO: 2289 - DNA, 105803 bp, Homo sapiens
gtccctcatgtcaaactgctttattacatcttaaataacagtacagtttaatatagtatctatcttgcatccagcttccttgcagtacactgactttaaaattaaatacaaaaggtggaaaggggtaagggtgcagagagctctacagagttgttggacggaaagagaaagaaggggtttcatttgtattctctttgccagatccaggcctaccgcaaggtcacagcacagttttgtatagaatgttgcagaaaacaggatggagaagccactactgctgctatgaaggagtgcggggggcggggcggggggtcccacagaacctgctttccaaacgctgctgctgaacactggccttgaaatgaacaccaggacaatctgtgtgtgatgggaatgagccacctcagatgtggagggccctgaagaatccatataggagggcaggctcttcactccctctccctccctctctctccctccccaccctcagaatccaacagcagtcgtttgcaacagaacttttttttttttaaagaaataaagaaaacagtgacttatcccgctacccaagcgtgtagagccgcgcgctgtactgcttccgatatgtgccacagagcagcaacgagaagtggacagagccgcaatggttacaactgtaagaggttatttcttaaaagaaaaagaacacctaaggactgagtcccatatgcacttttgagcatttctacagcatgcgattctaagagtaaacccacccaatatggcaaacaatcaaaatttttaaaatttaacttagaaagtctgagatcattattttcaaaacattgatttgtacattgtttcatacacaaataattgactgactatccaagcacaggacaggcatctctcttgaaaacagaggttcctcctagttgggggtggggtagtgttaggctattataaacttccctccaacttcacaaggaaacccaaagtgagattaaaaactcaactgagaagatagacaggatgggtcaggaggaacatggtgctggatctgagctcacttttcagcaaaggtgaaggattctctgatcacgcatttgagaccgtccccgcatgtgcttggccccatggcttctgaacatgttcttttctatgccacgtttgtgtgcaacaatgatctgtgacatcagacagaaaattaaaaaccagggactgaatttacatcattgacaacatcagagaggctgccctagactctctggttttgattaactgttgaacacaaaggaatacattttaaaaaggaaatatgaatgcttccaaaatcttgctacaaacatgactgaaatttggacacgatgaccagatgaacaaagccctcagcatgttttgcatgaatgccacaaaacagggtcactggtctaaaattcaaatacactggtggaaaagtgtgtctgtctgacaattacactcaagtttaccttctggttaacatttttattatatatttccttttaaaattcattcaagacaaaaaagaaaacaaagacgatggccccggaaggaatgcacaatttgttttagtttacagcacagagatctttctctcaatgggaattgtgctcttggtttcagcaataagtgaaggaaaaaagatcttgcccttttgaagttctgaggggaggtgtagggtgtccacgttagtacggttggataggatatgctctcatggtaacgcgtccaagttggaatggtcttccagtctccatggcatccacatgctgttttaaacagagtttaaagaaatgtgaaaagaggcagagaatctaagtgcagacgcacagccaggtcactgctcttcccatcactgcatgagtgtctgcagctgagggcacgtgacttcagctttctgtaaacgtttcccacaacacaattccaaatcaatgctacatcaacatttatctagaaaccgttaatgacaacttcaaatgttctatgagaaacacgcacagttctcctcagagaagggcatttgggctgctgcattacctactggcgttagttccagatcttgaggaagctatcccaggaccctgtcgccacagccatgccatcgtcagtcacgcccaggcagctgacgcggttgtcatgcccagccaagacacctgggagcaaacaacagcagaatcacaccaaagcccagaggcatcgatctcacctgtgtgccatgttgtgacgaggacggatggtgcatctctcatgggacaagacccagagtctcccacggccaggaagggagggaaagttgcatccacgtggggaattaacctgcagcatatggccagccttgttaaaattcaaagacacgcacacacacgcaatcgataaatccagagcccctggcattgacttctcagcactcacttataaaacttaaaaaaagaagcaaaggccactatcaaaaaaatcaaaactatcatcagacgcagtggcttaggcctgtaatcccagcacgttggaaggccgaggcaggcagatcatgaggtcaggactttgagaccagcctggccaatatggtgaaaccccatttctactaaaaatacaaaaaccagcagggcgtggtggtgcgggccgtagtcccagctactcaggaggctagggtaggagaatcattggaacccaggaggtggagcttgcagtgagccaagatcgtgccagtgctctccagcctgggcgacagagcgagactccatctcaaaaaaaaaaaaaaaaaatcaaaaccgccccaatctcaaagcaatctgtaacacaggagcttagaggcatgagccgtttttcctttgtctgtgatccctagagcccagcacaaggcacagaacacaggagtagcgatggtggctgagaccactggcactgcactgtcactgtcatgtgatgagggggccttctgtcaacactcccaataaccttggcttggatcatcaccagccagaagctccacttcctcccagggggatccgaaggcccatttcagccaccctcctccacctcctgcagccaccacacagctgagtacaggggccggcgtgtgctctgccaaggcctgggctggcttccaccgcccttcaacagcactgtgactgtgagacttggctggaaatggctccactctggtccccccaggctggggagaaaaagaaatgtgtttaaccaggaggtgggagtggcacccatccggaagcaggaagccccggtaagggccaagacctggagccatgctcccttctgtcctcccaggtactgagacaaatgaatctaagtctgtaagtgtcaacagttctcaaattcaaatgcccaaatgaccatttttagtaaggaagtctcatcttttgtacacctggcaataacacgcttgcctttgatatgttaactgtaacggcacccagaggtgtccctgcatggaactcctccccctgaagcagagttcagaggggaaagcacggggctgggccctggagcctgcacagctgaccctctcctgcccactgactctccccagagccctccccgacgcatgtgggaagatctgctggtactcctcggagtccacttgcctggagggtcagagctgggccatcagtttgcgactgtcactcctgctacgccatgccacagtcccaccgatactaaaacactgcagcttatgcaaccactctgtgtttgctctaaagataccacgtaaatgtccacaagacacagaaaggccccatggccacgtacctgcccggtcggctttgagtgcatcccagacgttgcagttgaagtcgtcgtacccagcaaggaggaggcgcccgctcttggagaaggagacagaggtgatcccgcagatgatgttgtcatgggagtaagtcatgagctcctggtcagcacgaaggtcaaacagcctgcaggtggcgtcgtctgagccagtggcaaatgcattgccatttggaaagaactggaaagagaaagcaaatcaagacatcatgtaaacgctcagaaagaaacattgggaatatggattgctcaatggtagggctgcagagaacacagcaggcaaagaccagcaagactgtgctctggtaagaacagagggctgggccgggtgcggtggctcatgcctgtaatcccagcactttgggaggctgacgcgggtggatcacctgagatggggagtttgagaccagcctgaccaacatagagaaaccccatctatactaaaaatacaaaattagctgggcgtggcggcgtgcgcctgtaatcccagctactcaagaggctgaagcaggagaactgcttgaaaccgggaggcggcggaggctgcggtgagccaagattgcaccattgcaccccagcctgggcaacaagagcaaaactccgtctcaaaaaaaaaaaaaaaagggtggggggatgggggaggaactacaggggactgggatgggaggggatttgcactggggaggcacacaaacactgtgatcttggacactgtgattactgtccccaaagagtagaatttattccaaaggatagtgagaaagtagtcatcactgacaggtgtgcatgttgctgtagctgccagccatcagggctaatctcatggaggaaggagggaagcgggctgaccaaggctgtggtcaggactgcagcagagctctgtccaaccaacagatacatccttctaagtctcctcacaaggccaggggctggaaacactgcctagccatccgcgtgctaaagaggagggcaggttccctggttagctgtgcccctgaccagtaaggctctgtaaccactggtggcctgagttatcttactgtctttcccctccaggatcccaaccactgctcagctgtagaggtgggaacggggactggcatacaacaccctgtgagtatctgtgagacaagtggtcaacacagagaagtttcccatcgggagttttctgtatccccatctgtacatgaggttgtataaggatcagaaaggagaacatctaatccagaaaagtttaaaatttagcaatctgaacggctagcagagacggcagaggacccgaccccacacctccacccagactcacgcaaatggcattgatgtcagactcgtggccagtgaaggtctgccggcacatgccttctcgcacatcccagagtttggctgaagcatcacaagcaccagagacgaacagtctggtgtcaggagcaagagaaaggctcatgacatctccagtgtgtccggtaaacgtggtcgtctgctggccggtctcgatgtcccacagggcactggagcaggagcgaatgacaaggggacatcagccttaacttcttgggtggctagtcatgtgacagacaatctgtccttcaaaccacccagggccacagtgagcctctgcactgttactttaaaaacgtaaattgtttaaagacaaatttaaatgtaatacaactttggaagggaaacaaagcaaagcaagcaaaattatacagagatgagcacagggcctgggcttcagaatgacgggatcgctacctcaactcaaatgccagcaaacagggagctgggggcacttttcaagcagcaccactgaggctgtgccccctctttggtcatggatgggcatggaaggggtggcaggaagctacgtggaggccctggatggcggaggggacgcgactctatctgtggctgctccctctgtgccctcccttggcctcccctccacagggtctcagaaaaggcaggcaggagaaggccaatgccaggtaaacaaatggctcacagcaattctgaggtcctcctgccctttcctggaatcacaaacaggagagcagctgagttctcagtgatcacacctggtattttttttttttttttgagaccgaatttcactcttgttgcccaggctggagtgcaatggcgcgatcttggctcaccacaacctccgcctcccgagttcaagcgattctcctgcctcagcctctccagtagctgggattacaggcatgcgccaccatgcccggctaattttgtttgtatttttagtagagacggggtttctccatattggtcagactggtctcgaactcctgacctcaggtgatccgcccgcctcggcctcccaaagtgctgggattacaggcatgagccaccgcgcccggccatacctggtattctatcacatttctgcttaacaagctgtcaaaaggtgagacgctgacagagccctgcacagagcagaagcctggctcaggtgtaaggacagctgtgagggccacacgcccaccaacatactattctcctgtgcctcgacccatggaaggcaacaccagagagcactgtccgttcatgtcagcctcagaggaaagcctggctgggcctggcaatgcaaatccaatcagccaatctcaacagacactgcacagggagcctcctctctagggcctgagggactgactgcagaagggaagcaagatacgtaaaagagtctgaaaaaaatgattaatgaacagaagcactttaaaaatatcttctaataaataaagtcttctcaagattgacaatctaggtgacaaatcttttgtaaatctatgaaatttatacaacgaggacaccttataataccacagatgctttgctgacaagttggttaagggcccatgtctcggtgaaccccaccaactgcgtgactaggggtctgtgccctgggctgggcacagctcctgccaccaaatcatgcctcagaagaccagaaaaacccacatggccagctgaagtctaaaatgactctcataaaataactatctggacatttaatttagtactttgatgccacaaatgaaaaaattctagcatttaagtgggcttccgtttacctgtaaggtgaaaacactaaaaatgaagtctgatggaatcacttgaattgtgacgtctgttatttttagtctgtgctcattgttcacaatgacatgatgctatcagaaagggacaatcaaaacccaccctactcccacctatcatcacctaaggaggtacaaatatatagaggggaaaaaaaagaagagcaggtactttgagcctgattgtagttaaaatatctatgttggccaggcatgggggctcacacctgtaatcccagcactttcagaggctgacgcaggcagatcacgaggtcaacggataagagaccatcctggccaacgtggtgaaatcccgtctctactgaaaatacaaaaattagctgggtgtggtggcgcacacctgtagttcccagctactcgggaggctgagaggggagaattgcttgaatctgggaggcagaggttgcaatgagccgagatcacgccactccactctagcctggagacagagagagactctatctcaaaaaaaaaaaaaaaaagaaaaaaatgtgtattttagttctcagctgctgaaaattaaactttgtaaatttattagaagtataatgaggctaggcacggaggctcacgcctgtaatcccagcactttgggaggccgaggtgggcaggtcacctgaggtcaggagttcaggaccagcctggccaatgtggtgaaacctggtctctactaaaaatacaaaaattagtcaggcgtggtggcgggcacctgtaatcccagctattcaggaggatgaggcaggagaatcatttaaacccggcaggcagatgtcgcagagccaagattgagccattgtactccagcctgggtgacaagaacaaaactccatctcaaaaaaaaaaaaagtataatgaattcacacattgctactatgtgttttaaatcttaaggccacttaaattacagatggcctaatattatgtcaagaaccttatttcctccatgttcacagaggaatgtgccaggggctgtgggttctcaaggcactgcctgccccgggtcaggtacttaccacgtggtgtctccagagctggtgacgatctgattgtcatccaggaatcggcagcaggacaggtaacctggcaaagaacaggcctaagtgatgagctgaatccagcaggccttgcacccagcctcatacatagagaaacacattggcccggtggaagctctacgtctaaggtaagaccagcaccatgctagtgaccttttattcccatctgtgcacacagcagaaggtccacacgcactgctggtgagggtgagagcctggccaggcaggacagcacgtcccacagagacccacagctccgtgatgggggcagaagcagaaaccacacccatgaaacatacacatctttcatctgctttactgtttgacccatcaaaggctggggatccctcgtctatttactcattcagggcacgctgactccagtgcccaggaagcagccttaaccagacagacacctcctgctctcctacagcccacgctcagcagggacagagaatgagaatcactgaaagaggacatcagaaagggagtgctaggggaaggaagaggacaaagtaggggcctcacaagatggaagccaggagaggagggaggacgagagtagactcagagaaggaggatccaaacagagggcccagccagggcaggaggcggcgaggccacagggtcagggtggcaagggcctgcaggtcatggaagggataacgaaggcaacaggaacgcggcatggcagcaacactgcagacacgggggtgctcgtgaatatgtgtgggtgggtttgttttcttggggacagtggctgtgacacccacatcagcgtgggcacaattctgtgtctctgagtattcccacccactcccactgggaaggaagcatcagaggcgagagcaggacacaccaagatgccccgtcctaaacaacttccaaaatgaggaaaagcaacaacaaaaaatcagtccgcaatatccacacatgatgactggtctctactaaaaatacaaaaattaagcgtggtggcgggcacctgtaatcccagctactcaggagggtgaggcaggagaatcatttgaacccggcagttcaagttgttaatgacttctgttgaccattatttcttttgtacattgatcacagttctggtatttactgtggaactaaaagcatagggtcaacaaaccagttagtgtgtgcccaggattggtgacagactggccctaatctgaagattcaggggttccagtggcactggtgattcttgggatacctgtttagatttgagtgtttactgaaaagccttccccccaactacaccccagggagtcatgcgacactgcgtgaatcagcaaacaacaaaaataaaatgcaccaaaagaagaaacccactggggttttaatgtagaaagtgtaagattacagagaaaacaaagcatttatttaacaaacattattatcactattttttgagacagagtctcgtgctgtcgccaggctggagtgcagtgatgtgatctcggctcaccgcaacctccacctcccaggtcaagcgattctcctgcctcagcctcccaagtagctgggactacaggtgcacgccaccacacacagctaatttttgtatttttagtagagatggggtttcaccatgttggtcaggatggtcttgatctcttgaccttgtgatccacccacctcggcttcccaaagtgctaggattacaggcgtgagccaccatgcctggccaacaaacattattaaactggctctgacagaagaaaaatatgcatagatgacagagctcaaaatattaactacgtgcctacgaaagtatgcgtggtcaaatacttcctggaggccacaccacagggacactagggaccacaaaggtgaacccaagtccagctcagaggaggatagccctgcatacctggcgccccctgtagtgccctgcagcttgctgtcgtgccccgcagctcactgtcatgctcccgggtctccacccgagccctcctccactggcttcctggttcacactcacccttgcttcagggaagcacccccaccccgtcagatgcccatccagaccaggccaccgagccttgtagcacttagcctgtttgaatgtgagcacagaagggcaggaaagaagagtcatggagacctcagcacagcctgcatctcacacaggggaccaggcggaggcactcccaagtttactgcatgaaagaatcatgaccttggctggacgcggtggctcatgactgtaatcccagcacttggggaggctgaggtcaggagtttgagaccagcctggccaacatggtgaaaccccgtctctactaaaaatataaaaattagccagctgtggtggtgggtgctgggtctgtaatcccagctactcgagaggctgaggcaggagaatcgcttgaacccaggaggcagaggttgcagtgagccgagttcacagcggtgcactccagcctgggcaacagagtgagactctgcctcaaaaaaacaaaaaacatgacctcataggtctcaaagatgacctctctgtcccaccctgtgcaggctgtagtgaagctacacagaatccatcagcttcttactccaagaaccagagactgaaccctaaaatcacagctctcaagcgctgataaaatgatgtggacaagcatcagctgacaggaactatgaaggacaaggggaatgaccgaatgtataagccacacatggcccctgacttacaattttgtgactttatgatggtttgaaagacacacgcatttaataggaaaaccatgctccaagtacccatacaactattctgtgttttcattttcaggagtgtccaataatttacatgagatgttcaactttttcttataagatatgtattatgttagatggttctgcccaaccagaggccactctaagtgtctgtgcatgttcaggttggggggtgaggtgtgtccagtgcggctggagagcaggatgggtggtgcaatgcccagggtgcaagcatactccatgaggcccagtctgtgaacagagaccaggtctaaccccttcttccaggaaagcctcgtagggccttctggccaagaggccacgagtggtgaagactgcagactctgaaatcagaaatacctgggctccactgtcagcatggcagctgaggaagagtgaaaattcctctaagttcttttagaagtcccagcctccccatgtaactggggaactgatgggaggagcagagctgtctgtgcacataagaagttctcagtaaatggagacagttactatttctgttattattgaatttgaacaaattccctgggtatgtgtggggggacacttcaggtgaaaacacgcccctcctcccctggtgcgggggcctgtgctgccaccctctggaagcctgcagaggggcagggaaaacagaccctgaacaaaagtgtgcacccagtgaggaggtgcaagggcacaaaggtggcaccaagtgcctcaaggagaggctgaaacgcggcctggggacctcgcagtggtctggtcatataggcagtgggtgtgaagggctgtcctgtgtctcatagggaccactggctatagggacaaggctgttaaagtccaggagagagggggtggcttgaagagaggcacggcagagagtggaagcgtaggagaaagatgggctcctgggcatgtggtgtcagcagaggtgcctcaaggatagagtgagtccagagtctagaaaggagcagatcaccaggctctgggaagagcacagcatgggtgcacacactgctctacccagcatggctgccgacccaaagacagcaaagccaagaaggacacacaagcgtggccagatgcagccctgtgaggaaacttacccaagaacgggacgatgggcttgagaaaccatccatctacaaggatggcgtttgctgcagcaatgtttataataaattgtgggaaactgtgaactgcctaaatgtctcacaataggaacaaattagtgcaccacaccatgaaactctctacagctcctgagttacagaacgacagtataatactatagttatataatactgtataatactactgcataactattgtataatactgtatttctggatggaattatagggtctcccaacataaaagatgatgattcaaagttcctttccaaaattcctttttttttttgagatggagtctcgctctgccacccaggctggagtgcagtggtgcggcctctgctcactgcaacctccgccaccccggttcagcacttctcctgcttcagcctcccaagtagctgggactacaggcacctgccaccacatccagctaatttttgtatttttagtagagatggggttttgccatgttggcaggctggtcttgcactcctaacatcaggtgatccacctgcctcagcctcccaaagtgctgggattataggcatgagccaccgcgcccagccccctttccaaaatttctacaatgaacacactttgaaaggtttagttctcctacctgcaccctggagaacatccctgttgggagcaggggcaaggagaccccacccaagggaggcgcacaggacacactgaaaggcaggcgggcaaatgccaagaagtcagccatgaccacgcccagtccctcactagtcctcctccgacaggtggtttcaggagcacctgtgccgccccaggatcggctccaaggagcaaaaacaagaccgtgctggcgagggacaggctcagcctagacctggagggaaaggtgcccagccctgcaccgaggcatgcacttggagagcagaggtgttttcttcaagttcagtaagaaggaaaatgaaagagatgaggaagtaacttgaagatgtgaaagtgaggctcagagggttgcacagaggagtgcccgggcaccatgagtgcctccatgatggtgtgaggctgtgaggcccaccagtgcagccaagatactggggctggtaacagtgagcctcaagcagacatcccagtcaccagctgccctgttgtggctcctgaagcagggtttacggggagacaacatatatccccttctgtgtccaagcttgtgaggcctgtcagaaaaaaatccgctattttcatgaatatagaaaatgttctgcttctcactatatgaagacaccgtgcctaaaaatgccaagttttggccaccacagtgggctctgtcactgacagctgtgcacgctgtatcatgaaggccttaggctggacttctgatcaatgcttatgtatctgtagccatcttgatcagaatgatccaggcaagggccgccgtgtctccactgcccgagaggtatgcaaagaacaaagctctaagagcaagcgttgagtctccctgcattggcccttagggatctgctttgataaaaatctgagactggatcagagggctggaaataagctttttttggagacggagtttcgctcttgttgcccaggctggagtgtagtggagcgatctcagctcactgcaaccttgcctgctgggttcaagtgattctcctgcctcaggatcccgagtagctgggactacaagtgcatgccaccacatccaactagtttttgtattttttgtagaggcgggtctccctatgtcacccagactcacaaacactcttttttttttttttgagacggagtctcgctgtcgcccaggttggagtgcggtggcgcgatctcggctcactgcaggctccgccccccggggttcacgccattctcctgcctcagccttttgagtagctgggactacaggtgcccgccacctcgcccggctaattttttgtatttttagtagagatggggtttcaccgtgttagccaggatggtctcgatctcctgacctcgtgatccgcctgcctcggcctcccaaagtgctgggattacaggcgtgagccaccgcgcccagcccacaaacactcttaagaggccaaatgtgtgtgtgtgttttttttaaataacacaactccttagaagtaaaatttcatgaaatatgaaggaaataaaatttctaaaatattcctactaataccagtttttttattttcttgagtatttttggcttttctttctttggtttcaaagacaaatacagtcagtgttaaatccagcaacctttgattaccaatggaaacagatgcacagactctgacggtcatgggaagggactgctgaacatagagaacacctttccaaaaagggtgctgcgtcagacagagctgtgtggtttacagggtcagtgtgagctgcctggctggactcccagcgatggccaggggctcctatctgtaggcattaccttctcacagaaacaactataagcactgcacaaactacaaaacgaaacacctgaaagcatgaaaacaggagcaggtagaaactggaggagtctcccctgggagaaaagaaaggcaggacatggtttgttcttaaggagctttctctgaggaggggactgtctgtgacaaccccagggctacagcctcacacacaagacctgtggccaaggtcttcaagagccagtagacagattactgggcaaccacagccagaaagcgaaaggataacaactacaaagaagaaagccacagaaagggagtcccaaactacacacacggctgaccagatatccgacacctgaagtgcacaggcatgcagcccagccagcgcagaaaagctgaacagaggtttctgctgctgccacacaagaaagacagagatagactgcctgatacaatgacactaaacatcagttagttctggagaatgtaaccggacacaaagtctctatgacacaacatttacaatgtccagaatacaatttgaaattactacatgtactaaaaaaatagcaaaatgtcactcagaatccagaggagagatccacaaggaccaacctcaggaagatgagatgctgggatcagcagacaagaactctaaaggcagctattaaactctccttgtggatgcaaaataaaacatgctattatacaaggacagggaatctcagcaggaaaataaaaaatttctaaataaaagcaatagaaactctacaactgcagaaggaatatctgacataaagaacctgctggatagccttagtttatcagaggtaacaagtacatgaacttgaatggaaataaaaaggttaaaagcaagtaagtggtgctaacaacaacaaaaaggaacaaatctgaagaagtgggaaagtgatgaacaaaccccagccccctgagcctcggggacagcacagatgcgtgtgtattgcagcacagaggggcagggactaaggacagaagatgcatttgaagacatggtctaaaacttcccaaatttggtgaaagacaaatttatagattcaagatgccaaagtgcaataaatgcaaagaaaatcacaccgaggcacctacgtgcaaactgctaaaaaccaaatctttagattgttaaaaaaaaaaaaaaaaaagaaaaataaattaaaaaaagagtcaacccataattctagatatccagcaaaaatacccttcaagaataaaggcaaaatataaatcttagagaaatgaacactaagtgctttgctagcagcagacctgagaactgcattaaccatgacttgttccgggtagggctcccggccgaaaggacgcccgcagaaggcgcctttgcaggagagcgggaagggcactggacatggaagatctctctggagggcagagtagatttacttcattcttttctctttgagacggagtctcactctgttacccaggctggaggtgcagtggcgtgatctcagctcactgcaacctccgcttcagttcaagtaattctcctgcttcagcctcctgagcagctgggactacaagcgcatgccaccatgcttggctaatttttttatttttagtagacacggggtttcgtcatgttggctaggctgatctcaaactcctggcctcaggtgatctgcttgcctcggcctcccaaagtgctgggattacaggcgtgagccaaccatgcccagcctatttcatgcttttcatatttattcacattataagacccctaatttcttaagaatgtttaaagtaaagaatacaacaatgcatcatggagctaataacacacacaggtgtgatgcatatgaaaaccacaagagtgagcaagggcagacagcaggcccgtgtggctgtgagttccttacgtttcctatcaactaggaccaagttaactagaggaccgcgagacattgggaatgtacactataatccctaaagacaccactaagacatcaggcaaaatggtttacctacaaagcccacagacaaagtaaaatagatttctttaaaaaatcaagtaacccaggccaggcgtggtggctcatgcctgtaatcaagtaactcaaaggaaggtaggaagggaacaaccaaaaaacaaaaatgaagggacaaaaaggtggcaaagtagcagagttacaataagaaatataaatgtgcaaaagcatattccaaaggcgggcagaaaaaaccaagacccaacaatgatgcgaggtctgtaacagactattttcaaagacacagttaagctgaaaggacccccatgaaggcaggactgactacattagtatcagaaaaagcagcggttcccaacaaagagcattatgagtgagaaagaacagttcatcatgagagcagggtcacagggtcaattaatcacaaagagacaacaaatgtaaaggcatctactaaaagagctcaagatatctgaagcacagattgacagaattaacaggaaagttagaaaatccataatcattttaacagccctgcatgagcatttcatagaaagacacagaatatttgaacatgccaaaaatcttgctctaattaacatgtatgtagaaaatcaggccgagatacaacaaaaacacatatcattcccatgtgcacacagcgcggccaccatgacagaccatcagctccattaaaaacaagcctcaaatgtcaaaggactgaaatgataccaagtgtgtctttaagcacaatgacatctaattagaaatcaacaataactaagaaaacttcagatatgtaaaaattatacatctaaataacctataagtcaaataagcactcacaaggatattaaaaatttcacattgaatgataattaaaatacaatataggctgggagtggtggctcaagcctgtaattccagcactttgggaggccgaggcaggcagatcacttgcagtcaggagttcaagaccagcctgaccaacatggcaaaaccccgtctctactaaaaatacaaaaattggccaggcgtggtggtgcacgcctgtaatctactcgggaggctgaggcaggagaatcgcttgaacccagggggttgaggtttcagtgagctgagattgcaccactgtactacagcctgggtgacagagcaggactccatcttaaaaaaaaaaaaaaaagacaatatgaaacaaatgtgtgtgatgtggctaaagccatgcttagagggaaacttaaaactttaagtgattctatttgaaaaggaagcaaaccagtggcctacagatctacttcaggtagctggaaaattaagaaggcaactccaaagtaagcagaaggcagaaaagaacagagaacagaaatcaacaacagcagcagcattatctttcaaaggacaaggttaaacttgtaatctggccaaaattaacttatttaacagactgcttaatgggtgtcaactgtagtactagtgactccatgaactgatttctttggctgcatgtgaagtgggcggagtgttatcaaaaagtactggggcataaaatgtctgagaacaaataatacagccagagaggtaaaatattagaatagtacatcctctttcagcaaatgtatgcctttcatgatgaattagtgtcacaagtaaataaaatcttggtgaaataatagactacctagcacttacggccacagggctctattatgcctcatttgcagagacagggtctcgctttcgcccagcctggagtgcagtggtgcaatcatagctccctgcagcctcaaccacccaggcttgagccatcctcctgaggagctgggaccatagttgtgtgccactgtgcgtggctgtttttcattttttgtagagaaggggtctagctttgttgccccagctggtctcgaacccctggctccaagctatcctcctaccttggcctcccagagtgttgcagttacaggcatgagccaccatgtccagcgcaaatccacaggtttcttactggtaaaggcatatcaggcttgtttttagtttcattttcagaaaacttctggccattactgtgacttttatttgaaccagtctcatttaatgattcataaggccgggcgcagcggctcacgcctataatcccagcactttgggaggctaaggcaggcggatcacaatgtcaggagttcaagaccagcctggccaatacagcaaaaccccgcctctactaaaaatacaaaaattagctgggcgtggtggcggacacctgtggtcccagctacttgggaggctgaggcaggagaatcgcttgaacccaggaatcagaggttgcagtgagccaagaatgcgctgctgcactccagcctgggtgacatagtgagactctgtctttaaaaaaaaaaaaaaaaaaaaagaaaaaaaggctgggtgtggtggctcacacctgtaatcccagcactttgggaggctgaggtgggtggatcacgaggttaggagatcgagaccatcctggctaacacggtgaaaccctgtctctactaaaaatacaaaaaagaaattagctgggcgtggtggtgggcgcctgtagtcccagctactcaggaggctgaggcaggggaatggcgtgaacacccaggaggcggagcgtgcagtgagccgagatcacgccaccgcactccagcctgggtgacagagcgagactccgcctcaaaaaaaataattaattaattaattaaaaaatgattgataaaaagtgagtatccaaagcatataatgtaccccaggtaaacagcttgtgtcacttgaagcttatgaacaaggacaggtacctgtgtgtcctgccagctcacgactcacgcgcacgttcccctcacgagttttcagattgtaaatggagcaaatgttatccaggccaccgcaggccacatagttcccagaaggggcatatgcacaggtcatgacccaggaggagcgcagagggatggcgtggacctaatgacagaaagacagatgatgcaaacaactttatgttcaaaaacaacactgacaccaggattttctcatctccaactttcactgcaaaggaggtaacagaacaaaataagagccaaaattatctagagagcgattcccatatgtggccactcaggtgaagcatacttaatgagaagtccagtgctgcacatgggattcaaattcaatccacacagtccagttttactgaagtcacaacttatgattaggtggagtcttaacagtagtgctgcccactcatcaaaaccacattaggccgggtgcggtcactcacgcctgtaatcccagcactttgggaggctaagtcgggcagatcacctgaggtcaggagttcaagaccagcttagccaacatggtgaaaccccatgtctctactaaatataccaaaattagctgggcgtgatggcgcatgcctgtagtttcagctacttgagtgactggggcaggagaatcacttgaacccgggaggcggaggttgcagtgagctgagatcacgccactgcactccagcctgggcaacagagcgagactccgtctcaaaagaaaacaaacaggccgggtgcggtggctcatgcctgtaatcctagcactttgggaggctaaggcgggtggatcacctgaggtcaggaattcgagaccagcctggcctcaaattggtgaaaccctgtctgtgctaaaatacaaaaattagctgggtgtggtggtgggcgcctgtaatcccagctactcaaggaggctgaagcaggagagtcgcttgaaccaggggggtggaggctgcagtgagcagagatcacgccactgcactccagccagggcggtaagagcaatgctccgtctcaaaaacacaaaaaaacccacacgtattggaaggaaaacactgcattatcctgtcaaatggctatgaactcatctgaaaacaaaaaatttttttttcgagatggagtttcgctcttgttgcccaggtttgagtgcagtggcgtgatctaggctcactgcaacctctgcctcctgggctcaagcaattctcctgcttcagcctcctgagtagctgggattacaggcgcctgccaccactcctggctaattttttgtatttttagtagagacgaggtttcaccatgttggctaggctggtctcaaactcctgacctcaggtgatccacctgcttcagcctcccaaaatgctggaattacaggtgtgagccacggcgcccagccgaaaacaaaagatttttatggaataaccaaaatggacattcctacaatctaccctgccacatctctcccactgttttagatctgctgtaattaatgcaatcatttatacacatttagtattctttagtaaaataaactgaattacatcttttacatacatgtttggaccaatgacaatactttttattcaaaacaatacactttggattaagtcttgaaaataacataaattacactttaaagtatgatgtctttcagatgatctcttctaaaaacttgtaactgaatgaaaagtgatacttctgcactctataaataaaacatgaaacttcccagactctgctaaaactggaattgaggtctcctagaaacacagaaggtccttagctcccaccagcttggtaaggagatgacggacaacagcacaactgtgcctggtccagaggaagagaccgtgacaggtggcacgtgactcagcttctatctcacctgcgcaacttcactactaacaaacagagcttgccgctgctgccttccctatcctgtattacgtgatttaacaaaatgaatccagagcttaaaaccctgtttcctgggttggtttttcaaggaagggaatcctccagtccctaccttgttggtggtgtagctgtcccagatgataagtttaccatcctgcgaggcactgacgagaagcctggagggacagacaaaagcaaacctatcagtaccgcacaacacagaaagtgtacaagagcaacagactaaaacccagactctggtggcttatgtgctcccatgttacatgtgcttcagacaaagccacttatttataagaaaaaaaatctctggtcgggcacagttgctcacgtttgtaatcccagcactttgggaggctgaggtgggcagatcacatgaggtcaggagttcaagaccagcctggccagcatggcgaaaccctgtctctattaaaaatacaaaaattagccgggcatggtagtgcgtctctgtaatcccagctactcgggaggctgaggcagaagaatcgcttgaacctaggaagcggaggttacagtgagccacaatcatgccactggacaccagcctgggcaacagagtgagactctgtttcaagaaagaaagaaagaaaggaaaggaaggctctaaatgtcagaccaacttcaaagcatgaacaaaaacactgtcacagaccacagttgagagtggagatgcctggccccaaccgaatgcaggccacatcacccctggcacccattccctttgtcagctgagacaggctgacatcatttcataagtgtttctgtttggtttcattacaaatcaaattagaggctcatgtctttaatcccaacactttgggaggccaaggtaggtggatcacaggagtttgagaccagcatggcctcatgctagcatggtaaaatcccgtctccactacaaaaacacaaaaaaatagctgggtatggtagtgcatgcctgtaatcctagctactcaggaggctgaggtgggaaaactgcttgaacccaggaggcgggggttgcagtgagccaagattgcgccactgcactctagcctgggcaacagagcgagatcctgactgaaaaaaaaaaaaaaaaaaaaaaaaaaaaaacaaacagaaagaacaaaccacttttagacattccaaattcatgaaacatttctcacccaaaataccccatgaaatttcccagactgagctaaaattggaatcaaggtctcctagaaaccaaaggaggcgttccctcctcacctgcttggtaaacaacagcaccactgcgcatggtccgggagcagagaccagtaactatcacgaattttttctttttttcttttttttttttgagacggagtctcgctccgtggcccaggctgcagtgcagtggcgccatctcggctcactgcaagctccgcctccggggttcatgccattctcctgccccagtctcccgagtagctgggactacaggcgcccaccatcacgcccagctaattctttttgtatttttagcagagacagggtctcaccatgttagccaggatggtctcgatctcctgacctcgtgatctgcccacctcagcctcccaaagtgctgggattacaggcgggagccaccacgcccggcctcttttttttgtttttgagatggagttttgcttttgttgcccaggctggagtgcaatggtgcgtcggctcaccgcaacctccacttcccagatttgagcaattttcctgcctcagcctccaaagtagctgggattacagacacgcgccaccacagccagctaattttgtatttttagtagagacggggtttctccacgttaatcaggctggtctcgaactcccgaccctcaggtgatccgcccacctcggcctcccaacgttttggtattacaagcgttgagccactgcgcccgaccatgaattttttcataactatttccttgctctggcaactgtgctcagttcggaatccacatgttgaaaaggagctccatactacaaaggagaatatgaataaggagcaaaagaatttcaccttagcaggcaagtaaggtgggtgaaaggtaactcctgggaaccacagttgcttatgagaggtcctaaggaaccctgtagcacagaatgctgttttcaaggaagagcaagaaggttccactgtttgatgcagggatatctgtcagtacggtaaatgatagtataaggatttttaattttaaagtttctatcaaacgcaaggttttttgtttgtttgtttttgtttgtttgtttgtttgagacagagtctcgctctgtcacccaggctggagtgcagtggtgtgatctcagctcactgcaacctctatctcctgggttcaagtgattctcatgcctcagcctcccaagtagctgggattacaggtacgtgccaccacacctggctaatttttgtatttttagtagagatggggtttccccatgttacccaggctggtctccaactcctggcctcaagtgatccgcccaccttggcctcccaaagtgttgggattacagacataagccacagcgcctcaaaacacaggttttaactatttcagctgtgaacatatgtggcttcttaaagctgacctaaagctggagtaacgctctctcaagttttgttgataactctgacacttttaatatcaaactagatgttttgatacaggtgtcaatgagtttaagaacaaataaaaaccttttcacctgcactttattacaaaatttatcacagaactaaaaactaagtgcaggctcccatcctattatttttcagatgcaattttttttttttttttttttttgagagagagtctcactctgtcacccaggctggagctcgctgcaacctctgcctcccagatgcaagcaattctcgtgcgtcagccttcccattagctggaattacaggtgtgcaccaccatgcctggctacttttttgtatttttagtagagacagggttttgccatgctggtctcgaactcctgagctcaatctgcctgcctcggctgggattacaggcgtaagccaccgcacccagccttcagttgcaattcttaaagcaaacttctcaatccaggttgtcatcaacatattaaacatttaaaattatttctacgtaatggtatcatgttcccactctagctttatttctgcccagcccttctgagactttctgtcgagtatcagagctgatctaaagcagctcatcctcctagattaggaggatcacctttacagaggtctcccggtcagagagcttaataactgctgacttccagagggattagggacacgtaagctgtccactgatcctccagaaggtgagagaagacatgcctcctagtcccgggtcagggagctgttggaaagctgggttcacgttgcctagtagtgcctttacctactcaaaaatcaattatctgaggtgccactcacctagaacatagaggcaagggccaggaagcaagctaacaggctccaggaccctgaaagtagctgtcaaaaatcaaaacacctaatgcccttcattttactcaaaggagggagggtggtggctcatgcctgtaaccccagcactttgggaggctgagataagaggattggttaagtccaggagtttgaaaccaacatgggcaacaaagggagaccctgtctccacaaaaaaatatatatatatattttttgagatggagtctcgctctgtcacccaggctggaggatctcggctaactgcaagctctgcctcctgggttcatgccattctcctgcctcagcctcccaaatagctgggactacaggcacctgccaccgcgcctggcttattttttgtatttttagttgagacagggtttcattgagttagccaggatggtctcgatctcctgacctcgtgatccgcccacctcagcctcccaaagtgctgggattacaggcctgagccaccgcgcccggcccacaaaaaatattttttaaaaattagctgggcacagtgatgtgcacctgtggtaccagctactcaggaggctgaggcaggaggattgcttgagcacagcagttcaaggcttcagtaagctaggatcgcaccactgcattctagcctggacgacagagtgagacccagtctcaaaaaaaaaaaaaaaaaaaaaaagttgccttttagtacaaatatattgataaacatattacaaatgtacatctgatacattaatacatacatacataacaagtaatcattgtgggccttgcatgtagttttcttttttgtttgtttttttgagacagagtctcactctgtcacccaggttggagtgcagtggtgcaatcttggctcactgcaacctctgcctcctgggttcaagcgattatcctgcctcagcctcctgagtagctgggattacaggcacccaccatgaagcctagttaacttttgtatttttggcagagacagggtttcaccatattgggcaggctggtctcaaactcctgacctcaggtgatccacccgccttagcctcccaaagtgctgggattataggcgtgaaccacggtgcctggcctctcatgtagctttatttgtgttttgttttgttttttgaggcagagtctccatccgtcacccaggcgggagtgcaatgcgcatgtttgtgggtatatatatacatatatatatattttttttttttttctttttttgagatggagtctcactctgttgcccaggctggagtgcagtggtgtgatcttggctcactgcaacctccagctcctgggttcaagcgattctcccacctcagcctcttgagtgcagctgaaactacaggcactcgccaccacacctggctaatttttgtatttttagtagagatggggtttcaccatgtcagccaggctggtctcgaactcctgaagtcaagcgatccacctgacttggcctcccaaagtgctggggttacaggtgtgagccaccgcgtctagcctcatgtagttttgaaagacaaactaggccgggcacagtggctcacccctgtaatcccagcactttgggaggccgaggcgagcggatcacgaggtcatgagatcgagaccaccctggctaacacggtgaaatcccgtctctactaaaaagacaaaaaaaattagccgggcgtggtggcgggtgcctgtagtcccagctactcgggaggctgaggcaggagaatggtgttaacctgggaggcagagcttgcagtgagctaagacagcaccattgcactctagcctgggcgacagtgagactccgtctcaaaaaaacagaaagacaaattagtagtcatttctactgtttccgagtgtccataaatcaaacaaacacagttaaaggaatggtattcataggccagacgcagtggctcacgcctgtaatcccagcactttgggaggccgaggtgggcagatcatgaggtcaggagatcgagaccatcctggctaacatggtgaaaccctgtctctactaaaaatacaaaaaaattagccaggcgtggtggcaggcgcctatagtcccagctactcgggaggctgaggcaggagaatggcgtgaacctgggaggcagagcttgcagtgagccgagatcgcaccactgcagtccaggctgggtgacagagcgagactccgtctcaaaaaaaaaaacccaaaaaaactggtattcataaattatagctttaagtcatgaaaaacaagcaataacatttgtttatgaaggcaggaaatatgaagattaaagaaaatatataccctccccactctgtcatgtggtggggggcaggaggagggacagcattaggagaaatacctatgtaaatgacaagttaacaggtgcagcaaaccaacatggcacatgtattcctatgtaacaaatctgcacattgtgcacatgtaccctagaacttaaagaaaaaaaaaaaagcttgtggaacaaggagatatagatatacatgtatatatatacacacacatacatacacacacacacacacacacaccctccccccaaaaaacctcttttggaccttaaagaggcaaacactggcctatccagaaaaaaacggctatttacaacaagcaatctctagaaggctctgaaaagcagaggttctccataatatcattttggttttctcatgactgtgcaattatacaacaaatgccatgcacctagcaccctgtccaagaacatggaccaatgtggcaccccagcctcccacaggcctcactgaagactgccttgctcacagggtggccatgattctgcacttggtcctgttttgtcagcccttgcttttcttccttctaatcctggggctttcaaggcacaaagtgtgtttgagacagacggaacataaagcctcccatgcaaggatctggcgcccaccccacccaccctgagcccccagccccacctccactgctcagttcacacacccatctcttcggtccctgaacacacctgcctgcaggtcactctcatcccttccagactacccagtccagagcccagctggtgaaggagacatattacttggcagtgcagtgctctgagtacctgaacactgcccagcagcagcactgtctactccactaacctgcctaatctgcacatcagtgttcccacacatggaggaaaggccccagaggtaacatactgttttgttttccatctacttttgacaataaattctaacatagatagactagtaacaacattttttcttttttttttttgagtcagtgtcactctgtcacccagtggtgcaatttcggctcacagtaacctccacgtgcctcagccttccaagtagctgggactacagctaccatgcccagctaatttttaaatttttagcagagatggggtttcgccatgttggccaggaggctggtttcgaactcctgacctcaagtgatccgcccacctcagcctcccaaagtgctgggattacaggtgtgcgccactgcatccagccagaacattttttaaaaaattctttttaattttttaaaggaataactttgaattcacaaagtatattcttacttatttacttatttatttagagacagggtctcactctgccgtgcaggctgaaacacagtggggtgatctggaatcactgcaagctctgcttccctgactcctgggttcaagtgatcctcccacctcggcctcctaagtagctgggactccaggtgcgcaccacaacaaccaacttatttttgtactttttgtagagaaggggtctcgccatgtgacctaggctgatcttgaactcctgggctcaagccattcgcctgccttggcctcccaaagtgctgggatgagaggcatgagccaatgtgcctggttacttatttattttgaatatttaaaagaatttttgacaagtaattatatgtatatttacggagtacaatgtgatattctgatatatatccacattgtgaaataaatcaatcaagctaatcaacatacccatcacttccaatttgctctgtggtgggaacacttaagtctactttactaacaattttgaaacacacgttattatgaactactctccgtgctgtgtggcacatttctaaaatttattcctaactaaaactctgtaccctcagaatatcatctccccacttccccaccctcccccttcccacttttattctttctgactcctgctgtcattggaaccatcatgcgagctctcatttgcatggggaattgtatgggatactatatagaacaaactaaagatagaatcttttgttctctagctgtttgtgctctaaagcggacaatttcacgaacaaagaaaaagcctagcagaaaattccacgctaacaacggaatacaaagaaatactactcaaagaagggcatgttaaaaattgttatgtcaggtgcttcaacgagcatgtcacagttacacaaatcaaacagtactttattaaattatttagatagaacaggcaccaaataagactttgtaatagcctctaaatcagagtgtggggtcacggaagggagatgcctggtggagaagaaaggggtataatttaaagtacaagaaataggctagaagtggtggtggctcacacctataatctcagcactttgggaggctgaggtggaaggatcacttaggggccaggagtttgagaccagtgtcagcaacaaagggagaccctgtctctgtaaaaaaccaaaaaatattagccaggcatggtggcacatgcctgtggcctatgccacttgggaggctgagtaggaagggttactggagcctaggacgtcgaggctgcagtgagatatgatcacaccactgcactccagcatgactgagtgagaccctgtctcaaaaaaaaaaaaaaaaaaaaaaagaaaaaaagaggctgggcgtagtggctcacgcctgtaatcccatcactttgggaggccgaggcgggtggatcgtgaagtcaggagatccagaccatcctggctaacatggtgaaaccccatctctactaaaaatacaaaaaaattagccagtgtggtggcaggcgcctgtagtcccagctactagggagggtgaggcaggagaatggcgtgaacccgggaggcggagcttgcagtgagccgagattgccccaccgcactccaggctgggcaacacagtgagactccgtctttaaaaaaaaaaaaaaaaagagaaaagaaaagaacaaataggagcccatgaagggaattatctcttgggatggtaaaccaaaggaaggcagggcagacaggccagatgagagaatggtgagagcagctcacagcgcattcccgtgtgtctgccgcagcaaagcacacacagcacaatgctgttctaaggctcaatacacttaatccctcaggatcctcggggcaggttctgtgatttcctgagccagggcactgacatcacaagagggcgagggccaaccagccctgagaaacaggcacagagaggtaacttccccaagttcacataagtaggatgcagtagaactgggaagacagaggtctagaaactgaaagagacaggagaagggagaaagaaaaatcagaacttgtattaatgtgattcagacagtgaagaaatggcagtgttctttcagcccaggtaagtggaaaactggacagggaatatgcacctgtgaacgctgcaccttgcgtgcccagagttctgattcaacttcctaatttcttcactgcacagcacagcaaatgggttcaggtacttttcccctaggacaacagagcagcccctgaatgtaacaagcagcatcctgctcatgcccacgcctacctggagtctgtgccccagtgcatggcgtagatcttggccaggtgcccccgcagtgtcctcctcgtgcgcatttggattcttcccactgggtcgatgttgtttgtgatcttgaaaataaaaacatttctgtaaatcaacatctgtgattaaacgattctcctcatcacccatccttgtcaaggctgttggctcgcccactgtgcctacctcttcccagcccttcccacagttctccagtggcttccactgtggcattctgcactgaaccccttccgtacctcttaccaagtctcagtctggctggtcatcaggaacctgtgtgccctgccctccaatgcacgcacacgaacatggccagccttgaagcacttgctgttcccttcctgcttccttcctcctctccctgtccatccaggaccatctcctcctaggtctctgagttctttgagatctcgcaactcttcttatgacaccacacagatgtcccacaccacaatttaatagctggttcctatgtcaggctatgtgtgggcctgcatgacacctgcttctgcacgaccatcacttggagcaccagctgtacacacacctgctgagcccatcctacatatagacactgatgttaatgagtttaggttggcaaacggagtaagtggattacaatagtgggttttaaaaacggacagtccaaagtgcttctcagaattgaaattcaggtaattctatgtagcctaatttttttttctttaacttacaatttaacctcaattaaagcacatcccctaaagcatttagacaatgtaaaaaacttaatcatcttcagtagaagtaggaatatagtttttctttcacatttctgtccaattatttggactttatttttattatcttttttttttttttttttttttaagatggagtctcgctctgtctcccaggctggagtgcagtggtgcgatctctgctcactgcaacctctgcctcccgggtccaagcaattctcctgcctcagccccctgagtagctgggattacaggtgtgtgccaccatgcctggctaatttttgtattttagtagggacagggtttcaccatgttggttaggctggtctcgaactcctgacctcaagtgatccacctgcctcggcctcccaaagtgctgggatggacttcatttttttaataaggtgaagttcacgtaacatccaattaatcactttaaagtctacagttcagtggcatttagtacactcattgttgtaaaaccactgccaccatctagttccaaaccatcttccaaaaggagaccagacattgattcagcagtcactccctgttcacttcctctccctctctcccctaacacccctgctggccactagtccactctgtctcagtgaatgttactattctagatatttcatataaatagaactaaacaatacatagccatttgtttggcttctctcactatcgtaatatttatggggtttatccacgttgcagcctctgactgtactgacgtccatttaatggctgataatactccagggcacagagacaccacaatttgtttctccactcattcatttatgcacattttggttgtttctacattttggctattgtgaatggtgctgctatgtacatgtgtgtgtttgaaaagcagtgttcaatcctgttgggcatatatttaatggcagaactgctgagtcatacaataattctatgtttaactttttgaggtattatcaaattggatattagaaatagaagttctgaggcagattctgttgaggagaggagcttcaaaatatcttaagacaataacaatattttacaactattaccctctgtaacaggtagatgattattcaaggcttgagatatctcatttttatctcaataagcccctctatttcctatgcctaccatcagaatgacttcttaataaaagcagtggcttggcatcctcactgcgcaacagagaatgcaagcagagccctcccgaggctccaggtgtgggtgccgtgctagcctcctcacaggcagatggctctgcgtgactcagtgggctcttacctgagagagagttgcatctgcacatgctttcctggcgtcctgggaagcaaggacagtgagaaattagcaacctttcagatacattcaatctcaggtccacacataccaaagtttcaaagagagctttcctaagctgtcaggagcaaaagcagaatgtgaaagaacggcagagtctccttgcatctcaacaccccatggtctactaccatctgtggactgtccaggccacgctgaacagagaaccagtagtacccaaatctgtctaagacctgcagcacaatattcctggggacccacagctgtggccagcaccgaggagaccacactgcaagctggggcagcacccacacacccgggaccctggtgctgcctgtgccctcactgctgcacaggctggcacacacgacttgctctttttacaaagcccatctagggtcaggaaggctgtggcccaaagaaaaggtctattaaaaaaaaaaaaaaaaaaaaaaaagtctaaaaaggaccagatacccagcccaaaaaaacttttcttcagactgcattaactaagtactttgttttcaagagaaacaatcattaattctaaattctatggagggcgcggtctcacgtctgtaatcctagcactttgggaagctgaggcaggaggatctcttgagcccatgagttcaagaccagcctgggcaacaaagtgagaccttgtctctactaaaaataaaaattaaaaatttaaggaaaataggctgggtgtggtggctgacacctataatcccagcactttgggaggccgaggtgggtggatcacctgaggtcaggagttcaagaccagcctggccaacatggtgaaaccccatctctactaaaaatacaaaaaatagctgggtgtggtggcgcacgcctgtaatcccagctactcaggaggctgaggcaggagaatcacttgaacccgggaggcggaggttgcagggagccgagactgcgccactgcactccagtctgggaaacagagcaagactccatctcaaaaaaaacaaaaataataataaaataaaataaaggaaaacaaagaaaaataaataaattctatggaaaacgagcaagggacctggagccagacaatcagatgtacatgagcctcttggctgttctcgttgctcatctacaaatgacctgcggctgcaggtaggcactgtgaagggatccaccaatgctaactcaagtgtcttcattactaagggatcaaagttactagaaaatagacctggaaatctcaaaagagaacgtacgtttagaaatagaaaggtacgtaacatgaaggaaaataagacaatggctaacaggtttaaagtttgagtgttggtataattttttttttaatcacaactattttttttttttgagacagagtctcgctctgtcttgcccaggcgggagtgctgtgtcgcgatctcagctcaccgcagcctccgcctcccaggttcaagtgattcttcccgtctcagcctcttgagtagctgagaccacaggcgtgtgccaccacaccggctaatttagtatttttagtagagatgaggtttcaccatattggccaggctggtctagaactcctgacctcaggtgatccgctcatctcagcctcccaaagtgctgggattacaggcgtgagccaccccgcctggcctctttttttttttaaactatgtatttatttatttttatgacaggatctggctctgttgcccagcctggagtgcagtgatgtcatcacagctcactgcagcctcgacctcctgggctcaggtgaccctcccacgtcagcctcctgaatagctgggactacaagcatgcattactatgcccggctaattttttttttttttttgtagagatggggatctcgtcatgttgcctgtggctggtcttgaactcctgggctcaaatgatccttcccccttggcctcccaaagtgttgggattataggggagagttaccatgcccagctgacactttctagtaagaaaaatgtgtttatatgctgtcatctgaccatctactttcaaaatggcaaatggcatgtgcagcccttacaggcgtgcgtccaagtgccccacatggggaaggtggaggacgagttcccagcggttcaggcttttggggcaaactgctcactgcaaatgatttctactttaggaagcttgtgggaatattataaactgataatatggaaatatattggtcaggcgcagtggctcatgcctgtaatcccaacacctcaggcggctgaggtgggtggatcacctgaggtcaggagttcaagacaagcctggccaacatggtgaaaccccatccctactaaaaacacaaaaattaaccaggcatggtggccggcacctgtaatcgtaactatttggggaggctgaggcaggagaatcgcttgaacctgggaggcagaggttgcagtgagctgagatcacaccactgcactccagcccgggcaacagagcgagactctgtttaaaaaaaaaaaaaaaaaaaaaaaaggaactatactgagattattataaatataccaaatttatacattccaaattcatctttagttaagctctttattggtcattctgcttataattaagacacacacaaaaaaatcgagtatttctatgcaagcagtaacatttggagtaagggggatgaagaatacttagagcagcagaagtctttttgtcaatgaattttactggcaagtactgagtttaatatttgtttttgaaatactattcttgttgatgttacagcctttgattttaaaacatcataagaaaatttaaaatggagaaaataaaacatgagatttaagcaacttcccccggttagtgtccaatgactaaaatgagtttcttaaggtacagtgtaacagactgtggtgatactactgttaaaccgaaggaaaaactactgtaaaaacaacacacagataacttcaattcaatctttattttagccaataaccagcttatttaactgagtgcagcactttgcagaacagacaccttcaacttttaaaactgtaggaagaagtcttttaatggaaacaagctctataactgcttaacaaagaagaaaaagtcttcaagttctttcagattaatttccagtttaatggactcctgtagatacatattatgatgtccacttaaaccagagatgaacatatccaagccactcatcagttgatttctcattctttttggatttgtcaaatgacacagtaacacacttactttggggtttcatcctaaattaaagcctgggccctgctcagcatggagtcgctggacattttggaccgggcatccattgcagctgcctctcgcacgaatggaccctgctcccttgcactggctggcatgccgctccagaacacatctacgcctgtgcatcctgtggagctttccttactccatcagctactctgtgtattttaaggcacaccatgttttaatcagaatccctctgagagcctgtgtttcctcaataataatcaaaaggagcatgcaaggtcctttaagggtcttttggctgaaaaacaaatctaagaaagaaaacagccccttttagaatcatctacaatttcttgtttgattcactatgctctgcattctttaacaagcacgtattccttgggcaatcaggaaaaaatgttctacattttaaaaataagtcttcctttcccatttggggtaaaaggacttcaacagcttttgctgtccctgtctcgtgcaaaggaactaacacagcgcggttcctggtacttcggagacaaagcagctaggcgcctctcctagtgaacgtcccaccgcgggggccatgacctgcctgtggctgctgcgcacagcaaacggaaccaggagacttgggacaaaaacagtgtcaaatatctcaattaaaatgtattaattacacattgcataataaataatattttagatatactgccttagataaaatttgttgggccaggcatggtggttcacacctgccagcactttgggaggctgaggcgggaagatcccttgagccctaggagttcaagaccagctggggcaacatggtggactctgtctctacaaaattgaaaaaaaccagccaggtgtggcagcatgctcctgtagttccagctactcgggaggctgcagtgagctgtgatcgcaccactgctctccagcttgaatgactgacagagaccctgtctcaaaacacacaaacaaaaaaatgaaaaaaaccttgttagggttaattccacccgtttcttttcattctttttcaaaagacagggcctttctaccttacaaaggctggtctcaagcttttgggctcatgcaatcctcctgccttggtatcccaaagtactgggattaacggcatgagccacggtgcctggccgtctctctttttactttttttttttttttttttgagacggagtctcgctctgtctcccaggctggagtgtgcagtggcgcgctctcgcctcactgcaagctccgcctcccaggttcacgccattccctgcctcagcctcccaagtagttgggactacaggcgcccaccaccaccacacctggctaattttttttgtattttttttcttttagtagagacggggtttcaccgtgttagccaggatggtatcgatctcctgaccttgtgatccacatgcctcagcctcccaaagtgctgggattacaggcgtcagccaccgcgcccgacctctttttacattttttatgtggcaacaagagcatgtggggaatgtcacgtgacatttgtgccagcccaagagggagccccctgtgcaagaaggccctggggaattcacaacgtgacagggtccaaacctcggaaggaggtgcaacagttccttttggccttaattttttaaatttgggtgtctttcacctgtgccatacaagctctttccatctgctatgaatagatccaagtccactatttgtgaacaacttatagctgtcagaaaaacaaaatttcttcaaatatgccaaatcaccctactatttaagacattttcagggtaaactttaaaattctgatttctaggccgggcgtggtggctcatgcctgtaatccccgcactttgggaggccgaggtgggcggatcacgaggtcaggagatcgagaccatcctggctaacacggtgaaaccccatctctactaaaagtacaaaaaattagccgggtgtggtggcgggcgcctatagtcccagctcctcaggaggccgaggcaggagaatggtgtgaacccaggaggaggagcttgcagtgagctgagatcgcgccactgcactccagcctggggaacagggcgagactgtctccagaaaaaaaaaaaaaaaaaaaaaaaaatctgatttctataagatgaaatatagtctcaaaagcaggtggtaaagagctgagagtgttctgaacccccccaaaaacccagttagattattattaaataacaacactttgcttttcttttttacttgccaaaaaccatgctgacttaaaatgaacagcagaagcttaagtattaagtcaggcaaaatttgaataccttttggttttatttaaatagatatttcagagaataattttatatcaaactaaatatttcagaacacatttgattaattttggtggaggggacatgttaaacaagtctgatcagagcaaactattaaaaaaatctaagtcttccctattcacctatgtaagatcttttaaatgttaagatttaaaattcttacagtagaggatactttgttttctctttggctgtaaatctcagagaattccattattttttctcaagttcaggaacaagttgcctaaaattatgttggtgtttctctctccaaatcctggtgggctttctaaacatgtaattggccgtttaaaaggaaatacttgacttcatccttgcactggagtcagaaaaataaactgttgttttttattttattttactgtattttgagaaggtgtcactttgtcacctaggctgcagtgcagtggtgcaatcacagcttactatacagcctcaacctcctgggctcaagtgatcctcctgggtagctcagactacaggcgcgcaccaccatacccagcttataaactgttatttaggtatgtactgaatgtcatcagcttcctgtacagcgacactctgaagaacagctaaagcttgacagagcaaacaagagtaagagaaagctcttacatcaaatggacaaaacctaaaaacatactgaagacgtggtttttcctgagaagtctgcctctttttctcttactcttcacatcagcagtttcagaaaggaaacacatacttgcattaaatgtttctctataaaatatttactagaagtactgcttcacaaaagtaggagcagcagaatgaattccatttagacctactgctcctcccttttcagaaagttatgaggcaagagaattgcttgaaagaggttgcagtgagacgagatcgcgccactgcactccagcctgggcacaacagagtgaaactctctctcaaataaaagtttatgaactctgcaatttaacatcctacatcagtcacagactggaatttaatgttttagaattctgtgaaaggtattctttttacagtgcagtttatttacacacggtaaataaatttatcttcaattttttttttatttttcagggtctcactctgacgcccaggttggagtgcagtggcacaatctcggctcactggatcctctgcctcccgggttcaagggattctctgactttagcctcctgagtagctgggaatacaggcacacaccaccacacccagctaatttttatattttttgtagagatgggggtttcactatgttgccctggctggtctcgaactcccgacctcaggtgatccacccgccttggcctcccaaactgctgggattccaggcatgagccccccacacccggcctctatcttggatttagatatatctgctccatctagcagtctatcagaagctgtagattccaatcatcaccgctagggaagatctttcaaaattaggaaaaaatacatcagatatacctgaaatactttttttattgttgttaatactcttacttttaagcaagttttctgctgtcaatagtcccaatattcaggggagggaggtagatatcacagtctgatcagtggcccagggtatcacaaattttcaaggttatgataaagaatgcaaaagacacttataaattctacggagacatctggtgtatattcaaataacaaattgtatacagaaagcaaaatcccaaaaacaatgtactaggctaagtatctagatctataattagtacatcctgggccaactaagattcaatttcatataaaacatagaacaagtcatcctgtaaaccatttttcctaaaacaagtaacatctaacctgaaactcaaatgattaataaaaccaagcacacacaactacatactcgaatctggttcttaagttgctcggcctcctgccgtaactggtcaagctcactcatcttccgatcttagtgctcttcaatgccaccttcaagaatgtgagatctgaaacagaaagacaagcacaatcaataaacaactgttggataatttaatgaagcaggtgagaaaagtaaattgaaagtttaaggtgggcgtggtggctcaagcctgtaatcccagcactttgggaggccgaggcgggcagatcacgaggtcaggagatcgagaccatcctggctaacacggtcaaaccccttctctactaaaaatacaaaaaaattagccaggcatggtggcaggcgcctgtagtcccagctacttgggaggctgaggcaggagaatggcgtgaacctgggaggcagagcttgcagtgagccgagatggcgccagtgcactccagcccgggcttcacagcaatactccgtctcaaaaaaaaaaaaaaggaaagtctgagaactatggtctcattacaaaccagagaacttttcttcagcattcatcagaacttatacaatggctaagtagggccaggtaaataaaatataattatgattatttattggctttgcataatattacaatgtctaaaatactactcaacatatgctggtgggttataaaaagaaaaatctgttaagcatttttcataaaaaaatctaggtctccctataaatccaagaacataagactgacatttaggccaggtgtggtggctcatgcctgtaatcccaacaatttgggaggccaaggcgggtggatcacttgaggtcaggagttcaagaccagcctggctaacatggtgaaacccgatctctactaaaaatacaaaaattagctgggcatggtggcacacgcctgtaatcccaactacttgggaggctgaggtagaagaatcatttgaacctgggaggcagaggttgcactgagccaaaatcacaccactgcattccggcctgggtgacagagcgagactccatctcaaaataaaaaaaataaaacctgacacttaggatagctatcgcatgaagacctaggggaagttacttcagggaacgggggtgagtggcaacctggcaaccaagaatctcaaagccacctcatctcagtaaccatgaaccgctactggtcaaaagctgtcaggatgctcacacagcaatcctgagcacacagggtgtgtccagcagttttttggctcagggacaacccactctcccacccaagtgagccctgggatcccaggaggctcagaaacaacaccttgatccttataggtgcaggctaaattaggctcagtacaagccgccctgccttctcgccctactcacgttagacaatattcctgaaatcaaagtaaaaactaaatcaccttgttaaacaagagacttattttcccaagagaatgtcataaatggaggctgcatttctgaccaagatcttagctgttaatgtatgactgaagatcttggctgttaagtatgactcaagtataacaaagctgaggacacagttgctaatgtctttaatcccttacaattagctctcacatgcaagtacggcttatgcaagcacttcaatttcctacataaattacacagaggatcaattttaccattataacttttgtgtaagtcaaaaggctaatacaatatacatcaaaatctaactgatagcagttattttcttgagattaaaacccatctgtgggaaactatccgatgacctaagaagctcagccgtcagtttccagtctgaactttcctagtgtgcctaaaggaattcgaataacctacagtatagatacttgatgtctacggtccacagaaccagaaaggcctgcaaggcatgccccgtaacacgagcacgcagaccaggcatcctgctgccactgctctctggggaggcaggctgcacagcaacacggtgtcagaaagatttctgaccaaatagttgtttctaaaggcattatttgaaacggatgttttaatcatgaggaaagcttcactaaggaaaaatacctcaggcctccctgcacacatggagcatcaccggaattaggtatggacaaggtcacacctcaagggcagtttattcttaagggataagactggttaattctttccctggttttcacatataaatcctagcgactgtgatttgtggacgttaatgtgttaagcagtaagagtgccaggacaagatgagcagtgtctcagatggaagctgtctggatgccttgtgctttgcattctttctgcatgccctgacactactcacttgtatttcacacatgatcaaattatattatgcacacaattttgcagagttgggggtagttttatttcaccagcaccccgcacgcataatagagaattgttcttagtctgtaaagctactttaatccttccaaaatcaacatgaagaaaacaagttaatgttatgaagtaccccgaattaaactgttttagttaacacacacagtttctgatcatttaaacactaaaaagtaaagctaatttttatagtacgggactaaaaacaacaaactcctgggatctcgggaaagagaaacgcatgttctgagatgcttcaaaaatgatgttccggctgggggcggtggctgacgcctgtaatcccagcactttgggaggctgcggacaacggatcacctgaggtcaggagtttgagaccagcgtggttaacatggagaaaccccatctctactaaaaatacaaaaattagccaggcgtggtggtgtgtgcctgtaatcccagctactcgggaggctgaggcaggagaatcgcttgaacctgggaggtggaggttgcagtgagccgagatcttgccattgcactccagcctgagcaacaacagcgaaactctgtctcgagaaaaaaagagatgtttcttgtggctggagggtggtgggtgggtgtgtaaaggcccaaattccatcattaggtgggataactcctgaaatcttacatactgcttttaattagatgttcttttcacatattatacaagaacatgtacacaacaatcacccagctgtattgcttgagactagagaaacaaatttaccaaaaatctaagtatctttaaaatgagctcaatataacttagtgacctcacaaaatttcagaagtagtaatgccaaaactcgctaactttcatctttagtcacatgcaaagagaaaaaaaccagacggacttctttttcatagttaatagcagaaattattatagcactctgctgtgccaacatttgagtttcaattcagagactcaaaacctacgtttgtcaattttttttaaaaaggcgtattcctggctgggcatggtgggctataatcccaacactttaggaggtcaagtcgggaggactgcttgaatccagcagtttgcgaccagcctgggcaatatggcaaaacgctgtgtacacacacacatacacacatacacacacacacacacacaatttttgttagcaataaaaataaatttcctggtcaggccctcttcagtccacacatagaagtgataagaaaaatctattgtcaggcatttcaatttttttaaaaaaattacattctctagtctccaggataaagatatattttcttttcttttcttttttgagacggagtttcactcttatcgcccaggctgcagtgcaatgatgcaatctctgctcactgcaacctctgcctcccaggttcaagtgattcttttgcctcagcctcccgagtagctggaattacaggcgtatgctaccacgcttggctagtttttgtatttttagtagagacggggtttcaccacgttggccaggctgtaaggaactcctgacctcaggtgatccgcccgcctcggcctcccaaatgccgggattacaggtatgagccatcatgccccgcctaaaaatgtattttctacaatcaaattgaaaaaaatttttggagataaactcaatgatcagtaccatctttttgttatgtggacatgcaccagacaccctgtacaggagttcaggcacagcagtgaactggctgatgggatgaggcaggagagacgagaaaacgtgaccatcacattccccatgggctgcaagggaaccaggtgccaggaagagcgaacttaagggaagcaaacaaccttctggttcccataaacagccttctcagtggctcttagttcatctttaccgtgaagacagtgaacgaaacaaaaacgaacagtgtacaaagcatgatgcttttgtgtgtacaagaaggacaaacgccaatgccagggcaagccatcttttttcttttttttttgagatggagttttgctcttgttgctgagactagagtgcagtggcacagtgctggctcactgcaacctccgcctcccgatttcaagcgattcttttgcctcagcctcccgagtagctgggactacaggcacatgccaccacaaccggctaattttttgtatttttagtagagacagggtttcatcatgttggccaggctggtcttgaactcctgacctcaggtgatccgcccacctcggcctcccaaagtgctgggattacaggtgtgagccactgcgcccggcccgccatcttttttctacacacaccagatgttatggcgttgtttttggagaaagagaaacaggttagcagcttttattcttctcattattcttcaaatatagtttgcttactaacccccctacacaccaacacacgcatacaaagttaacagaggctaatctggggtcctagaacaaagaaacatttttttctttatacttttcagtttcaataaaataatattacatttttttttttttgagatggagtcttgctccgtcgcccaggctggagtgcagtggcgcgatctcagctcactgcaagctccacctcccgggttcacgccactctcctgcctcagcctctccgagtagctgggactacaggcgcccgccaccacgcccagctaattttttatatttttagtagggacggggtttcaccgtggtctccatctcctgacctcgtgatccgcccgcctcagcctcccgaagtgctgggattacaagagtgagccaccgcgcccagccttaatgttacattttttaaaaaaaatttctgtgagggtctcacactcttgcccagggtggagtgagtggcatgatcatagctcactgcagttcaagccatccttctaccttagcctccagagtagccaggactacaagcagactccacccatcacacccagctatttttgaaatttttggtagagacgaggccttgctatgttgcccgggctggtctcaaactcttggcttcaagtgatcctcctgccaaggcctcccaaagcgctagactctaatctattgcatgagccaccacacccagcctaaagttaactttttaaagttacctgatgcagccaggtgcaatggctcaagcctataatcccagcactttgagaggctgaggcaggtggatcacctgaggttaggagttcgagaccagcctggccaacgtggtgaaactccgtttctactaaaaaatacaaaaattagccaggtgtggtgatgcgtgcctgtaatcccacatactcgggaggcttaggtgggagaacggcttgaacctgggaggcggaggctgcagtgagcagagatcgtgccactgcactccagcctgggtgacagaatgaggctccatctcaaaaaaaaagttacttgatgcaattcgctgggtatcgtggaacgtgcctgtagtcctacctacttgggaggctgaggtgggaggatcgcttgagtccaggagttcaaggctgcagtgagctatgatagcaccactgcactccaatctgggcaacagagcaagatcctgtctctaaatagttactggaataactgtaacatattgctaagaacaataaggaagacagtaataatttgggaaaacgcttactatatactaagtcaaaaataatataaatttgcatatagttattttatttgagactgagtctagctctgaggcccaggctggatggagtgcaatggcgcgatctcggctcactgcaacctccacctcctgagttcaagcgattctccttcctcagcttcccaagtagctgggattacaggcatgcaccaccacacctggctaatttttgtatttttagtagagacagggtttcgccatgttggccaggctggtcttgaactcctgacctcaagtcatctgcctgcctcagcctcccaaagtactgggattacacgcacccggtcacatgtagtaattgtagctgctttattataattaaaataggtctgggcgcggtggctcatgcctgtagtcccagcactttgggaggctgaggctggcagatggcttgagctcaggagttcaagaccaggctgggcaacaacatggcaaaaacctggtctctactaaaaatgcaaaaattagctggcgcagtggcacacgcctgtagtcccagctacttgggaggctgaagtgggagaatccacttgagcctgggaaattgaggctacagtgagccatgactgttccactacactctagcctgagcacatggagtgagaccttgtctcaaaaaaaaaaaaaaaagaaaagaaaaaagaaaaatatactcactttaaagaaagatagaatagcatttttattataactattagtcacgtttttctactaaacgtaatattgatgcagcttcctttgaaaattaaagaataaatgtaaattttaaaagtcttactcacatttaattgctcttgcttttctcttcgcttccctcagtcccccagaccttccagaacacccaccaccaggtttccctggcctgggctcctctcctccggtgccgacgtcacggctaagctctggctgtgctgactccaagagcccgcccgtctaatccactaagacaggctctgctaaggcctcatgtctagtcttcctgatgacccatatctgccattggcttttattcagaatctgagttttggaaatccttttgagagagatttgaataacttaaaagcaagcaggtgaagggatctgcccctactttagaacaacatctttgtgagtcaagtgttagcaagatttttaaagtcagaatatttcatatttgcaatgcaatgtgctccgtgtagtgcctctacccttcatggcaatgcagcagcccaggcctctcatccagacccctgagagtctaggaggggcacctcagcggtgccctcaggaccccatattacacagtcaccaataacaacattcaggctgcaagtttgccaatgacaaaatagggtacagatattgaaaaataatttcaagttctggttctgcaacatacaaagaataatgctttcactaaattgttttttactctaatctgcttaattcaaaatgggaatggtgttatctatatcacagagctaaaatgaaaattaaatcagacaaccaatctgaaagtgctctgtcagtctcacagtgattaaactatgacgtgtacctttgactaacaatctcaaggacaacaggcaccatgctcaccaaagtgcacacatgtggtcccaccaccaagcagcaacagggcagtcctgagtcacctggtcaccagctagccgcacacccctgagcctcctgtgcagcactggatggctgcatctctggatggtttggacaacttccgaagtccaaaccggccccagtgtcttacaccggggcaggaaatttgctaacttgaccaaacacacaaggatcacagctcacctccaagacgaagcagcattttgaaagagaggagtttgcatgaggaatttaaaccaatttcactcacttttccatttttctttcattcccaagtccaggtcaatctccaaaactaagactgtgggaattcaaagggcaacggaaaaagtcctcaggccctgcttcccttacgcaccgctcctaacaatactgtgaggaataaggggagcaggggaccaccgcaactgataaaggacacgaccactaacgcagctgcagagcaacgcatgcgcagaccctccctccaacacaacaggcactgtagagcctcagcatggtgctgagcagcatgaaccaggctggattctagtttgagggagacagaagacaaacaggtaaatcacgtggagttacagaggctgggagcgtacacagtcactgcgaacgggtgaagtgtgccaacgagggcagggaggatgctgctttgcatggctgttagacatgaccttgctaatgggccaacatttgagcagcaggcagatgggcaaaaataacacaactgttcttgtttgaggtgctattttttgcaatggtaacaattttaaaaatcttaccttaggattttgcctgtgcctataaagtaatcttaacgaaaaagtgaatgtgaccaaagctctagaactagaagacagggaaacatgttcaatgaccccacagaggcaacggtactacacaatggcctgggaaacactccaggacagacgaccaggcaggtcggttagtctgtctttaacaaataaacttcaagggaaaaaggagagaaagcaaacaatggagggaggatttctggactaagtgaagagactccccagaatcatctccttcatgtcccagtcacaagtgagctcactcacccattagacgctggcaactgggggaagggcaggaactatggtgtgcggtcacaaagccctcagaaggcaattctccagggaggggtctaacagccaggggtgagccagtgaggcacagctgctaagagcttacctctgacccttggaactctgaaatcccagaagtggctactgactctcccgaagccttattatttctcatgcatcacaaaaaacatctgatctcccattctgctctcccttttctaaccctgttagcctatggcctctttttgcttttagggcggagcacaaaatctagcacatactaggacaattggaaatcattcaatagatacacatcttcaaacatgttgaggccaaattggaagtcccactttgatcatttcaaagccaaactttatatgtaactgatggagtctcatgaaatgaatggcatccatccagaagacgggtctaacagggaaaggtggtgagaaactaacaatcatgcagcgcacacaacagaggaggctaaactccaagcactttttttttttttttttttgagatggagtctcactctgttgcccaggctggagtgcagtggtgcgatctcggctcagtgcaacctccgcctcccgggttcatgccattctcctgcctcagcctcccaagtagccaggactacaggcgcctgccactatgccctgctaattttttaaatttttattagagacggggtttcaccgtgttagccaggatggtcttgatctcctgacttcatgatccgcccacctcagcctcccaaagtgctgggattacaggcgtgagccactgcacccggcctccaagcaccttttataaggggcctggaaatccttaggtttagggaaagactgctgtgtgccatgccatctgcactccagtatataaaaataatctttgtttttacatttactgctgcaaactacaatgaatactatgtgctttcccaacagcaaatgggcggtgggggttagaattctgttcctagaaaaacttccgtgtttttattggcatttgcaggtccagcccacttaagcaggaccaatgatgtctgacagccctggctggaagcagagtgacgcttcatggcaggaaagttggaagccccaggttctaacccagactctatctcttctcaccaggtggcctccagtaggtttcctaacttctctctgcctacatttttttgtctgaaagtggggacagtaatagtccccacagctcatgctatgacaattccattagaatccatgcaagccccttagaaccatgactgacacagtaaatgcttactaaatatgacttgctatgaaagcaggtgtaaaactgttgccctgaaagttttaagtaatgtccagaaaactacctcctgcctcacctgccacactttccatccagtcagtgcagtaggcccttttgcagaaatcaaaaatatatgtagcagtggcaaccagtgtaacagtggagttaatcagatagatgtgatactttgaaatctgtgcatgttgttacatgtacaagtctttatgagaacatctgctttcacttctcttgggcagattcctagcggtggaatggctggatcatactacaggtgtgtgttgaacattccaagaaaatgccaggccaggtgcagtgactcatgactataatctgagcactttccgaggcaaggcaggaggatcacttgagcccaggaattgaagaccagcctgggcaacatactgagaccccgtcttacaagaattaaaaaaagaaaaaaaaaaaaaaaaaaaaagccagacatggtagtgcgtgcctatagtcccaactacttaggaagctgaggccagaggatcacttgagcccaggaggtcatggatgcagtcagctatgatcacaccattgtactccagtctaagagacagagtgagaccctatttcaaaaaaacaaaaaacaaactcaaaaaacaaaaaaaaccaactcttttcaaaatggttatgctgggtcacattcccaacatcctataagcaatgtggagagtcccggctcctcacgcccaacaacgctgggtgggtgtcacagccattctaatgggggcgtgggctgtagtctccatctgcatctcgctgactgctgagcttctgaggcactcaattgctgtctatacagtttctggtaaagtgtctgttcaagtcacttgcctcttttttattgggttacctgttttcttaatattgcttttttttttttttttttttttgacacagggtctcgctctgttgtccaggctggagtacagtggtgtgatcgtgactcactgcagcctcaacatcccgggctcaagtgattctcccacctcagcctcccaagtagctggtactacagacacacaacacgatgcctggctaaattttttttttggagacagtctcgctttatcacccaggctggagtgcagttgcacaacctggactcactgcaacctccacctcccaggttcaagtgattcttgtgtctcagtctcccaaatggccgggattataggcataagccactacacctagctaatttttgtatttttagtagagatggggtttccccatgttggccaggttgttctcgaactcccaacctcaggtgatccgcctgcctgggcctcccaaagtgctgggattacaggtgtgagccaccgtgcccgactgctaacttttttttttttttttttttgaagagacaggggtctcactttattgcccaggatggtatcgaacaactggcttcaagcaatcctcctcccaaagtgctgggattacaggtgttagccatagtacctagccaaaattgagttttgagagttcttacctattctggatacaagtcatctaaaagacatttgctaatattttctgccagactatggtttgtctttcgttctctgttttttctaaggagcagaagttttaaattttgaacaaattcaatttataaatgttttcttttacgcattctatctttgatctcacatctaaaaactgtttgcttaattcaaaatctcattttttctaattttacgttttatatttaggtatatgatccattgagttaatttttttttttttttttgagacggagtctcactctgtcacccaggctggagtgcagtagcgtgatcttggctcactgcaagctccgcctcctgggttcatgccattctcctgccttggcctcctgagtagctgggacttcaggtgcccatcaccacgcctggctaattttttgtattttcagtagagacggggtttcatcgtgttagccaggatggtctcgatctcttgacctcgtgatccaccctccttggcctcccaaagtgctgggattacaggcgtgagccaccatgcctggcctttttgtttttgtttttgtttttttgacacggagtctcactctgtcaccaggctggagcacaacggtgcaatctcagctcactgcaacctctgcctcctgggttcaagcgattcccctgcctcaacctcctgagtagctggactacaggggcgtgccaccacacgtggctaaatcttttcctttgtattttcgtagagacggggtttcaccatgttggccaggatggtctcgatctccagacctgatgatctgcccaccttggcctcccaaaatgctgggattacaggtgagccaccttgcctggcctgagttaatttctgtacatgatgtcaagttctccttttgcgtaagaatatccaattgactaaccaggcgtggtggctcacgcctgtaatcccacagctttgggaggccaaggcgggtggatcacctgaggtcaggagttcgagaccagcctgaccaacatggtgaaaccccgtctctactaaaaatacaaaaattagctgggtgtggtggtgagcgcctgtaatcccagctaattgggaggctgagacaggagaatggcttgaacctgggagggggaggttgcagagagctgagattgcaccactgcacttcggcctgggcaacagagcaagactctgtctcaaaagaaaaaaaagaatatccaattgttccagcccctaattgctattcaatttaattttgctttttaatttaaaattatttcaaacttcaaagagttgcaagaataatacaaagaaaccatgtaccctcctcacccagactcactcactacgaacatggcttcattattcccactttattcaaacaaaaaggtttttgttttgttttgttttcctgaatcatgttcaccttacttttttttcttttctttttttttttttgagacggagtctcgctctgtcccacaggctggagtgcagtggtatgatcttggctcactgcaagctccgcctcctgggttcacatcattctcctgactcagcctccagagtagctgggactacaggcgcccaccaccgcacccggctaattttttgtatttttagtagagacagggtttcaccgtgttagccaggatggtctcgatctcctgacctcgtgatccacccaacctgacctcccaaagtgctgggattacaggcatcagccaccgcacccggccatatattggtatttcaactaagatctgatttgaaaaaagggctctcctgctttctaacgaaaaaaactagcgatgtaccactctgattcagaaggtaaatcctcatcactgggaccctaaaccttcttgctcaacactaaatggaagctttttttgaggatcaaattgttttgaaaaccaactttggcttaaaagagatagaaaaaaactgtaacaaaaaccagggtattgaccaggcatgctggcgtatgtctatagcctcagctactcaggatgctgaggtgagagaaccccttgaccccaggagttagaatccagtctgagcaacatggcaaaacactgtctctttaaaaaaccaacccaccagctatttataaaaacaaactctgaagaaatttatatattgtctttctaaaactgatgaggatcaaatatatcaaaattaccttaattcagaagggcttctggtctggtctccaatacatgtaaatttgtctgaaacaaacagaaaaggctgtatttgtattgcactcaggttgtgaataaaatattctattttgctagtagctatattttatgcaacgacacataaatttgacccttccctattactatttctcccccaaaattgctttatttagcagtactgtcatattttgtttttcagcatgggaacaaaataagaaatcagatctcaacttctttaagaatccttagaaatgccccagggaaaataccttgaattaaactgaaaagtatgggcacagaggttagaatcctatcactagaaaaattacagtaacaatttaaaaactaatgcaggccgggcccagtggctaacccctgcaatcccagcactttgggaagctgaggcaggcaaatcacctgaggtcaggaattggagaccagcatggtcaacatggtgaaaccccatctccactaaaaatacaaaaaaaaaaagttagccaggcatggtgtcacaagcctgtaatcccggttactcaggaggcttagacaggagaatcgcttaaatccgggaggtggaggttgcagtgaaccgagatcattccactgcattccagcctaggtgacagagcaagaatctgtctcaaaacaaaaacacacaacagtctgggcgcggtggctcacatctgtaatcccaacactttgggaggctgaggtgggcgcataacctgaggtcaagagttcgagaccagtctggccaacgtggctaactaaaaattaaatgtttttaattttaatgtgttttaagaacacattatgttcttggcagcgaactaaaaaaaaaaacgtttctactaaaaattaaaaaaattagccaggcgtgatggcaggcacctgtaaccccagctacctgggaggcagaggcaggagaatcacttgaacccagaaggtggaggttgtagtgagtggagatcacgccactacacttcagcctgggtgatagagcaagacaccgtctcgaaaagaaaaaaaaaaaaaagctaggtaccgtggctcctgcctgtaatcccagcactttgggagaccaagttgggcggatcacaaggtaaagagttcgagaccagcctggccaatatggtgaaacctcatctctactaaaaatacaaaaaattcgccgagcgtagtggcaggcacctgtagtcccagctactcaggaagctgaggcaggagaattgcttgaacacaggaggcggagattgcagtgagccgagatcgtgccgctgcactccagcctgggtgacagtgcgagactctgtctcaaaacacacacgcacacacacacacagacacaacactaatacaattcaacaaattctgaagattaatttaatccagactttgcctgtttggcatgacagtggagagcatttcatctgaatctcaaggaagccactaaataactactttgtgagtcctggcaagtctatgttgggacacttccaatccctccctctgtccctctcctgctgacacggtcccatccagtgcctggccctggtgcccaggaaggtggcttgaatggtgacagagatcacaagagaggtttctgactcctcttgacatacttctggtggaatgaaaatatgtccaattctagatttcttctgatttcagaacatttattgtattttttttatttttgagacagcagtctcgctctgtcaccaggctggagtgcagtggtatcatctcagttcactggaacctccgactcactggttcgagtgattctcctgcctcagcctcttgagtagctgcgattataggcacatgccaccactcccagccaatttttatatttttagtagagacgggttttcaccatattggtcagtatggtctcgatctcctgacctcgtgatctgcccacctcggcctcccaaagtgctgggattacaggcgtgagccactgcacatggccacatttattaattttttgagacagattctcactctgtcaccctggctggagtgcagtggcatgatcttggctcactgcaacctctgcatcccaggttccagcgattttcctgcctcagcctcctgagtagctgggattacaggcacacgccatgccttttattatttattagtagagatggggtttcactatgttggccaggctggtctcaaactcctgacctcaggtaatccgcctgtttcagcctccgaaagtgttgggattacaggcctgagccactgagcctggcctgatttcagaacatttaaagatgcttctgtaatcgctccctcaaattaaactatgtgaaaagaccacttgtggaggcttcacaggtcaccacctgcctattaattcagtgtcttgtgagtctgcaaactcacatgcacacatctagtctggagtcagtagatgaatcaacaaactgaaatatctcccagttgaactgtgaattctaattcatttacttaaagtagtttcgttttgcaattatgctgcttatgtacaagcaagcacgtacttttccggcagtaaaaatgagtgtggaaggaaaacagtttggcagttcctcaaaaaattaaacacagaattaccccataacccagcaattctactcctaggtatattcccaaaagaactgaaagcagggattcaatgcatgtacacattatgttcttagcagcagtactcagcagccagaaggtggagacagcccaaatacccactgagcatgaatggatgaataaaatgtggtctatccaaacaattgaatattattcagctataaagataaaggaggccgagcgtggtggctcacgcctgtaatcccagcactttgggaaggtgaggcgggtggatcacctgaggtcaggagttcaagaccaacctggccacctcgtctctattaaaaatacaaaaattgccaggcacggtggctcacgcctgtaatcccagcactctgggaggccaaggcgggcagatcacaaggtcagcagattgagaccatcctggctaacacggtgaaaccccatctctactaaaaatacaaaaaattagccgggcatggtggcgggcgtctgtagtcccagctactctggaggctgaggcaggagaatgccatgaacccaggaggtagggcttgcagtgagccaaggttgcacccctgcactccagcctgggcggggtgacagagtgagactccatctcaaaaaaaaaaaaaaaagaagtcctggtcctgtctctgctagaacacagacaaacctcacaaatatgctaagtgacagatgccatacacaaaaagccacatatatacaaccccatttacatgaaatatccggaacacacaaatccaaagagacagaatgcagtggttgccaggggctgcatgtgtctgcgtgtgcatgcacatgtgtgtgcagtggacaattatttaatgggtacagggtttccttttgaggtgatgaaaatgtcatggaattagctagagacggtggttgcaacacattgtaaatgtactaaacggcaccgaatcattcactttaaaatggtttatgttatgtgaatttcacctcagaaaaaaagttgggtgtgaaaaggcacacaggagtaaacagtgaatgatgcaaactaccccagacttcaggaagcgaagcctcgctccggggcagggtcctatgagcatacccgaaaagtgccaccaaatcaagtttcaaagcatgggtctcaacctcagcacaatgaacattttaggcaggggtgtgtgtgtgtccccaggaggatatctggcagcatgccagtagtgctcctttccccagctgtaacagccacctggcatcccgagaggcaatactgaccccagttgagaactcttcaactgtcacaattatctcaaccactaaatataaatcttttcaagtactttccagatcaagggacaggtaggaagagaaatactactaaaaaaaattatacataatctgctctattttatcattattaattatttttttgagacagggtcaccctctgtcagccagtctggagtacagtggcacaatcatggctcactgcagcttcgacttcctgggctaaggtgatcctcctgcctcagcctcctgagtagctgggaccacaggtgtgtgccaccatgcccagctaattaaaaaatatatatatatttgtagacatggggtcttgccatactgcgcaggctggtctttaactcctgggctcaaacgatccttgcaggtcggccttccacggtgctgggattgcaggcacaaggcaccgcacccagctgctctattttaatgcctagattgccctgtggctcaaatcatgactcaagattggagtaaggatgctaaaagtgctatcaaatcaccttagcctggattcacatggagagttgtctggacccatttctggctaaaaacaagatgacccaaatgtatgctctttttctgactatccagctcatagaaccccacactaaggacaggactaccagtcccacaataatgtaaccctaaaccagtagcactacccttaaagaacatcaggagctgggctcgcacctcccagtgctttgggaggccgaggcgggtggatcacctgaggtcatgagttcgagaccagcctggccaacatggtgaaaccctctccactaaaaatacaaaaattactggccgggtgcggtggctcattcctgtaatccgagcactttgggaggccgaggcgggcggatcacgaggtcaggagatcgagaccatcctggctaactcgatgaaaccccgtctctactaaaaatacaaaaaattagctgggcgtggtggcgggtgcctgtagtcccagctacttgggagggtgaggcaggagaatggcgtgacctcgggaggcagagcttgcagtgagctgagattgcgtcactgcactccagcctgggtgacagagcaagactccatctcaaaaaaaaattaaaataaaataaaaataaatttaaaaaataaaaaaattagccgggcacggtggcatgcacctgtagtcccagctacttgagaggctgaggcaggacaatcaattgatcctgagacagggaggttgcagtgagccaagattgcatcactgcactccagcctcgatggcagagtgagactccgtctccaaaaaaaaaaaaaagaaaaagatgggcactttttcaaggctcttgataaaatcaactgactctatacagctaatttagcaatattaaatattaatatgacttctttgcacatatcctagtacttatacttttatttcagcatttttcaaaatctagaaactgaatccttgagacatacctagagaatttctctacaagctgcattaatatttctaatcaagtacaggtatacttgtgggggatgatttcttctctatcaacataatcctaagatgggaaacacataagtgcaccactggttatctacaattctgagatacccaaaccagaataggacacacggcattaggcagactttctcacattcagggtgagcagtcttatgtttactacaaactttggggtatctgattaaagccttgccgtaagtgtggtgcacatgtaacatactcactgcatctttctcaaccctgaaaaagtctatattccggaaaacatccagccccaagagttttgcctaaaggcctgggggcttgtaagaaacaaagtaaactcccttccaaataattctttaattcaaaaacacactgaacaactagaatgtgaaataatactgaacttaatgacaactctgtatcataatcttcaactatatatgatcatactaataaacaggataaaaacaaactagaaatgccttctttcaaacaaaaattagagttcagtatcaataaaaagataacaatacctgtaaaacacaaccaaccaaccaaaaaaaggtctaaagacatcacgttaatttagaatactctaactgtacaaacgtgggggtacattctaagggcaaatagagttctgaaatttaagcgtcatattggtggcataataatgcttaaagtaggccgggtgcggtggctcacgcctgtaatcccagcactttgggaggccaaggcgggcggatcacgaggtcaggagattgagaccatcctagctaactcagtgaaaccccgtctctactaaaaatacaaaaaattagccaggtgggatggcgggcgcctgtagtcccagctactcaggaggctgaggcaggagaatggcgtgaacccaggaggcggagcttgcagtgagccgagatcgtgccactgcactccagcctgggtgacagtgcgagactccgtctcaaaaaaaataataataaaataaaataaaaataataataataatgcttaaaatattaatatggatatgtatgccagagcgaaataagcgaagatatggttatttggggagcaaggctcacactggagaagggaggcacaacacggactatctgaaagcaaggaatggccccctggggttcaatctgaatttggagacaatggaaattctctatacatttattccgctgtagaatcatttgtgtgtaagtccatacacacacacacacacacacacacacacacacacacacacacacacacgtatatctcctatctcttgtcaactgaaaggtctggaagcaacgacctctccacacacaaagcccaaatcttggttttataaaaacggttccctttaaaaggagcttcagggttcctctgagaaatcactccctcaaggtctggcacaggaaccctcttgctatggcagaaaggaagggctccaaaactaaaaagaacatgtcaaaaacacaccagcttgaaggaagtctgctggccaaatttaggacaatctgagggtcaacatgacgaacaatggtaatggaatataccttactggatctaaaaaaagaacacacaagcacatggtaacatataaattaaaaaaaaaaagaggaaaagcgaagctcttctttacagaggaatgccaatacacatagaaggagtaagatttagccgggtgcagtggctcatgtctgtaatctcagcagtttgggaggccaaggcaggcggatcacctaagctcaggagttcgaaaccagccaggccaacgtggtgaaactccatctctgctaaaaacaaaaaaattagccaggcgtggtggctggcacctgtaatcccagctactcgggaggctgaggcagaaggatcgcttgaacccaggagacggaggttgcagtgagcagagatcatgccactgcactccaggctgtgagacaaagtgagactccatctcaaaatcaatcaatcaatcaatcagagtctcactgtcacccaagtgggtgacagccttgaacagctcactgaaaccttgaactcctaggcacagccatcctcttgcctcagccccctaagtagcaaggattcaggcatgtgccacactgcacgtgactaaattttttgtttctttatggagagagggtctcactatgtggcccaggctggtcttcaactcctggtctcaagcaatcctcctcccttggcctcccaaagtgctcagattataggaatgagccactggttctagctgaaagtgaaggacttaaagctagagaatttaatgccagcaaaagggtggcttgatcagtttagaaagagggttggcttaaaaaatgttaagataacaggagaagcagtttctgccaaccaagaggcaccagggttcccagatgccatgaagaaaatcattgaggaaaagaaaatcttcctgaataggtttttaatgcagacaaaagtgccctattctggaaaaaactgccacaaaggacacttattagtaaggaagaaaagtgagccccagcactgaaggcaggcagggagaggccaactctactgctttgtgcaaatgcagccgggtttatgatcaggactgctcttatctacaaagctgctaacccctgagccttgaaggggaagagataaacaccagttgccagtctcttggttgtggaacaagactgggacaacaaaatccctttttctggactggttccatcgatgttctttgtctgcagtcaggaagtacactttgccagtaagggattgccttttaaagttctttagatattggacaaggcccctggccactcagaaccccatgagttcaatactgacggcaatgaagtggtctacttacccccaaacacagcacctctccttcagcctctagattagggggtcataaggacctttaaggctcataacacacagtactctatggaaagaattgtcaatgctatggaagagaatcccaatagacagaacattgtttaagtctggaaggattatcctgctgaagatgccaaggttgttacagaaaaagctgtgaaggccatgagcctgaaacaatcaactcctgctggagaggacgacgtccagatgctgcgcctgacctcacaggatttacgagagccagacgaggaaatcatgaaaagactgtgcatatgcttttaaaagggtaggggggtgggtaaggacttcaacatgtggatcttagagaaattcaagagctattagacaccacaccagaggaattaacagaacacaccttgacagatgtcagtacttccaacgtggtgccaaacgatgagaaagaagcagtgccaaaaacacgtggacactgggcaatctggcagaaggtccccattccccaagactgcacttgacttctttaggacacagagcttttatggcacaggaactaaaactaaagcatacaacagaaggttgctatcatacagaaacttttttagagaaatgaaaaagcaggccgggtgcggtggctcaggcctgtactcccagcactttgggaggccaaagcgggcagaccacgagatcaggtgttccagaccaccctggccaacacagtgaaactctgtctctactaaaaataaaaaaaattagccgggcatggtggcgggcgcctgtaatcccagctacttgggaggctgaagcaggaaaaccgcttgaacccaggaggcggaggctgcagtgagccaagactgagccattgcactccagcccaggcaaaaaaaaaaaaaaaaagaaaaagaaaaaataaaacgaaaaagaaagaagtcagaaattatgtatttcagtaaagttccaccaagtatgcctgtctctcctacctccccttccaccacctccatccaagacagcaagaccaatcccatctctttctcctcctcagcctcaacctgaaaatgagaaggaagacctttatgagggatccacttccactcattaaatagtaaatacatttttctctcccttatgattttcttaatattttctctagcttgatcacaaaaatatataatatataaaacataaaaactgtcttttgactgctatcggtaaggcttccagtcaatagcaggctattagtagttcatgttttgggagtcaagtgatagaagaattttgactgcacagcaggttagcactcctaatccctgtgttaagggtcacgatattccttccctttcactctttgtaacacaactgtctagcattttacttctacatgttttttgaagactccttctgggtctttgttcccagttcctcagaaggagcttcaaaaactattggatgttccggagtgataggcatgtctttgttattcatgagcctccatgtttttgctgagatgagctgactcaagatagaggctggtcaccagaaagacaaaccatgacattagacggttggggtttgaaaccattctgactggggtgggagaggggctagagattgtgctctatcaattgtgcccaagtaacaaagccccaataaaaactctcaacaccaaggctcaggggagcttcctggttagaagctcattgaccccgatttgtcaggagagactccatggggagagggcttggaggatgtgtgcttgagactctgctaggccttgctgtatatatctcttcatttgcctggtctgatttatattaaactagatatagcaccagaagataactgcagtgtgatgggatacacttctgcctgaagaacttcctccatctcacagggcagatctactggcaacaaaccccacaacttttgtctgaggaagtcttttgtgggactaggtctcattctatcacccaggctacagtgcagtggcacaatcttggctcactgcagcctcaacctcccaggctcaagcgatcctcccacttcagtctcctgagtagctgagaccacaggcaccgccagagcacctggataattttttttttgtagagatgaagtctcgctatgttgcccaggctgctctcaaactcctgggctcaagtgagtctgccactcagtctcccaaagtgctgggattacaggtatgacccaccatgcctggcctgtatgaaatactttttttctggctacattcaaaactttctctttgactttcagcagtttgactataatgtgcctaggtgttgagggttttttgtttatatttatggtgcttggagtcctctgaacttcacagacctctggtttgttgtcttttactaatgaaaaaattctcaaccattagctctttgaatatttcttctgccccgttttcttcctagggctccaattatctgtatatttgacagtttgctatagtctcacaactactcaacactttttttttgtttgagatggagtctcgctctgtacataggctgaagtacaatggcacaatctcagctcactgcaatctccgcctcccaggttcaagtgattgtcctgcctcagcctgagtagctgggattacaggtgcccgccaccacacccagctaattttttttttttttccagatggagtttctctcttgttgcccaggctggagtgcaatggcgggatcttggctcaccacaacctccgcctcccaggttcaagcgattctcctgcctcaacctctcgagtagctgggattccaggcatgtgccatcacaccctgctaattttttttatttttagtagagacggggtttctccatgttggtcaggctggtctcgaactcccgacctcaggtgatctgcccacctcggcctccccaaagtgctgggattacaagggtgagccaccgcgcccagcctaaatgctatttttgttctggtttattttcttctgcttgtttcattttggatttctattgacctatcttcagtttcactgattctttcctatctgctgacaaactcactgagaaaattattcatctataatgtttttaaagaatctctaacatttcaatttaactttttctagagtttctgcctcctgaaattctcgatcttttcacatataatgcatgctgtatacctttctcactcaatcttttaccacatccatcacagtcatttaaagtctctggcagttccaatatctgggtcatctctaagttggcttccatttatttctctcttaacaagaaatcgcttttttgtgtatctcataattttttattgaattatcagatgatattcaataaaaccagaattgggtacacctctttgtctgagccactactgtgtggggatgaggggttaattcaatctagtcttcagttgggtttggattttataatcctcaggggaaggctgccttcaacttcgtggcaccatgtatttttctcaaaaacatactggccggccaggcgcggtggcttacgcctgtaatcccagcactttgggaggccaaggcgggcggatcacaaggtcaggagtttgagaccagcctgaccaagatggtgaaaccccgtctctactaaaaatacaaaaattagcaaggcgccaggcgcggaggctcatgcctgcaattcccagcactttgggaggccgagacgtgtggatcacctgaggtcgggagtttgagaccagcctgaccaacatggagaaaccatatctctactaaaaatacaaaattagccaggcgtggtggtgcatgcctgtaattccagctactcgggaggctgaggcaggagaatcgcttgaacccgggaggcggaggttgcagtgagccgagattgcaccattgcactccagcctgggcaacaagagtaaaactccatctcaaagaaaaaaaaaaaaaaaaattagcagggcatggtggcacacacctgtaatcccagctactcaggaggctgaggcaggagaatcgcttgaacctgggataccactgcactccagcctgggcgacacagcaagactgtgtctcaaaaattaactaattaattaaatttaatttaaaaaaatattggccaaagaggaaacctcactactcacacctagaggaggacagaacaaatgcagaaaagcaagccatacaacttcacatgaagatgcaaacagtcttgcaggctaccatgaggacaagcctttactttattttggcagtagactgaatgtctgttaaacaggcattcggccgggcacagcggctcacgcctataatcccagcactttgggaggctgaggtgggtggatcacttgaggtcaggagtttgagaccagcctgaccaacacggagaaaccccatgtctactaaaaatacgaaatcagccgggcatggtagcgcatgcttgtaatcccagctactcgggaggctgaggcaggagaaatgcttgaacccaggaggcagagattgcggtgagccaagatagcgccattgcactccagcctgggcaacaagagcgaaactccgtctcaaaaaaaataaataaagagacattcactttactggaaaaaaaaaaatcaacatattgtggttgaatatataaaaagagatgccaaacgttaggagccaggcgtggtggctcacgcctgtaataccagggggcgatcacttgaggccaggagtttcagaccagcctaggcaacatagcaagatcctgcctctcaaattttttttgagacggcatcttgctctgtcgcccaggctggaatgcagtggcgccatctcggctcactgcaagctccgcctcccgggttcacaccattctcctgcctcagcctcccaagtagctgggactatagacgcccgccaccacgcctggctaattttttttgtatttttagtagagacggtgtttcacgatgttagccaggatggtctcgatctcctgacctcgcgacccgcccgcctcagtctcccaaagtgctaggattacaggctcgagccacggcgcccggcctcaaaatattttttaaaaaaattggcatggtggtgcatacctgtagtcctagctactccagaggctaagacaggaggactggttgagcccaggagttgaaggcagcagcgagccactgtatgtcagcctgggcaacagtgagactctgtctcttaagaaaaaaaaaaaaaagtgaatgtcttgtgtgccttgctatgcacacaggttctcagcccctgagtggagtgcaacttacgggcctaccctacactcaggagccagcaacagcccctcatcctgctctcaccaacccagctccacatctgccacacccagtcacgcccccttctgaaccctcaactggttcttttgtggttcttctctcaagtcgaggatccactccttattccctttccctgaatgtaccccagttcctagaaagctctacgcactgcagcgctctgagggttcaatcctttcagattccaccagtgtaaagcaagcctcagcacccctttcctttccaaacctgctggcagtccctcccagctctcctgcagcacagactcaagcctcccttccatccctttcccctcctgcccctgtgctccactcccactgcttcagcctcttgatggcttaccatctttgcctggcccgttactaatctgtgtctctatcccacctcttttccacttcaatccatcttaacagcactgcctgatttatctttctgaaggacagctctgacatgcgactcctccgctcagaagtcttcaaatactcctcctacggaaaaaatcaaactttttagcctggcctaatttaaagctcttactgactgtattcccaggtactcctccccagggagtcaagtaagcctagaaagggccaaacacatgggcacgaacaccccagacaactttggtggtctctgccgaactctgaccactagtctcttaaagagaaatcctagaaacatgaacatatttttgcctcaaagaatgagagccaatttttaaaggtaaaatatctccccaccaagcaagaaaaaagacatgcttccaaaacttagcttatttcctgcaaaacccacaaaatatagaaagtaccctgagttggaaatgtttttataacccatattctaaatcatctgtgatttagaaagagaactggaaacaggaataatagaaactatgtcttcaggctatttagaatgacacagtgctctataaacctcagctaatgtctaggtttgttaggcggtcactgtgagaaaagcattttgtgagcctactctggtgccaggcaccagtttaggtcagagtaaagtaagcacaaatatttacttgggagtctgagtacatatatagtcatattatataacaacatgaaaataggatagaagtgtcaattgttgataaaacatttaacaataaagtggcctcaatatctgggttcgtatttgtatggcttcattcactcactcaacaacgacctgcccatctccaatcatgtgccaggcaccacagctcaggggagtccgtaggaaacaagacacagcacttgctgttctagaacttgcttgttggtcgaggaaggcattaagcgaacagtgcaagtctttattttgatacatcaactgctatccattgctaaggaaacataaaactacgtaagaaggggaaacaggtgagatggggaggtctctcttagaaggtggccagagaaggccactctggtgtggagaaatctgagcggggtcccaaggacagggtgaacaggtataaagagtccctgagattctgacttattcctactagtcaagatttcttacctgctgaaacactgacaaagcctgccacttctacctctgaatgtgagagacaaattaactttattgtctccatcctggaatgttcagtccaactgctatccttctcttaaattaaactctgacagtacaaaaaagctcagtcataaaaaaaaggtagaggaaggggaccacaatgaagcagcagatacacagcaagagggactcactacaaaacctgttttaaggaagacagatacatctcctgttagtcccagacattccttcctaagtaagtttttaagctgggcgcattggctcatgcctgtaatcccacctactagcgaggctgaggaaggaggattgcttaagcccaggagttggaggccagactggataatatagtaagacgtcatgtctttaaaaaattaaaaagtgcagtggctcacacccgtaatccccgcactttgggaagccgaggtggatggatcacctgaagccaggagttcaagatcagcctggccaacatggtgaaaccccatctctactaaaaatacatccgggcgtggtggctcacgcctgtaatcccagcactttgggagtccaaggcaggtggatcacgaggtcaggagttcaagaccagcctggccaagatggtgaaaccccgtctctactaaaaatacaaaaattagccaggcgcagtggcagtcacctgtaatcccagctacttgggaggctgaggcaggagaatcgcttgaaccctggaggcaaaggttacagtgggccgagatagctccactgcactccagcctgggcaacagagcaagaccgtatctcaaaaaaaaaaaaaacagctgagtgtggtggtggatacctgtaatcccagttacttgggaggctgaggcaagagaatcacttgaaccggggaggtggaagctgcagtgagctgagatcgcccccactgcactccagcctgggtgacacagcaagacactgtgtcaaaaaaaaaaaaaaagaaaagaaaagaagaaaaaagaacccaaattccatccaagttaaccagcaatgacttaaaaagcaagcaaaacaataactcccggccgggcgcggtggctcacgcctgtaatcccagcactttgggaggccgaggcgggcggatcacaaggtcaggagatcaagaccatcctggctaacacagtgaaaccccatctctactaaaaatacaaaaaattagcagggcgaggtggcaggcgcctgtagtcccagctactcgggaggctgaggcgggagaatggctggcatgaaccccggggggcggagcctgcagtgagccgagatcgcgccactgcactccagcctgggtgacagcgagactccgtctcaaaaaaaaaacaaaaaaaaactcccataaaaggaaaaaacactaagtcactgttttccagtgaggaaagtacatcagagtaacctggggaaagagagacacctggtgtttgcttctttggctatttcaaagaggaggaggcaatagtgtctacagaactagatgctatgaccttcttaacctaagagtgaagttgacagcactgatctggggaaggtgataagcagggagctcagggcagggccctctaccttttcaccactgtgttctcaggactcatggcgtaaagcagcctcccaaatttttttaatcaatggactttcttcttcttctttaagagatggcgatcttgctctgtgacccaggctagagtgcagtggcaccatcatagctcactgcagcctcaaattcctgggctcaagtatcctcccatctcagtctcctgagcagccaggactaaaggcatgtgccatcacacctggctaacttttatattttcagagatgggctggtctcgctacattgcccaggctgttttcaaactctcagcctcaagtgatcctcctgccacaacctcctgaatagggctttctttttttaaattagagatggggtctcgctatgttgcccaggcagatctccaactcctgggctcaagtgatcctcccaccttgatctcctgaagtgctgggataacaggcataagccactgcactggcccggaatttctttctttctttttttgagacagagtctcgctctgtcgccaggctggagtgcagtggcctgatctcagctcactgcaacctccacctcctgggttcaggtgattctcctgcctcagcctcccgagtagctgggactacaggcacgcgctacgacgcccagctaacttttgtattttcagtagagacagggtttcaccatgttggccaggatagtctccatctcttcaccttgtgatccgcccgccttggcctcccaaagtgctgggattacaggcatgagccactgcgcctggcctagaatttcttaatgttcctctctccccctccacaatcccacctaatgtagcaattaacagtttggtgatatgttgggacaaccaagaatgtaatttctgaaaacagttgatatttcatttaaaacaaaaaatattattaattcagaaggcccaagaaaaaggctcttgtactgttcactcttctgagggaagtatcctacaaaacagtaataccgtaaagacattcaggagagcccaggtatatggagagcatactctgattttaatcacttcaggtattttcaccaggtaattaaattcactgtccaatcacctgtctcaaaatcctgctgattaatgagaagccttaatgggaaatttggtattaactacatcttttaggaaatcattaattctagaaatggaaaattaaaactactcctgacttcactttacccccacttcaaaagtctacccagtctagccaaggttctcactgggaagtggggagaggaggaatatgagaggtcccaaggaaactaaactggaaacgagaaagtggaaagaggaaccaagaacccagtctcggatggctcttggggctggctggctcctctctctctccttccagtgtgctttctctgctcctctgtgaatctctctattaaccaatcactgtcatcttgtacagggttcaacgcagcctaggattctaaatcacagcaatcatcaaatgtcagccatgtctctgtctccagagtctcctctgcaccaactcactccctcactgtctgcaggccaggtggctggtacactgtggaactggggaggatacagcaagtcctgtgggcagctgcccttgccaaagggacaatgggtggagtacctgagaagggaacatgggtaggccaagcaatgacgatatctttaacatgggaacaaacttctctacatgtgcacttatagcagtacccccatatctgagaaggacatgctccaagacccccaggggatgccagataaactgtggatagtaccacactttatatagactacattttttcctttatgctgtattttttcctatacaaatgataggaacttaatcctgtaacaaagttttatttataaattaggcacagtaagaaattaacaataataactaataatcaagcagaaccaccataacaacataccgtaataaaagttatgggaatgtggtctctctcgtactgtaccgtgatattttatggtgccatacctcaaaagacaaggccacgggtacaggggctactgcaattcttccctctggcactgcactagctgaggacatgccacaaagcagcacacatggatccataatggagaatccagaacaattacagtccccaaaacacacaaaataaaaacacaactgcacagtcactggtgttttttcttttctttaaaagcattcatgaatatccccactgccttatctgcctactatgtcaaaaacaggagagaaggccatggccagaatcatggaacatccaataaaggcagtcacttgttattctgacaagtcatttgttttcagttcatctgtcgcatctgtcaagaaaaacacagactgtcttctaaaagtccgtttttaactattttattttttttcaatgacaaattccacttgtaccatagaagccatattctgcatgttggagaggcccctttgtggtccctcatccctgggttcttcctgggcatcctatggcctcccctctggtgacaggcagcaccccgaagacttaattttgattcttaaaaagggacagatccctccttccacccttgtccaggtacttccagagggtgggtccccttctcatgggaacatactacccccactcaccagaccacagtgatgagtccagcccagactgtgggccatgaaagcctaagctcccaaaacaaacaagatgccagggacactgcagccatctcagaggacaccgaaagacattttaaagccaagggaagcacagcagaacatcagctgctggacaccaagggagccacagctcgagggggttcgtgctccaacagcagatggagctacacccttcccgatgacgtcacatcctaataaagccctgtttgcagtggctgctgtgataaaaaagcaagctctgcatgaaatcaacatggaacaggaaacaaggggtggggtgggacggagtccaatctgattctgaagtttgagaagctgtacaacccattagtaattgtggctatttaaaaataaaatacagtttccttcaatttatgggtatttattttcttttttttttttttggaggcagagtttcacttgttgcccaggctggaatgcaatagcgcgatctcagctcactgcaacctccacctctcaggttcaatcaattctcctgtctcagcctcccaagtagccaggattagaggcatgcaccacaaagcccggctaatttttatattattagtagagacagggtttcacaatgttggccaggctggtctcgaattcctgacctcaagtgatccacccgcctgagcctccgaaagtgctgggcttacaggcgtgagccaccacgccccgacggggattagttttcaaatggctaccctaacttcctaggacataaatagttaaactgtttagatggaaagattcaacaaagggctgggcgtggtggctcatgtgagcctgtaatcccagcactttgagagcagcctgggcaacagagggagatcctgtctcttcaaacaaacaaaaaaattcaataaagggaatgtgaactatgtatcgtggcctaaaggcatttggagacataaaggtgccatgaatctgccctcagggatgagacgccaacggagactgattggcaggagtgggggaggaaagaaaatgtaaagaaagggggagcagggtaaactaaaggagagaaaaggggagaggaaggagaagtggggtgggggagaggggtgggaaagaagagggaggcaggccgggcgcggtggctcacgcctgtaatcccagcactttgggaggccgagaggcgggcaaatcaggaggtcaggagatcgagatcgaccatccttgccaacacggtaaacccctgttctctactaaaaatacaaaaaaggtgtaaggaagggatccattttcagtttttgttgtggggtggggggagaggggacggaaagcattaggagatatacttaatgtaaatgtaaatgaccagttaataggtacagcacaccaacatggcacatgtatacatatgtaacaaacctgcacgttgtgcacatgtaccctagaacttaaagtataataaaaaaaaagtaaacaaagaagaagtaaaaaatagcaaccataaaaaggaatgaaagcatgtcctttgcagcaacatggatgcagctggaagccattatcctaagtgaattaacacagcaacaaaaaactgaataccacatgttctcatttataagtgggagctaaacatcagggacttgtggacataaagatggcaaaaatagacaatggggactattagacaggggcatgatagagggtggcaagagttggaaaactgactgttgggtactatgcttagtacctgggtgatgggattactcatacccaaacttgagcatcatgcaatataaccaggaaataaacctgcacatgcaaccctgaatctaaaataaaagttgaaaaaattagtcaaaaaataaataaataaaaacaaacaaacaaaaaaaaattagccagtcgtggtggtgggcgcctgtagtcccagctacctgggaggctgaggcaggagaacggtgtcaaccttggaggcggagcttgcagcgagccgagatcacgccactgcactccagcctgggcaacagagcaagactccatctccaacaaaaaaaaaaaaaaagagggaggaagagtccccacaaaccagcctgtgggcaacagagcaagactctgtctcaaaaaaaaagagggaggaagagtccccacaaaccgaccagactgcagctcagctctaaatccaccccaaaagcctcacctactgctctgcccctccactttgcagtaagctgtaacacactacacgctcatcaaaaatgggaactgacactttgggaggccgagccggacagatcgcttgaggtcaggagttcgagacccgcctgaccaacatggctaaactccatgtctactaaaaatacaaaaattagctgggcatggtggcacgagcctgtagtcccagctacttgggaggctgagacaagagaatcccttgaacccgggaggcagaggttgcagtaagccgagatgctgccacttgcactccagcctgggcgacagagcgagactctgtctcacaaaaaaaaaaaaaaaaaagggaactgacttcccaatctttgtgtctcagaacaaaacccagcacagctgcgcacagtggctcatgcccataatcccaatattgtgggaggctaaggcagggagactgttagaagccaggacttggagcccagtctgggcaacataaagagtcctcatctccacacacacaaaaaaattttttaaaaattaactggacatggtggtgcacatctgtagctgaggcaggaggatcactgagcctcagaggtcaaggctacagcaagttatgatcccaccgctgcactccagcctgagtgacagagcaagaccctgtgtactgtctcaaaaataataataataataataataaaaacccagcaggaactcagtaactgcttattgaaaggcatccctcaagggaagcaggattggcaagcagccttgagaacagacacatctcagagattttatatcctcagggggttgggggttggtggtgggggagaagtgatggaggggcaagagaggatgtaaggaagacacaggtcagagctggaagcaaccctgaaggaggcttcaatctgtggctaaaacagagctggtgctgaggctccagttagagctcaaactggacccttcaagcaacacagacagcactggaagcattcaccagagaagccccaggacacatctctggggtattcagctcaaaatgcaaaacctgaatccccccatgaggcagccaccagacccaaagtgagggatgtcctacaggataactggcctgtactctttaaacctcaagggaggccgggcgcagtggctcacgcctgtaatcccagctactcgggaggctgaggcaagagaatcacttgagccccgggggtcggaggttgcagtgagctgagatcgcaccactgcacgccagcctgggcgacagagtgagactccatctcaaaaaaaaagcctggtgtggtggcgcacacctgtaatcccagctacttgggaggctaaggcaggacaatcacttgaaccaaggagatgaaagttgcagtgagccaagattgcgccactgcactccgcctgggtaacagagtaaaaccttgtcaaataaataaataactaagtaaagtgtatatgttagcagagcaacgtggcagtcccatgtaccatgaattggaggatgaagagccactaagtaactcctgggacctcctcttcggaggcttgtcaggtaaattaggagatgattacaacagtctgagtgagaagtccacccattaacttctccccacactgagtgagacaatcagtttcctaagtctattacccggtagtgtaaagtacttcatttttattaatttttttttttttgagacagggtctcgttcagttgcccaggctggagcggcacaattacggctcactgcagacttgacctcctgggctcaagcaatcctcccacctcagcatcccgagtagctgggactacaagccgtgctctgatgcccccgatttttgtaatttttgtagagacagggtttcccccatgttgcctaggctggtctccagctcctgggctcaagcaatcggctgccttgacctcccaaagtgttgggactacaggcacaatccactacacctggccagtactttatttgtacagaagcagaacaaatacacccagcagaaaggtaaggaagctgaggagggctccccggtaaggtattacacgtaggcatcacaccttggagactcttagaaaacaccacggaggaggcaaggtggctgaatttgaactgcagtggtgctgaagtccacacaaataactgccatacacacacaagagggaaaaccaaacctcattcagccccacgccaggccacatccctctacctaagagcacagtgctagacccaggctgaatgtgtctgaccctcagcactgtggacactggggtcatcccgggtggtgcagggtgctgaacagcatcactggcgtctgttcatcagatgaacacaatccttggtcactgcccctcttcagccatcagtctacaaatgggctgtagaggttttccaaccaaacaaatgagtaacagaggctcagatgggcaagttgtgaggtggtgctggctagaaatggaagcagtgagggccacagagaaacaaagaaaagaaagtatgtgacaacacccaatcatgtaagttatgcaatttatagccaacctgagtaatatgtgagataatttgactgattttagagcctcatctcccacagaaacctgaccaattcagaaaagcactgccgtcccttgcccactgtggctgctgccactggaggggtttgggagtggggcaaacacaccccagacattgcaaagcgtcaacaaagccctttactgaaacgtctacttaggagacctaactgcctttctatggctaaacctagtgttcaggctccaccaccttctacatgctgctactctgttaactataaaagaacacaaaaaacaaaaacccacaggactcactcttcatccacaaatagctcattttgagatcttctccttccaaggttcttttagtgagcaaacacccaaatttcagatatcacacacagtaagatttcaaaggagatttaagttggaaaaattcagaaaacctacctatgcttaagcactgaatccccactctcagtgtagtatatggcagcacataattgataacatttttttaaagaataggacagaacaatgtttctgtgggaggtggtgttgcacagtgactgaaaacaagagggtctgggccaggcacactggctcacgcctgtaatcctaaaattttggaaggccaaggcgggtggatccagtttgggcaacatagttggaccctgtctctacaaaacaaaaaaacaaaatttaaaaaatttgccaggagtggtggctcacacctgtaatcccagcactttgggaggctgaggcaggtggatcacgaggtcaggagttcaagatcagcctggccaagatgatgaaaccctgtctctactaaatatacaaaaaaattagccaggcgtggtggcaggcacctgtaatcccagctattcaggaggctgaggcagagagttgcttgggaggcggaggttgcagtgtgccaagatcgtgccactgcactccagcctgggtgacaagagcaagactctctcaaaaaaaaaaaaaaaaaaaaaagaagaaaaccccacgaaaaaactattcttagcttctgggccacagaaagagatggctgtagcgtggcaacttctggctcatagcatagggcctagtacacagtaggtagttaaaacggccgcaatgatactggtttctcccactatcatcacaagttattccctccggccgacccatcctgccgattaccacctggcctgtaggttaacttcatgtagccaattctgtgccatgaggagcatgttccacctaacagaaacctgacattcctgcaccccaggaagtacatttttgggtctttaaatcaaactatataatcttgcctaagaactctgaaaaacccagtatacgaaagactttttccactagtttgtactctgagtaaaattcttcgttctgcaatttataactaagaggttatattttagttgctcatctcccaacaccttttactcactgcatcttagagtgctcacttacagctgctgatgcacatctcctctttcacaaaacgtaaaggtttcatcagctacaattagcttaaccaattacattttacttggcctttggttttgcctgattgccttgtacagagttatgaagagtattgctatctaacatctgttataaaaactaccaggccaggccaggcgtggtggctcatgcctgtaatcccagcactttgggaggctgaggcgggcagatcacaaggtcaggagatcgagaccatcctggctaacatggtgaaacctcatctctactaaaaatacaaaaaattagccaggcgtggtggcgggcacctgaagtcccagcaactcgggaggctgaggcaggagaatggcatgaacccgggaggcagaggtggcagtgagcagagatcacgccacagaactccagcctgggtgacagagtgagactccatctcaaaaaacaaaaaaaaaacaaaaaaaaaccaaaaaaaaaaaacaggcaacacattgtggctcatgcctgtaatcccagcactctgagaggccgaggagggcggatcacaaggtcaggagatcgagaccatcctggctaacacggtgaaaccccatctctactaaaaatacaaaacattggccaggtgtggtggcgggcacctgtagtcccagctactcaggaggctgaggcaggagaatcgcttgaacccgggaagcagaggtcgcagtgagccaagattgtgccaccgcactccaacctgggcaacagagtgagactccatctcaaaaagaactaccggattacagttatgttatgttcacaataccagcatccaaaaatatccagtgacaggatacagcaagaaacatgactacaaggtctatgaaacaggagactacagtacctaaaaaggcagatttaaacaaattcctgtaatgtgctcatttcagtcatgctaacttgagaaagcttttaaaacttttaaatgtaaataatccactttcacatttcttccaaaatgaaaaataactccttttttctgtcactgactttggcgaattttccaaaaaataaagagaaaacagttttgttttttggttgttgttttttgagaccacgcctggccttgaaaacagtatttatttattttttttttttttgagtttcactcttgttgcccaggctggagtacaatggcgcaacgttggctcactgcaacttccgcctccgaggttcaactgattctcctgcctcagcctcccaagtagctgggattacaggcatgcaccaccacggccagctaattttttctatttagtagacagacagggtttcaccatcttggtcaggctggtctcaaactcctgacctcaggtgatccacccgccttggtctctcaaagtgctgagattacaggcgtgcgccactgcgcccagccagaaaacagtatcttaaaacagtatgttcctttcctccattcaccccatgagataccacgtttcacagggatgtcttccagactttgatacatatgtgcataatttttcacaagtcaatcaaatgataccatattccccaaactatacatattcaaaatgcccaaccatttactgtattgtggtcatctcttcatgccaataaaggaaggccaccttaaatctttttaacaactgcacagtatgccattccaagtctgccttaatttaaccaatctattgatggacatttagattcatccaggggtgtccaatcttttggcttccctgggccacattggagaattctgtcttgggccacacataaaatacactaactagtaatagctgatgagcttaaaaaaaaaaaaaatcgctaaaaaaaaatctcaatgtggccgggcgcggtggctcacgcctgtaatcccagcactttgggaggccgaaatgggcagatcacgaggtcaggagatcgagaccatcttggctaacacggtgaaaccccgtttctactaaaaatacaaaaaattagctgggtgtgttggcaggcgcctgtagtcccaggtactcaggaggctgaggcaggagaatggcgtcaacccgggaggcggagcttgcagtgagctgagatcgcgccactgcactccaacctggggcacacagggagactccatctcaaaacaaacaaacaaaaaaacctcaattctaggccgggtgcagtggctcacgcctataatcccagcactttgggaggctgaggtgggcaggtcgcctgaggtcaggagttcgagaccagcctggccaacatggcgaaaccccatctctattaaaaatacaaaaattagccaagcatggtggtaggcgcctataatcccagctactcgggaggctgaggcagaagaattgcttgaacctgggaggcagaggttgcagtgagccgagatcaggccacttcaccccagcctggcaagagcgaaactccaccaaaaaacaacattttaagaaagtttacaaatttgtgttgggctgcaatgcggcccacaggcctcaggttggacaagcatgactaggcattcatacagcaaatatttattgagacctactatgtaccaggcactgtcagaggatataccaggaaataaaacatgaagttctctaccctcatggagcttatattttagtggctactgacaattttttgcttttataccaaaaattctagctaggagtttttgagcattgtctgtcttaaatatttggcttttataactaattttataataagcattctcttatttcttcctttggataaatttctaaaaatagacttgctggaacaattattttagaaatgcttttatactaaaaataataaccctttatcatatatattcctaacatttttctaattttcctgcctttgaactatagttcagaggcccccaaacaggcatcttttgctgtagatatgttccgaatgcttaagcagatatcttttcatagcttatagccttattgtcaaactaagaaactctttacctacagctggattgccagttgatccaataccttttacatgacaaaccatccattcccaactgattgtaaatgctacattaatcataaattcccattaatttatagatcagtatctagactgctttgttccacttacctataatacttataaaaaatctactaggaaacgttcccccttttctttctttagaactcccctcaaatatttacttctccaaatcaagtgacatcttgaaaatattcaagcacatgcatataggaatactgcattcaagttctgtatttatgtctatctattcaagttctctttcacctcttcaataatgcatctaaaggttccttcatatagtgtgtgttttgtttttttgtttttttttgagacggagtttcgctctttttgcccaggctggagtgcaatggtgcgatctcagctcgctgcaacctctgcctcccgggttcgagcaattctcctgcctcagcctcccgcgtagctgggattacaggcatgagccaccacatccaactaatttttgtattttttagtagagatggggttttaccatgttggccaggctggtctcaaactcctggcaattgacctgcctcagcctcccaaagcgctgggattacaagcatgagacaccgtgcctggccatgttttcccgtttttaaaagtgaaaaagttagccgggcacagttgctcacgcctgtaattccagcactttgggaggccgaggcaggtgaatcacgaggtcaggagttcaagaccagcctagccaagatggtgaaaccccgtctctactaaaaatacaaaaaaattagccaggcatggtggcgggcacctgtaatcccagttactcaggaggctgaggcagaattgcttgaacccaggaggcggaggttgcagtgagccgagattgtgcaactgcactccagcctgggtgacagagtgagactccatctcaaaaaagaaaaaaagtgaaaaagttttaggcctaacaatcatgaaacaaatgccattagtgtatttgcctaagaactcaaaaaatcttctgaagttaatttctataaagaataagttatttacagccaggcgtggtgactcatgcctgtaatcccaacactttgggaggctgaggtggacggaccacgaggtcaggagatcaagaccatcttggctaacaaggtgaaaccccgtctctactaaaaaaatacaaaaaaattagccggtgtggtggcgggcacctgtagtcccagctacctgggaggctgaggcaggagaatggcatgaacccaggaggcggagcttgcagtgagctgagatcacaccaccgcactccagcctgggcaacagagcaagacaccttctcaaaaaaaaaaaaaaaaaaaaaaaaaagaataagttacttacaaaaaagaagcaaacttacaaagaccagaggctctagtcagtccactgctcctttatgttgttatctgaccattcattatctcagacacttactactgacttctataagaatccaaaaaacagaatttcactagaaggtgacagtcttgtttcagctaaccattcatgcccaagagcttaattacagggtggacctcagcccccaccttagtgtctctcaggtgggtgggatgaagtcagagaaaaggcagtgcagcaccagcaacacaggtccatcaggaactggagcttttcctactgtccctgcttcctcctcccgtgaatcccaacaatcacagccacagaaatagtaagcaggaaaaaacaaggaggtggcagtagaggagcctatttgtcttatcacagttattcatcacgtagctggttcctcttttctgcctcttcttccagatgacccaactaccctcaaactgccctcccaaccccgaaagaaagtctctgattttgtaataggtcaatatatacaaaaacttcagagctatttatattccatttatcaaggacaacctacgctaacacacttgtacaacacaacttgtaatgctgctttgttatgtcttcagattcaaaaacaatcttttctttttttttcttgagacaacatctcactccatcacccaggctggagtgtagtggtacaatctaggctcactgcaacctccacctcctgggttcaagagattctcctgccttagcctcctgagtagctgggattataggcacccgccaccatgctcagctaatttttgtttttagtagagacggggtttcaccatattggccaggctggtctcgatctcttgacctcaagtgatctgcccgccatggcctcccaaagtgctaggattacaggcgtgagccaccgcaccaggcccaaagacaatcttatgtttttgtttgtggggttttgtttttgcttttttgagacaaggtctcactctggcacccagactggagtacagtggcatatcataactcagtgtaacctcaaactccttctgcctcagccatcccagtagctaggactacaggcaccatgcccagctaattttgttttttaaactttttgtagagacagggtctcactacattgtgcccaggctggtctaaaattcctggcctcaagggatcctcgcaactcagcctccccaaatccagagattacagggattatagttataagccactataatcagcccgtcttgtttaaaaatcaaatccctccctatcaaactcagctttctgaatcgcactttgtcttttccaaaacataatattctgagctcagcagacacttccttatgcgctgttacgcatgttagcgttgctggaattacagtaagaataatcatctgccaagagccagttcaacccatttctgatataaaaagccattttagcactttgggaggcagaggtgagtggattacctgaggtcaggagttcaagaccagcctgaccaacagggtgaaaccccacctctactaaaaatgcaaaataaattagctgggcgtggtggcacacacctgtcatcccagctactcgggaggctgaggcaggagaatcgcttgaacctgggaggtggagtgagccaagatttcaccactgcactccagcctgggcgacagagactccatctcaaaaaaataaacaataaaataaaataaaaacagaactctccactgttgcccacatcaccctccaactactgagctccttctctgagccctctagagcaaccttctttaagtcgtatctacacaggtggtctcctcttccatctcctatgtttcaattgactccaatctggctttcactccctaccgtgaaaccaaaagggctgaccacctagtacctgcagtccttaaatttaaggaacctttggccaggtacagtggctcacacctgtaaccccagcattttggataacattaaggccgaggcaggtggatcacttaaggccaggagttagagaccagcgtgaccaacatggtgaaaccccgtctctattaaaaatacaaaaattagccaggcatggtggcacacatctataatctcagctactcaagaggctgaggcaggagtattgcttgaacgtaggaggcggaggttgcagtgagcccagatcgcgctactgcactccagccacggcaacagagtgagacttaagggaaccctttccccacccccattcacctgactcctcaactgcaccctacactgtcacatcccacctctccgtgtctcctcgatctaacctctaatagctgggcaccccacctctccttttaataacccctccaccgaccatcacaaaaacagaaagaccaagacttccagactggactccaggccaacaggctgttagccggcggttggcacttagttgccctatacccattttgagcttcagatattcaaggcatggctctgcacagccaacagatttgcctcccctcagtgctcaacatcaccaccctctacatgtgcaaagcacacacagaaatcatcctggcctccttcctttccctactcccctacacccggtccatcagcaacctggctgactctaccacccatttcttcccatttccttagtctccatcctcagccaaaccacgccatttctcatcaacagtctccttaaaatgacctctgtctcaatctgtgcccccgacaatccatttttcattcagcaatctgaacaatcttttttctttttttttttttcttaagacagggtctcgctctgttgcccagactcgagtacagttgtgtgatcatagctcactgcaaactccaactcctgggctgaagcgatgctccctcctcagcctccccagtagctggaactacaagtgtatgctacaatgcccagctaattttttcttttaagtagagacagagtcttgaactcctgggctcaagcaatcttcctgtctcaacctcccaaactgttaggactataagcatgaaccactgcacccagcctcaacaatcttttaaaattcaccttttgtcacttgaggcttaaaatttttcaacggcttcccactgcatcaaggaaaacatccaagctctctgccagtttggaaactagagaatgcaccatctgcacgaggaccctcacctggtataaatcaagactgtcctgggcaaactgggcctctggcacctgcctgaggccgtgtggccaaggcctggcttccacccctacctctgccctacagctttgctcctgtgtgctgagcttcacccgctgtcccttccgcaggacctctgctgagcttcgcctgctgtcccttccgcagggcctctgcaatcactgccctctccacctgaagcataggggctccttgcctacctggttccttctcatccttcaggcctttactctaaataccctaaacaataccctaaaccaagtgccctctccacccaacagctcacagcacctaccacaggcccaaacttcgcttcttccagttcgccatctccccacagagaatgaaccaccagttgcaacttctcggtactcaaccatcaccaagcacagtgtcttgctcaaagtaagtacttggtaaatatttgttaaagagttcactccatcccacagataccatattattaactgggcatcctaaagcaggaagttcttgaggtcacacagtataggaaaggctgtgatgaaaaatggccacggtttctgcaagtcccaccattaaggaccagagtctatctcctactctccaagcctgtgctaagccttgtttttttttttttcttcattttcggtagagatgcggtctcactatgttgtccaggctggtttcaaactcctggcctcaagccatcctcccaccttggcctcccaaagggctgggattacaggcatgaggcagcactcctggcctatgctaggcctcataacttgcaataagcaagggaatgcaacagaggtgacactgtgacttctaaacatgtcctcaagtagcctgtcaaactctgctcctgcccttttggaattcagccactatgggaggaagcctgagctagactgttggagaggcaggctgaggagatcagaggcaccctggctgaaagcccatgtgggtgagggcaatgggaagcacaagccagcctacctgccaactgttaattgcccttgctagcgtggccagcacagtgaacagagatgagccctgcccacatccatactcccacatgatgatgaacaaggacttactgttttaagtcgcttcattttggggtagtttgttacccaggagcatataactgatgtaaggccatgacaatatgctcttcttaaacttggcgccgagactggacgcagtggctcacacctgcaatcccagcacttcgggaggccgaggtgggcgggtcacctgtaatcccagctactcaggaggctgaggcagaagaattgcttgaaccccagaggcagaggttacagtgagccaagatggtgccactgcactccagcctgggcgacagagcaagactccatcttaaataaacttggcaccgagactgctggactggacaattctccatggtggagcaggatccctgtggcacaccccagctgtcacaaccaccaatgtatccaggcaggcagcgtggggactaaatacaagagggaacgcatacctgcctctaggggactcagcactttcacaggggaaggaaagattccctgctttggaggcattctttatgtcttctcattgacttctgatctaggttactggtccccaaggacagtcagtggaacaaatgctggcagcagcctcgatccatccctgtggaagctaccgaggacaacactcttcagttcccacaaaagaaagactagcaaagcataaacacaacgcgcctcctggccaggtgcggtggctcacgcctgtaatcccagcactctaggaggccgaggcaggcagatcacgaggccaggaattcaagagcagcctggtcaacatggcaaaaccctgtctctactaaaaatacaaaaattaggccgggcgtggtggctcacgcgtgtctgtaatcctagcactttgggaggctgaggcgggcggactgcctaagctcaggagttggagaccagcctgggcaacacggtgaaaccccgtctctaccaaagtacagagaaagccgggcgtggcggtgtgcacctgtagtcccagctactcgggaggctgaggcaggagaactgcttgaaccttggaggcagaggttgcagtgagacgagactgcaccactgcactccagcctgggaagcagagcaagactccatctaaaaaaaaaaaaaaaaaaaaaaaaaaagtacaaaaattagctgggcatgctggcacacgcctgtagtcccacctacttgggagactgagacaggagaattgcttgagcctgtgaggcggagttgcagtgagctgagatggtgccactgcagtccagcctgggtgacaaagagtgacaccctgtctcaaaaaaaaaagacaaaaaaaaagtgcctcctgagcttcgttctgtgaagcatccagaatccttacagcagcggtcaccaacctttttgatgccagggaccggttttgtgaaggacaatttttccacagacagaggggatggttttgggatgaaactgttccacctcagatcatcaggcattagattctcataaggagtgcacagcctacatccctcgcgtgtgcagttcatgacggggttcacgctcctatgagaatctaacactgccgctgatctgacaggaggtggagctcaggtgggaatgctcgcttgcccacctctcacctgctgtgcagcccggctcctaagagaccacagcccaggagttgggggcccatgcttagaagacattttatctttttctggttttttttttttggagacaaagtcttgctctgcctaccagtctggagtgtagtggtgtgatctcagctcactgcaacctcaacctctccagttcaagtgattctcatgcctcagtctcccaagtagctgggtctacaggtgcacgccaccacaccccactaaacttttgtgtttttagcagagacggggttttcacatgttggtcaggctggtctcaaactcctggcctcaagtgatccacccgctgtggcctcccaaagtgctgggattacaggtgtgagccatcacacctggccaaggacactttaccttttctattttgttttgttttagaggcggggtcttgctctgtcacaggttggagtgcagtggcacaatcatagctcattgcagcctcaaactcctgggctcaagtgatcctctcatcttggcctcccaaagtgctgagcttacaggagtgagccactgcatccggcccctttttctatgtaaattatcttacaagtttcttcaacctccaacagagacttcatttcacaaggctggccacaaggggaatgggaagacatggaaggcaagagagctagaaacacaaggggcgaaggatgaagctctaggaactttagcaggttcaacagtgtccccccccccaaaattcatgtctacctggaacctgggaatgtgaccttatttggagcgtctttccaggtatgattagttaagttaaaacgaggtcatactgaattagggtggccctaatctaataactatgtccttataaggtgagtagagacactgagaaaagcccacgtaaaacagaggtagagagtgactcctctacaagccacactgctggcacccaccagaagccagaaagaagaaaggaagtgtcctcccttggagccttcagaagcactggggccctgccaacaccttgatttcagacttctgtcctccagaactgagggaatcaattcattctgagccatccaacttgtgatgatttgctacagcagccacaggaaactaacattgtgtcatttctgaagacctttactaagccagaaccacaagggtagaaatcaagtgcccagatcagcttggagaaggacttgtttttttttaatagagacagggctggagtgcagtcgtacaatcaggtcactgcagcctcgaactcctgggttcaagcaatcctcccaccttagcctcctggatagctgggactacaggtgtacaccatcaggcccagctaagaaaaagagagagcaagagagaggacatgcatgtgcacacgagagagagagagagagagagagcgagcgtgcatggccacgtgcacgagccagtgagcaagcgcacacacatgcaaaaatggggtctcactatgttgcctaggctggtctcaatcttcccacctcagcctcccaaagtgataagtgtcataggcataagccaccacacccagtcaatggagaagcatttcaggaatgaaggcagagtcaaacaccatcagtagtagcggtactggaagctaacactttgaggtcttgcttggcttgaagctaagaattttatttgtagcatgtcattcagtcctcacaacaatcctggaagacaagaaaactaaggtagagacgttcagtaacttgctccagacctcaaatctgagttggcagaaccaggatgtccagcacgtggattcaggtacaagaaataccactgatatctacataattactactcatgttttccaagatgaatgacatttggaaacaattacaaagtagaaaaatcacaattttaaaaatctatatatacaggccaggcgtggtggctcatgcctgtaatctcagcactttgggaggccaaggtgggcggatcacttgaggtcaggagttcgagaccagcctgaccaacatggtgaaaccccgtctctactaaaaatacaaaattagccaggcatggtggtgtatgcctgtaatcccagctactcaggaggctgaggcaggagaatcgcctgagctggggaggtggaggtttcaatgagccgagatcgcgcctctgcactccagcctgggcaataagtgagactctgtctcaaaaaaaaaaaaaaaaaaatatatatatatatacacacacacacagagtgggacccccaatccgaggaaaaacatctctatacacacatgcatgagagatacaaaacactagaagaaatataataatcttacatggttatttcctgattgagagattatagatttttgctgtatgttcctaatttcccttttttataaaattttatttatttttttaaaaatagagacagggtctagctgtgttgcccaggctggtctcaaactcctggcctcaagtgattctcctgcctcagcctcccaaagtgctaagattacaggcatgagccaccatgccaagcccctaatttactacaatgaacattttagatgtttttattagcaaaatgaagaagctgaaaataaaactgagacaacaggaacaagatctccagagaaaggataggatagatggtggaggcaatggaaacagactgcctgttggggagtttaaagagagaaaaacaagaagagtggctagaatagatagcaagattaactgggtgttgagttacataagatttaggcatgtttgaaggtataatagagtagccactgacaaaactgttggtaactgttttccagtggaaaaatgttccttttactaacataggaagaggcaaatgcagacacagaagtcttctcagatgaatgaggagaaagagctcacaccagcaggtctataatgcataggctccaggagcaatgacccaagaactaagttcactgtcaccacggccaactgtctaatctccctgtagatccagtcatctgtaagatggagctattaacagcacctatcagagctgatgtgaggaccacgcagtaatagcatagttcccagcatggtgcctggtgcaagaaagatacccaacaaatgcgagctaatggcacaggcatcttcaacagggcaaaacgcaagtgcaccaactgccatgggagtgtcaggcagagggactggaaggctaaggttgtagggaatttatttcaacaggaaaaccttcaagtacctctcccaacacactttacataatatgtatgccaagcggggattaaccaattttccaggacttatttcaattccaagtccaagcacagccctgacttggggcttctcctgcctggaaccctcttttcccagatgtctgtctggtttgtcttctcacctcctcctactctctcctcaaatgtttggaccacccttttcaacatggaagcaccagcaatgcctagagccctacagcagactcgtccgccatctttttcagcacacagccttttccactgtcgcataggtaacattcctctcaccaaggcaagttggcatctcttattcactgcccatcacctgcctctccttggcacatctttggccctgaatacgcattttacaaaagatctctcctctcttcccctttatgggcgctgccctctcagtattcccatctaaaatccatgcagacagagcctcccctagccccacacttctctctccgactactttcctacaagactctcctcaccccactggaactcactggccctcagcaatctctaccactgacgaatccatctccaacttcggaccattccctctgctctcagaataccttctgtgggttctgcgacactagtgctgagagtctcccaaagtctggtcactcctttaagtgtttctcttcctctgcacatccctaacacaagggcctcttctcaagctacaccaacgggtcttcacctctgacaaatctctgagttctcctccccaggaaaaggcacaatcctacagtactgcacatgggggcagggacagggtgcctgtctccagctgagaacttctctggtccccacaggtgccctgggcctggcccattctctaaaccagcgctgctcagatatttcggctcagaccccctctacatcctcaactattaaggaccccaggggcttttgtttatgagggtttgatctatcaatatttactgtgctataaattaaaactgaaatgtcctaaaaatgtttatcatttgaaaataagcccactgcatgttaccatacataacatttttataaagaacaactactttctaggccgggcgcagtggctcatgcctgtaatcccagcactttgggaggccgaggcgggcagatcacgagatcaggcgatcgagagcatcctgcctaacacggtgaaaccctgtctctactaaaaatacaaaaattagccaggcgtggtggcaggcacctgtagtcccagctattcgggaggctgaggcaggagaatggcgtgaacccaggaggcggagcttgcagtgagccaagatcgcaccactgcactccagcctgggtgacagagtgagactctgtctcagggaaaaaaaaaaaaaaaagaataactattttctaagaaaaataatctggtgataagccatattttacattttacatttaccttgtctgcctcaatgggagcaatggatcttcacatcgtgtctgctctcagcctgatgcaatacacagttttagctgaagtctaagaggaaaattcagtctcacatagatatgcagctggaaaaagaaaagagctgttttttgttgttgttgttgttttttaagacatagggcctcactctgtcacccaggctggagtgccatggtgcaaccatagctcactgcaatctcaacctgccaggctccatcaatcctcctgcctcagcctccccagtagatgggaccacaggcacgcaccaccatgcctggctaattttcaaatttttttgtagagatggggtctcactatgttgcccaggctggtctcaaaatctcagcctcaagtgatcctcctgcctcaccctcccaaagcactgggattacaggtgtgagctaccatgcccagccaagaacagtatttctatagaatttttattttatttttatatgtcaacacaatgaaaagtcaaataacatcttaatatgattatgaaggccggacacggcggctcacgcttgtaatcccagcgctttgggaggccgaggcaggcggatcacgaggtcaggagatcgagaccacggtgaaaccccgcctctactaaaaatacaaaaaattagccgggcgtggtggggggtgcctgtagtcccagctactcggagaggccgaggcagaattgcgtgaacccgggaggcggagctggcagtgagccgagatcgcgccactgcactccagcctgggcgacagagagagactccatctcaaaaaaaaaatatatatatatatgatgatgaaaacagttctgactaagtgaattcctgaaactgtctcaggagcccccaggggtccacgatcacactttgagaaccactgctctaagtgaccactgctccccaagacttcaatcatcacccaaatgttgctaactcccaaaggcctgcctccatccagacctatcttccagagctccccactcacaggcacaggagtcactacgtcagcatttactgtgtaccgttttaggggctggtctgcagtgaaccagactgcctgtgtccatggagcttagaagaagtgggaagagcattatcaggctacgaagacaagagtggggtaaaacagcagagatcaatgagatcagagcacaccctcggaggaagggatacatgacaaatgcctgaacggagagagggagtgaactgtgcaaacacacagccaggagttttccaaggacagggaggagaaagtataaggcctgccgtaccctcgatgcaaaacatgagaaagcctcagagactcctcaaacccaacacacacaaactaaactcatcatgacccacagccacccagagggcagacggaaacctgtggtcatttacatctttctcgccactctcgccttcccttcggtcaccaggtcttatcaatcgtcaacctggtccagacccctttcctcttctacagcagctttgccaactgactagagtcccctccctcccctgagcactctacgctcaactaccaagtaatgatccccatcagatcaatctccttaaaactctttcagggcttcctggagctctcgaggtaaaagttcatttttttctttttttttgagtctcacactgtcacccaggctagggtgatcttgggtcactgcaacctccgcctcccagattcaagtgatccttgtgcctcagcctaatgagtagctgagaatacaggtgtgcgccaccaagcctaatttttatatgtttagtagagacaaggtttcaccatgttggccaggctggtctcaaactcctgacctcaagtgatccgcccgccctggcctcccaaagtggtgggattacaggcataagccactgtgcccggcctcaaggtaaaagctctttatccagactgtaaaccttttggcttccaggtctaaccactctcctagccctttggaacttccgtccctggatgtgctgtgctcttatgcgcttgataaataattactgagcacctggcacacagtattgtgcggggtgctggagacagtgaaggagaccagttggttgccggatgaaaaacacaccatctcatcagcctaggatacactcctcccctccatccccacctgcctgccagacagactccaattcaggtctcaaagctttttttaatgagaagctgccactgaactctggacagggtggtgtccctgggagccacagccactgccctccgctctgtgcctgcgtgtcaggctccctattagaccatgaattcagcaaggccctggatcacatgcattctactatggctcacagcctcagcacccagtaaggtgctaaattggggccaggcacagtggctcacgcctgtaatcctaacactttgggaggccaaggagttcaagagcggcatgggcaacaaggtgaaacaccatctctactaagatacaaaaaacattagctaggcgtggcggcatgcacctgtaatcccaactatttgggaggctgaggcaggagaagcgcctgaacctgggaggcggaggttgcagtgagccgaaatcgtgccactgcactccagctgggtgacagagcaagactccaactcaaaaaaaaaaaaaaaaaaaaaaaagagagaaggtgctaagtcaacatctgttaaacaaatcaccattacagtttttataaaaacaagtggaaaatatttaattattgtccctatcagcaaatcaagggacgtcaacaaattttggtgaaattaaaaaaaaatctagcttcataaatgggaggaggagaattctctaaaaaaatgaacataaatgggcagggcgtggtggctcacgcctgtaatcccagcactttgggaggccgaggcaggcagatcacgaggtcaggagtttgagaccagactggccaatatggtgaaaccctgtctctactaaaaatacaaaaatcagctgggcatggtggcaggtgcctgtaaccccagctactctggaggctgaggcaggagaattgtttgaacccaggaggtggaggttgcagtgagccgagatcatgtcactgcactccagcctgggtgacagggcaagactccgtctcaaaaaaaaaaaaaggacataaacttaccagttttcaaaatgaggcatagttcaagattattctacaaaggtaaaggaaagcctttaagagcaggttactgtggctcacatctataatcccaacattttgggaggctaaggcaggaggatcacttgaacccaggagttggagaccagcctgtctctacaaacaataaaaaaaattagctgggcacggtggcatgtgcccgtggtcctagctacttgtgagactgagagaagaagatcgtatgagcccaggaggtccaggctgcagtgaaccatgatcataccatcacattccacactccagcctgggtgacacagcaaaaccctgtcccaaaaaaaaaaaaaaaagaaaaagaaaaaaaaacctttcaagaaaagataaggatgtgagagatttagtagaaagtaaggcagtaaataagtgatagggatttgcaaagatagctaatatgcatgttccacaccctgaattaatattcttctggaaccatggagaaaaaaagaaaaatctcagtaaactgtcatcttataacatttgttaaccttgccataaaagaaatttttacaaagcaaggccatcagcaacagaaatagctaatccttgcactgagctctgttatcagtgcccacatcaggactcatttaatcctcacaatgaccccatgaaggaggctctaggagcctgtttcacagataaggacagacacagaagtcctaacactgcaggtggcctaaattaaggcaggctcagggaggacagaaagctcctgtggagtggaagggtagaagttgaactgatcttgattttcagtgcgaataaaagtcctaacactgcaaatcagccagtgaggcaacagagctgagctgggctctaactcagacagtgccaatccttttgaaaactactgaatttctctcactccctagattttaggaattattttaaaattcctatgagaaattttctgaaacctattgtagactcttttgacatgctcatctaattataaagtgtccggactttttttttttttttttgaccgagtttcactcttgttgcccaggctgcagtacaatggcacaatctcggctcaccgcaacctccgcctcccaggttcaagcgattctcttgcctctgcctcccgagtagctgagattacaggcatgtgccaccatgcccgactaattttttttttttttttgagatggagtttccttcttgttgcccaggctggagtgcaatggcacgatctcggctcactgcaacctcagcctcccgagtagctggaattacaggcatgcatcaccatgcctgggtaattttttgtatttttagtagagatggggtttctccatgttggccaggctgatccaccctcctcggcctcccaaagtgctggaattacaggcgtgagccaccgcgtctgggctaattttgtattttcagtagagacagggtttctccatgttggtcaggctggtcttgaactcccaacctcaggtgatccgctcaccttggcctcccaaagtgttgggtttacaggcatgagccaccacacccagcccagaattttttaagctttattaactacaacactcggcagaagttgagtgtctgtaatcaacatagggaatatattttctaagtgctacaggactgcacacagacatgcatggagacatgattacccaccagtaaacaagaatacattccactgatgcccttagtattcccattctttttttttttttgagagacggagtcttgctctgtcgcccaggctggagtgcagtggcgcgatctccactcactgcgaggtctgcctcccgggttcacaccattctcctgcctcagcctcccaagtagctgggactacaggtgcctgccaccacgcccggctaatttttttgtatttttagcagagacagggtttcactgtgttagccaggttggtctcgatctcctgacatcgtgatctgcccgcctgggcctcccaaagtgctgggattacaggcatgagccaccgtgcccggccagtattccaattctaacaggtgaatgaattaatacataaagtcctctcttgatataatgcattagtaagtttggagcaatgaattattaaatcataaaaatattttatctatggcaaaataggttcaacagaataaacttaaaaattaagctgggcacggtggctcacacctgtaatcccagcactttgggaggcggaggcgggcggatcacttgaggtcagcagtttgagaccagcctggccaacatggtgaaaccccatctctactaaaactacaaaaattagccaggcatggtggcgggcacctgtaatctcagctacttgggaggctgaggcaggagaatcacttgaacccgggaggcagaagttgcagtgagccaggacagcgccattgcactccagcctgggcaacaggaaggaaactccatctcaaaaaaaaaagaaagaaaaaaggaattaccttagataatcttaatctggtcttttaaatcagtaagcttttaaaaaatgggtctttctcagaattctaatttaagaagacataaataaggaaatacttccacttaatctttttttttttttttttttttgtgaaacggagtctcgctcagtcacccaggctggagtgcagtagcacgatctcggctcactgcaagctccgcctcccgggttcacgccattctcctgcctcagcctcccaagtagctgggactacaggcgcccgccaccacacccagctaatttttttggtatttttagtagcaatggggtttcaccgtgttagccaggatggtctcaatctcctgacctcgtgatccgcccacgtcggcctcccaaagtgctgggattacaggcgtgagccaccgtgcccggcccacttaatcttaaaaaaaaaaaaaagcaagcaagcaacattgctctataaaacagaaagcttttctaccactgaaagccaggagtaatttccactgattaccatggcacccaatggtaggcactgacacaagaacaagaggctaaaaggtttaaaaaagctttcagcattccggcagggcacggtggctcacgcctgtaatcctagaactttgggaggctcagacaggcagatcaccggaggtcaggagttcaagaccagcctggccaacatggtgaaaccccatctctactaaaataaaattttaaaaaattatccgggcatgacggcgggtgcctgtaatcccagctactcgggaggctgagactggagaatcacttgaacccgtgagatggtggttgcagtgagccgagattgcgccactgcactccagactgggtggctgagtgggactctgtctcacaaaaaaagctttcagcattccactaatccactagcaaactcaaatgtctatagattgtctctatttcttcaatcaaagttctagaacaaaatgcatagctttgaaataggtggtgctctgtccctctcccagagcagctgatgtgatgttgcatttctctctcttcatacacactcactcccatatacgttggccctgctttttctttcagtaatgttgaacactgcagtttcataaatttctgatagtttccattttaaatttattttatctcctcattctgtgttcctaaaccaaacacttaactgaattgcctacttcataatctctccaaccactcttaacaaatgcaaacctgaaatcagaatgtaaaccagtttaaaattttttttatttttattttttgagacggagtctcgctgtgtcgcccaggctggagtgcagtggccgatcttggctcactgcaagctccccctcccgggttcctgccattctcctgcctcagcctcctgagtagctgggattacaggtgcccagcaccacgcccagctaattttttgtagagaagtaattttagtagagaaggggtttcaccgtgttagccagggtggtctcgatctcctgacctcatgatccgcctgactcggcctcccaaagtgctgggattacaggtgtgagccaccacgcccggtcaaaccagtttaaaattttataaaaatttttgttccatgtcttgtgagacttacactaaataggggtttcaaaataacatggcctgccatatggtcaagccagatttaaaaattgagaatatctattaccaatccactaatgctaaagccaaagtcacagacagtaagaatgtaatccaatttagagaccaacatgagccaaatctttcgggcagagaaaaacaacgacaaaactataataaatgccaacactgcacttctaaaataataccaatgttattcattaaagtattagctacaaaaagtcaactgatggtagatgaagtctagagatgccctgaagacctttttcatccttttatcaaagctgtttttagctacaaagctacaacttttccagtggaccaacacacacataaaataaaccaaaagacccagaaatttttagcaaagcaaagggaagagaacaaagctctggtacttttgcaggatagtacaacatctcctttgagaaataaattaacttttcaaattctgtttctcaagtgatcaacataaatctacctagatgatactagctttgaaatcaaagtcattgggcatcaaaaggatttacagaggtttttactcttttgagacacagtctcactctgtcgcccagtggcacaatctcggctcaccgcaacccctgcctcccgggttcaagcgattcccgtgcctaaacctcccgagtagctgggattacaggcgcccaccaccacgccggctaattttaatatttttagtagatacgaggtttcgctatgttggccagactggtctcaaactcccagcctcatgtgatccgcccgcctccacctcccaaagtgctgggattacaggcgtgagccaccacacccagtgggttttactcttaaaaacaaacaataaaaaaaccacacactattctgcagtctcttgaatcttctaagattaaaattaaatctgagaaaatttacttcaactttcccacccaccaaaaaaacagaattaactgaagatatcaaagaaaaaacaatattttaaaggtatcactgaagagcactgtcagtacttgtctgatgagataactatggttctgtcataaattcagattacgcgagagaaatagcttttggccagtggatgtgctcttttgagaaagtcaattctgagctgaaatttcatgttggaacagtttcctctataagactcatcttgaaaggttcccgcagaagataaaatgtcatcctcacactgggcctgggcagtgcgcacttaactgggagggggcacaggcacctcagaacttaactggttttccaaactctcaatctcaaaaaaaaaaaaaaaggcgggcggggggagcactttcagtgttgatgaaaccaaatgctcgtaacctgggaccaccgcccaacacctgcagtccagccttcccccagggttgacagcatcagcctctggaccctgcagttgcagttcatttctgcgcagctctaatcgttagaaagttctgccttaccggctgggcgcggtggctcacgctcgtaatcccagcactttggcagatcaaggcgggtgaatcacctgaggtctggagttggagaccagcttggccaacatggtgaaaccctatctctactaaaaatacaaaaaattagccgggtgtggtggtggtagctgtaatcccagctactcgggaggctgaggcaagagaatcacttgaacccgggggcgcggaggttgcaatgagccgagatcgcgccactgcactccagcctgggcaacaagagcgaaactccatctcaaaaagtaaagaaagttctgccttagcataaaccaagacaaaacccaccattcagtcctaccctggggaggctctcagacctgtctccatgtcagtggcaccacctccatccccagcctcgaacccagcgttagcaaagaaggaaccgcctatccactttcttgatatacataccttcccaaagaatccagaatagactatgcatgtcaatagcatgaaaattaaaaccttactttcaataaagagctcctccctctcccaaaagactatcacttcagattagaaaataacttatgcaaaaaccttatcaataacaatgcttgctccaaagaccttattcagtatgcagttcactgaaactttccacaaaactaatacgtccatttgctaatcatgaaaaataatcttcatattttcttaattaataatctcaccagcaactgcttaatcacctaatactatttgagactaatgttatcagatagatagcaacatgaaaatacaatgaaccaatgctccccaaaagaaaaccataggttaccatttctacactatttacccataagtccagtactgtacaccctaactgtaaatgtacaccaactcccttttcaaaacacaaattttaacatcggcgttttccttcaggagcccatttcacaatcttaagaaaaagcttccatgaagacaggctgggcacggtggctaaggccgctaatcccagcactttgggaggctgaggcgggaggatcgcttgagccccagagttcgagaccagcctggttaacaggatctcttttacaaagagatcccatctcttaaaaaaaaaaaaaaaaaaggcttccatgaagatgaattaagcaaacaaaagctgatactgcttctgcatgctaaccatgtaatttaacggacacaagaaatgttaaaatatcatttgaatcaactatcgattcacaagaaaaaatatagcaggttcttaaaagtcaaaagcctcagccgacagccctgtggaattttcaacagatctccccactccccacccccaccccgcttccagccgaaaagccgatccaggcaagaggaagacacccagcctttgtgctatttcctgtcctctcccccaccttcgggccttcggaatatcgcaaaccgggccccgaaactcggcgcggcggcggccgccccacaaaggcagcggtgggagcgccatcttggcgcggccaccgggcccattcattcgcggggccgggccggggtccgcgcaaccctcgagtcgacacgcgcggggcgccagcgccggacagacccgggcctcggcaggagaagggcgaggccacagcgcgactgcctcagcggctcgacacagcgaaaagggccgaaaccgttattttcccatttcccgacgccgcgcccggcttccgctttaaatccctactccgaccgcggcgcgcggcccggcttccccatttcattgttccccttccccacgctcgcgccccgcggccgcccggccctcaaagtcaccccgataggcggcccgcgcgggggctccggccgccgacaccgccccgcctgcaggcccgcccggcctttgttctcgcgccgcgggcccgagagccacgtccggctccccacgcagggcccggccccgcccgacccgcgcccccggggccccggccgccgccacgggaagcgcccgcggcgcacacaaccccgcaccccggtgccgaaactcggcccccagccttgggcctgggaccccggctcctctccctagaccccgccctcgaccccgaccctgcaccccgaacctcggaccccagcccccggcccccccttcggacgccgcccgccgcacccgggcggggcaggaagacgcggccccgaccggcgggtggggtgggggcggggcgggcgcccccagggcgggcgggtggacgaacaggacccgggtccggggctgggggctgccgcgctcacctcagcgccctcgtcgcggcctgacgcgcccacaccgccgcctcggccgccgctcggcaggtcgtcgcgctcgggccgcgctgcgcgctccgcgggcgctgcgggcaggtgcgcgccggcgaggctcggtccagtcccgccgcggcggctgctccactcccggccccgctccccactcgccgcccgctcccgctcccgccgccgccgccgccgcctccgtccgcccctcagacgcctccagccatcgggatgggcgcggcgggcccct

SEQ ID NO: 2290 - DNA, 50526 bp, Homo sapiens
tgagacagtattttactcttataggccaggctggagtgcaatggcgcgatctcagctcactgcaacctccgcctcccgggttcaagcaattctcttgcctcagccacccaagtagctgggattacaggcgcccgccaccacgcctggctaattttttgtatttttagtagaaatggggtttcaccatgttggccaggctggtctcaaactcttgacctcaagtgatcctcctgcctcggcctcccaaagttctgggattacaggcatgagccactgtgcctggatggtcaattgatttttgacacggacaacgaatggatcgaatgggatagcagagtccacttgtgccgtggaatacacaaacacgcaccaggggaaatgagcctcagccctgacttccaccacaagcaggagtgaatttgaggtggatcatacacctcaacacaaaagcgatgtcctatgtctttatgaccctggaggagaaaaaaattgcctaaaaatcataaaaaacaaattccaatagaaatgactggtaaatatgcaaagactggactgaagaactttgatttgagaaaagacgtcataaagggagaggaaggcccagccacagactcggaggcagcacctgcaacattcctcagggaggagggctggaatctgggtgcatgaagagctcctatgaatgaatgagaagaagacagacaatcccacagaagaacaagggatagccttaaacagagatgtcacaccaaagaagatacaacttgtaaatgggcccagggaaagacacgcaatctcactggtgatctgggaaaccaaaaagcaacatctcaacagcagaccgtggtgcaggccccccagacaagcagccccgggccgtgtgacctcgtgctcctgcggatgtgaagcaaggccctcaagcccagtgtggccccgtaggaccctctgtgaccaggcagagctgggcttctgggctgtccagtagggcagccgttgcccacaggtcgctatggagcatgtgaaatgtggcccttgtggaggaggacctgaattttcactattatttaatttggatcaatttaagtttaaatagccagatgtggcagtgacagccacgctggacagcacagtcttgtacactgttggtgggagtgtaaacttgcacaaccactttgaaaaagaactcggtgggctaggcgaggtggctcatgcctgtaatccagcaccttgggaggctgaggtgggcagacagcctgagttcaggagttccacaccagcctgggaaacatggcgaaaccctgtgtctacaaaaaaatacaaaaactagccaggtgcggtggtgcgtgcctgtagttccagctactcaggagctgaggcaggaggattgcttgagcccgggaggtcgaggctgcagtgagctgtgactgcaccactgcactccagcctaggcgacagagaccctgtctcaacataaaaagaactcactttggtattagctgatgccagtgaggctggctatgccctgtgatgcaggcatgagccccagccaggtgccctgtgggaactcacacacaggccaaggggcagtgcagaacggccttcgcaacagtgtgtaccacgaacgctcccaagtgtgcactggcagaaggacggatctagaacccgaggctctctcaggaaaggaaacgccacgcagtggtgaggacaggaagtgcggctcacaccggaagtgcggctcacaccggaagtgcggctcacaccggaagtgcggctcacacaggctgtggagaaccggcccagctccgcgctgagctgcagggcgtgcggaacgcgcaccacgcgaagacagacaggaggaggacggaggtttctggatctcgatgcgtatgtgggaaaacgatcaagagaagcaaggaggagacgcaagcgattcccgatggcggcgggctgcagggcaggaggcatggggagggcagggcccgcccgtttctcggcacctctccccgctggtgcgcgtctaacaacagccacagctgcagagctagacagaagccccccgcagcccggcccctccagggggcaccgcagagcctcttccccgccctgtgcggctccgcccgtgctgggcctgctgggccaatgctggaggtgccttcaagtcttcggttagcgtcaacgtgaatgtacattttcgtccactccaaaaacaacacttagtggcacataagaatattttcttgcttaaccgtcacttaacatcgaaggcctaggaaaattctctactttccagccctcccctgggcccctcagccccctggaatgctgccctgaggccctcaccgcccgcccaccctggcttggcctggcagcctggctcacctgcgggctgctcctcctcctgctccttgtccagcttctccagctccttccggctctgcatgtccgcctgggaggactccgtgccctctagctgctgctcagagaagctggtggcggctttgtcatacaagcttttatcttcgtaggtcaggagactgctctagagaggagaatcaacatcctggcttgggaggtttcccacctccttttcccagtcagctgccggaactcccatgaggacaggccgtgttgggggctggaccctggctccagcgtggcccctcagctgcctcctcggctgcctgctctcgtctcacccatcctggttgtgggatcacagcagcagctcacccagagactcagagtcacccctcagcctccctcactccaggccgggtgggcatggctgtgctgccccagcctgggagtgtgagccacatcttcctcttggtccaaccctccttcctccttggctggctagaggctgaggcttctctccacctgagccttgggacacccatacccgtgacaggacaagacgcgctcacacttggaacaggtgcagctgtggccatggagtgcacctgtccagtcctcccacccccacacctggggcttcagagatgcgtcgggggaggctgggtctcctggggccctcgggcctggagctgctggccagcacccctgctgctacgtgcctgagaaagggagtgtcctgctgctgctgcccctgaggccaggtgactgcaggtgtcctacagaagaagctggtctcttctgcttaggctgatttgaggaggcccccacactgccctccttctcccaggcccactgttgataccctcatgttgtcacctctgttcacccacatgggactggatttggggggcaggtccccacactcccccatggctgagtggcacactcactaatttcagggcagactgggagtcgtccatctcacagggctctgaagctggcaggaacttgaaagtcgtgcccaagcccccaacgttggtcagcgtgatggtccgagacgtggtctctcctaccacgtagctgccgaagtcaatgagctccttgtcgagggacagctgccagaggacatggagtgaactcagggccaccgtgccaggcccacagggtgcccagcgtgaggcctgcacgtggctccaggcagggctgccctgagcatttgtgcgcgttgtgcactgcacaagcaggtacacgattcaacccagaaatcaggtgtgtattgctcatgacaaggtgtggcacgcgagtctggttttaagaacatcaaggcaggagccccctcgccacggagtaacaagggttcagtgagaggacgcagggcccggatgcagggcctaaacaaggagcctggacacggggctttggaggtcctgaggatggatggtgtcattcctgggtgaggtcagctggactctggatacagggacccagggagcatccttccagaacgggagcacgccctccatgggggtgcctcaccatgcccgctgtgggccacaggccacagaagctctggtgctggctaaggatgcaggcccgggccatacctcggctctgcccaatggcccctcctcgggaggcttttctgggctctgagtttggaggcccaggggctccccactctgtgctcctgctccaggggcaggaccaggggccaccgacgcaaatggacgtggttcgcagagggcggtcggggtccagccaagggaggccgcctccttcccgcctgcaccgcctgggtcctgttctccccttgttcagatggggttttactgtttttacagtccccagcctggacgctcccctgggagaagcaagcccctgctcaggggagccgagggtctcggtgctcctgtcacagaggagcacttgacactgcaaagaccaaatgcgggagaggccggggcagctctggccaggacacctggggcctcgccgggcacgtgctccatgatgctgatccggagtggagcaggccagtaccagactcctgccgggctcccaggctgagcaggagggagccggagcctggctgtctgcgggggggcgggggacttcctgctgcccctggccctggtgctcggtgtcctgggcctgagtcttggctcaccaagagcccgcacagccgagtgccggcccaaccgtgaccgctctgaggagaaggcggcagccacagggcaaggagctgctcgggtgccctaggacggcagtggtccctgcatgaacccaagcggggccacttgagtgccaagaggaagggagactaaagtgactggaacacaccaaatactcaaacactggtgagcctatgaagaaactgagaggaaaacacttctctctctgccaccatcggtgactctcatcccaacccctctccacggcgacacgcggtgaaggaggaagcacgcgacagagaaagttacacaggtgctcatcaaaggtggcttggggccagcgtggcctggatcacgggtgaccatgagggcgtctgctgatcttcctggggtgggggacatagcgcgcctctgcccttcgcctgccccggcttgttcctcctctagtgtaagaatgggcctcttcctgccccgctgacgcaggctcaggctgtgagacttgccttgacctgagaattcttaggagataatgacgtccccactgtcctctgggagatgctcgtgctgccgtagctgccactctggagtccagcctggacggggctggccgcagagggcttcacactcgcggctgagccaggagccgtttgctgtgtggcaggtgcggtgcgagctgaccaattactcggcgggggccggggggacaatgatgtgtgggttcctggtttactggagatgcatgctgaagtttctgagggtggagtgttgacattttactaatgtactttgaaatggatcagcaacaacagatatagcagttgatggaccaagcaaaggtgtccgaggccgacaatgtggagtctgggaggatgcggggtccgggttgcagcgcgtggagccttgttctgctgttctgttttcctctatgcttgaaatttttcttagttaaaaagaatcaggcgggatccccccaagagctgcagatgaatgttaagttttcctgagccacaggccctgcagtctgggctccacacagagcagggtttgtctcatttttccagcactggtccgagtgccccacgttcgagaccccacctaaggttcggctcaggcccacctgagctgctgttggaagaaggggctcagcccctggtgaagattggagcttccacctggtccccccgccaacctgcaccccctcccaggagatgccgtcccccactggggttcccagccagcatgccccgagaaatgctggctcggacacctttgaactcaccgaacatttctttgttgaacatttcagtggaactgaaaactcgcccgtctgagccaaaaatgagatatttccttctagatccttgtttatctaaaacataaaacaacccccaccacaatacacttctgcaacttttgtgtgttttgttttttttttggacagggtctggctctgttggccaggctggggtgcagtggcacctgctcgattcactgcaacccccctccacccacccccacctggggtccaagcgatcctcccacctcagcctctccactagctgggattacaggcatgcgccaccatatctggctaattgtattttttgtagagacggggtctcgccatgttgcccaggctggtcttgaacttctgggctcaagcgaccctcctgccttggcctcccaaagtgctgggattacaggcataagccaccacacccctccctcctgtaactttagcctgttacatgtgccgtggctacctgggccagggccgcctgccacctgcccagctcgggtgaccccaggggaaagagtcagtagagggcatctcaggagggctggacactagcttcctggaacatcccagccctcccgacttagacccgagagtgcacgccctcggccactaacccagaggagctgcgccgcggttctgcccagcattcaggaatatgttgagtgtatttttggaagtaaaatagcaaaacaggggcctgcgtgatcctcactgagaggccaagtgcatccttcccccatcatgttctgcgccaccatgcccgatcacaggctccacccaccaccacctccccttcgagagagaacgggcccctctgactcaccatcggcttgaaggtgacaagcacttcacaggacattccggctgacagggggccaggggggtcaaagctgcaggacgtgacccatagcacacgggggttagtgctgcggagggcagacgctcgcctcaccacccagagcacagtcaggctgggcctcctggcctcctccccatcccgggcctggccccctgcccagccgccttcaccccggggagtgctggatctgctgcattccctgctgccgccagtacctggcaggcagggggcgctccagtgtgtgcgaacgtttgtggagtgagggagttaatcactgaaggcgtgaggcaagtccccaggccaactgccaggaaatgggaccccatgggtcggagagggccacagttcccctgggcacaggtgccaggcctgggaccggggctctagggctttgataccaatatgggaccagggggctgtgggcaggagccaggaagagagctggaactgggagtcctgagacagctgggaccctcgggaccctctcagcccctttcagggaaagaaccacaaaaatagcccctactgcacaggccacttgagggagctggtctgtcttggcccagatcagggtgagggagcatctccccaaggaattcctgacgccaggctgatttcacaaggttggattttacctaatgtgcttggtttagaaatgcacaagctaaaattttaatgtaaaatgtgtccctggctggcaacattcccacggcaccagcagaagcaaacccaaagctcctccaattgggagggaaatgctttggtgccgactgcacagagcccgggatggagctgccggggagaggagcagaatccgagagggtggacgtgcgtgcctcacataaaccagcagcagagtgcagggccgagctccaaacccttcagatgacagaagcgtggagtggggatgttagaggacgtatagataaaatggttagagacagaaatagagaattccagacgtgagaaaagaacaagacactgtcaagaaatgcagactcatccaaaacagaacttggcatttttagaaatgagagacagggcagctgagtaagaaacttactgagcaatttcaaccgttgattagcagcactaaggggacaagtggtgaaccgagcagcacctagagcaccacccaatgcgaaaaagagacaagaaatttccaacccgacggggaggtttcaaaaggaggagcaggagggcagagccggagaatgaatgggggaggggcgatgcctggggagctggggctgagaagttcccaaaattgttcaaagatctgaatcttcagattcaacagcacagtgaggtctaagaaaaatcagcccacaccagacgcacagcagagctgcgggacattaaggatgagagaatctcagagcaagcaggcggaaagccaggtatcctccaaaaaaaccagcacctggaccgaggccacctcccactccagcaacaagaggcagagggcaggagagtggtggcctcaacctgttgagagaaaataaccgtccatgagaagttctcatcccagcgtggggaggaatgcctcggtggctgagagcacagcgaccacctaaacccacctctgcacgcgccctccagaaaccacatggatcaatgagagaaacaggcgggctgcagaaatcccatgccttcagcatgactagaggacacagaaccctccagacttaaaattaaccataaggtgaaaagtaaacaccaacctccagcatgcattctccatgcccgccttcacagagagctacgaaggtctgaaaaactgcagggaagagaggaaggagacgggaacaaagaccctaagactgacctaaaatcagctccccaaagagaacatcacagcctccacaagaaaataccaagtcccagtgagtcagtgctgatctcagggaggggccatcagagcccacgcgcccctgggggcagcctcaggaagatgcctcgtgggagaagaggaggcccctctggagcctgggcagcaaggggggaatgaggatcctgcccttgctgaccctcttttgagaagctgcacttcacaacgctcgcgggagtggaaactcctgaactgggaatccgaaagccatcctggacctacaaacctgtccacaaagagaaaactggcaggaagcaggaagtagaagagaaagaactttcttaaaaataaagtaagttaggctgggtgctgtggctcacgcctgtaatcctagcattttgggaggccgaggtgggcctcggatcacctgaggtcaggagttcatgaccagcctggccaacatggtgaaaccccgtctctactaaaatacaaaaaattaaccggacgtggtggcaggcgcctgttatccgagctactcaggaggctgaggcagaagaatcgcttgaacccaggaggcagaggttgcagggagccgagattgtgccactatactccagcctgggcaacaagagtgaaactccatctcaaaaaaaaaaaaaaaaaagtaagttactaaggagcagaagaaaagagaaacattgcagaaaacatggaaaaggccgtcagagggaaaaatgaagaaaaataaaataaaagagaaaagaagaaaatgggccaggcacaggggctcacacctgtaatcccagcacttggggaggctgaggcaggtggatcacttgagctcaggagtttgagaccagcctgggaaacacagtgaaaccctgtctctacaaaaaatagaaaaattagccgggcttggtggcacacagctgtggtcccagttactcaggaggctgattgaggcaggaggattgctggagcctgggaaattgaggctgcagtgaactgagatcgtgccactgcactccagtctgggtgacagagcaagaccctgtcaaaaacaaaacaaagaaaaggaaagcagaaagcattaaaggcaaccagaaggaaaacatcagacaccaaagaccagcaaggaggatccaaaacacaggtaagtggagtctgcaaggaagcaaatggaaacattgttacagagtgaaagcacggccttaattcagggaggcagtgctgaaatgaagacagctttcaccttgacactgaaaacactggctaattgccagggaaaacttatcagaatggtcaacatcaaaacataacaatacaaaaggaaactctgacaaggtgtggtggctcatgcctgtaataccagtactttgggaagccaaggcaggtggaccgcctgaggtcaggagttcgagaccagcctgggcaacatggtaaaacccggtctctactaaaaatataaaaattagccaggcgtagtggcaggtgcctgtaatcccagctactggggaggctgaggcaggagaatctcttgaatccaggaggtagaggttgcagtgagctgagaccgcgccatcgcacttgcactccagcctgggcgacagagcaagactccatctcaaaaaaaaaaaaaaaaaaaaaaaaaaaggcagcaaaacaaaacgaagaaaaacaaaaggaaacttgggcagccaggcaaagttccagccattcgtgaagggaaatgggctcggtctcggacgactttgacacaagaagacagaggagccccctctacaaaatcttcgtgaaaatcggacctgagggcttatgcccatatagagcctgttccagccgttctgaacatgaagggacctatgaacctcctgctgtccctgcaccgcgtccctccctgtctgagccgtcctcttactcaacgtggatgaagtcccggaggtgctcctccacgcccaccagcttgcagtagttgatcgtgtaggtggtgtttaccaacgtgatctttttcttgtacactttgccaatatcaaagtcctgggaaaggccgaggtagcagcttcagagcgggtcacagggggctgtgctgtgagcaccgaggcagctttgcctcaaggtaaccgctggtgagcatttgccaactagggagaggttcccagggaacaatttccaaggtttctcccagaatcgagaaggcccctggggtgcatgaaggacaggtctgggggtggaacctgtcacataagagccttcgccacttgaggcaggacagggccttgctggggcccgcaggtgggagtaagagaaaaggctcagacactgtgggttccaaggtgggtccctgactccatggatggacttgagctggggtcaaatacaggagcccacagcctgctctgtcttgcagagtttggcagaggcgtccaggcaccaacctcagcctcacatgttcccaccctgtccctgctacatccctgtcccgaggttcaggggacccccactgccccaagtggcacagggctttcggggccacggcacccccattgctcagactggcgtccagccctccatggggatggggccctctccctccacctcctggaagagaaggtccacacttgggcctgtgcctcctgaggaagcccccgggttttccagcgttaaaaagcgaaaggcaggccaggcgcagtggctcatgcctgcaatcccagcactttgggaggctgaggcgggcagatcgcctgaggtcaggagttcgagaccagcctggcctacatggtgaaaccccgtctctactaaaaatacaaaaattagccaggcgtggtggcaggcgcctgtaatccctgctactcgggaggctgaggcaggagaatcgcttgaacccaggaggcggaggttgcagtgacctgagattatgccgttgcactccagcctgggcgacagagtgagactccatctcaaaaaaaagcaaaaggtgtcaggggttgggctgcggcagggctcccctgctgtcctgtgctgctgcccgtcccgttcctggcccagctgcgggctcacctggaagtggaggagctccggtttgctgttgaaggggcgtccttggaactcacgcccccacaccacctgcttgtggaccaccctgctccgcagccgctccaccgtgcgctccaggatgtccttgtccatctttgtcccgcccacgggctttcggtccacgtcctccttgggcacctgggggtcacagagacagaggctggggctgttagcggctccacctgggcggcgccggtggcagctcggaggcgagggtagcggttagcagagcacggacagcccagccccaccggctgccaccagcgctggagctgggaagagccccatggcccggggagttgctctgagttgctcagaaaggccctggggaccgactgactttctgctccattgacaaggcagggacccctcacttccaaaaaagaggaaaccaggaaacaagagcagacagctccagattcaggtggatttctgggaaatgatgtggagggggaactttccagattgttaaatcaggacaagaggaaggttttgaaaggttctgcaggaagcagttttctcgagcgggcagtgtcagcacacactgggctttctcagatgaaaagccgcttccctggccaacaccagcaaccaggaagatcagaactggagtcctgaactgtcccttcagaagctgcttggactctgcgtgggtcctggctctgggctgtgggctgtccctgctggtgcccatgcccggcagccgggcagcctcctccctggcttcccggggtggggggggcacttggcaccctcctcttgtccagaggcagccttctcccttgggtgtccccagtgggcaggtggtggctctgcctggcctgtcttgttcaccaccctggtcagcccggcatccccagaaccagcagaaccaggtggcttttgccctgacagtagaggtggccaatgcttacagaaaccgggcggcgggcattgccctcccacgtgggacagggccacagcctgagccacactgctgcagagaccgtgtcttgctgtaactgctctttcagaggcagaaggaccccagcgccagatggggcatgtttcttacaaaaggccgtcaaagaaagtttgcacgcttcttctagaaagatgcttctccaatagtacacggagtagctcagagtcattccctcagcctttcagctttggagccccaccgtccctccccgttacaccatggtgaccgagctgtctgtcagggggagcttggggtcgtcgagcacgcgtggtgccctccaggctccgcgaagagggaaaggcatgagtgtggagagggaggcggggggcgtccacacacaggagagggtggcgggagatggcaggcacagccaggagaagcctcagagcagctggtgtggccggggcaggcgtgggaggtggcgagccggcgacagagggccggggtccgtctgcaagcgtctaaaggagcaggagctgatacctggtatggcttgtagtcttcattccaaagcccagagatctcgggctcagctaacgtttcctcctctgagctggccccggggtccccctggataagctcactggaaacgacttccagcaaccgagagggcccggggcctgcagcagcctcgtagtcctgcagtcggggagaggaacatcgcaaagacacgctcatgacagagaacagggaagagaaactcggcccagcccccgccggtatggcccgctgcctgcccccgttcttctgcctcacgtactctgcatggagatagcggtgcacacggttttgtaactttttctacttgaaatataagtattttaatacattattaaatatttttctacaatgctcagaagagtctgcaaaatatttcctttgataggaaaatgttctaattcacggactggcatccttggcgccgatcctcaggcactcatctgttctcatttttttttttttttttgagacgcagtcttgcactgtcacctgggctagagtgtagcagcgcgatctcagctcactgcaacttctatctcccgggttcacatgattctcctgcctcagcctcccgagtagctgggattgcaggcgcccgccaccacacccagctaattttttgtatttttagtagagatggggtttcactatgttggccaggctggtctcgaactcttgatctcatgatccactcaccctagcctcccaaagtactgggattacaggtgtgagccaccgcgcctggcgcagttctcatttctgtggatataagccatgcccgggaaaagccccaggctgaccccaggaggatggctgtggtggtttcctcagaatgagtttggggacggagccttgcctatctgctctggctctgtcccaggcctgctggagaagggggaactgggccgggtagacagggttcttcttcctggggaccgtcctatggagcgacagacaggaagtctggacggggccagcgcattgctgttactgtgacctgtatagtgccacaggtggtgccacagaaaatcgcagggagcagctcacgggtgggggtgggggcaggggaggcttctctggagcaaggaggcgcagcagggtgctcctggcggagggatcggcgggtgcaaaggccccggcgtgagacgggcagtgaggggtggatggggcaaaggctcagcccaggcactgggagcctgggtagcaggaaaggaccttctctggtgccctgaagggcaccgcagagaccctgtggaggccaaagctgaggcagcccaaggctttctctttcccagcagggcatcggttgcagcagtgaccttgaccttcaggttttggggtacacaagggcagagactgcagcactgtgccagactcaggagaggaccatcgtccctaccccacacctttagggaaaggtaaactagaaatacattcccccaactgaagccagttgcctgcagcagcagtggacaccaagcaggccctggatgtgagtgagtgagtgaatgagtaagtgagtgaataagtgaatgtgtgagtgaatgaatgaatgagtgaatcagtgagtgagtgaatgagtgaatgagtaaagaatgaatgagtgaatgagtgagcgaatgagtgaatgaatgagtgaatgagtgaatgaataagtgtatcagtgagtgagtgaatgaatgagtgaatgagtaaagagtgaatgagtgaatgaatgagtgaatgaatgaagaatgagtgagtgaatgaatgaagaaagaatgagtgagtgaacgaataaaggatgagtgagtgaatgaatgagtgataggaaagctgtcctctaggtgctatcaggagtgctttgtagcagggtgatcccaggcatgtggtctgaacggctgtgcacatctccctggcaggcggctgacccagctctacagggccaggcaaggtggtcccagcctggtgggcagcaacactgctgggggtgacgcagggtctggtgggcacaccgagaccaggaggacactggacccttgctggggatgctgcggccatgggcctctctcatgtggtgggtccgtagtgtgtcttgtccccttgtccttgagctgagtggcggccactcagcgggctcagcaaccccctgcaggtggccatggtgctgaggtcctcagaggatgtctcaccacacctgagccctgaggccccacctgccctccacaggtgtgcggcttctgtctacaggaaggcgttttgctcaccagtgtgtacgtgttggttgggactgtggtcttcttgcaaaagtcagaaatgtagttccaggtcttgtccctcagggtcagccggtgcctggcactggtggggggatgctgtttcttcctcttttcctcctcagcctcctctttcagaatccgactgatgatctcctgctttctgagcttctgctcctcctcaaaggccctgcgtggagtcgcttctcagatgagtgcaagaggtcccctgcctccaccttgccccagatgagacagtgcccggcggcccctccctagcgccctcctgggggctccggtcctgcccagcagccccaggtgagacagcgcctggcggcccctccctagctccctcctggggactccatcctacccagcagggctcttggggtgggaacttcctggtcctggagctaaacgcaagctccagtgggaagcagatgggcagaggccaagccagaggttccaggcttaaaccccagccctgccctgcccagtccatccctgccaagcccagtcctgctcagtcctgcccagccctgcccagccctgcccagcccagcctagccctgcccagccctgccctgcccaacccagccctgcccagccctgcccaacccagccctgccctgccctgcccagcccaggccttcccagcccagccctgcactgcccagccctgccttgcccagccctgccctgcccagcccagcccagaccttcccagtccagccctgccaagcccagccttgcccagcttagccctgccctgcccagcccagcccatcccttccaagtccagtcctgcccagccctgcccagcccagccctgcccggcccagccctgcccacttcgcagcccagtcccccagcagccttggctgcccggagggcttcttccaagcccttatttctaggctggcgtggggctgccactgagagtagcaccagggctaaagatgttcatccactcactgcagctgcacttcccgggtgcctcctacatgccaggcctgcgccaggctaagggatgtataggcggtggagctgctgccaggacccccccgcccaggtgggcaggctgatgggtggtggagaactctgatcgtgactcaggggggtggggaggacgcactcagggctctgtggcacccagaggaggatgccttgcccagtgagagggccaggagcccccgcccaggcagatcctaagcagtgattggccagggccgtggacagggagactgggatggggagaaagggccaggctcccgggatgagggcagcttcgggcaaaacccaggacagggtggtttgcgtggaggtcactggggagcgttacgggcagggctgggaaaggcgagactgagcgggagagaggggccttgtaggaacctggccccgaggtctggatctcaggaagcccagtggggcccgtgggtggggggtccgagagggcaacatgggcccccgtttggagaagaacagagagtgaagccagaagcaacgtgttcaccacggacccaagctggcaggaggtggtctgaggggccaggagggccccaaggccgtggcagcaggaagccaggtggacggccctggacagggagtgagcaagggcaggcccagcagcaccaggttccctggaggggcctggtgctccctggagacttctgggtgggccaggaaagagcccgccagtccctccttgtgagaagtcaggacaggagccggaggctctcgacaggggccggggtttcagcgtctgggaggggagaaggggccgagggttgggcgtggactggagtaggggcagggctgggcaggctgagtcaggcccaggcagggcaagggtagcagcctggagcccctgttcccgtgccccacagccgcctgagtgggcgccctgggagagagagcagctttgctcaatgtgaagccgaacccccttggctctccctgcacccactgactgggcgggtgcctcccggtggcacctctgccaccaccctcacctcttctgggcctccagctcctggcgccggcgctggtggacaaggtgcctgaatgcatccctgccctgggccagaatcgccttcttctcagcctggaccctctgctccgccagctctgccttggcacggtcccatgcttggaacttccgcagtgtgtccttggaaacagagagcactgagatgacagcagcagcacccacgggcacatgcacacgctcacacctgcacatgtgcacacacaggttcatacatgcacacgtgcacacacgtgcacacacacatgcacacctgcacatgcacacatcacacatgcacacctgcacacacgtgcacacacacacgcacacctgcacatgcacacatcacacatgcacacctgcacacacgtgcacacacatgctcacacacgcacacctgcacacactcatacatgcacacctgcacacgtgtgcacacacatgctcacacgtgcacacacatgctcgcacatgcacacctggacacacatgcacacctgcacacacgtgcacagacgtgcttacatgcacacctgcacacatacgcgtgcacgcctgcacacacatgcacacactcacgcatgcacacacatgcaaacctgcacacacgtgcacatacacgctcacacatgcacacctgcagacacttgcacacctgcacacacgtgcacacacatgcacacctgcacacacacggtcacacatgcacacacgtgcacacacggtcacacatgcacacatgcacacacacatgcaaacgtgcacacacacatgctcacacactgggccgttgaacagatgtccttaaaccaatgttgacgcctgcagatcctgtgagagaccactggcaaactgtccgcacatcccaagcgtggggctgggtgtccctgcacgtcacctgcccgcctctgctcctcacctctgagcctttgcagatgctgttcccactcttccctccattttcccagcctgaatccccagccttggccccagggcatggcctcgaggcacccaggccctccatgtgtctcatgaggacgccactgcttccccaacaagaccaggccccatgggagcagggctggggtgcctgctcctgcctgactccagtgcctggccctgacccacacggaacccgtgggcaaatctgtggcacaggctcgggaagcctccaggggtcaccaagtgcgcgggtcagccctggacgccagaggacacgggcctggctcccaaggagcaggggcccagggacggaccccggcagggcgccaagggagaggctgggtggggctgcgggggcctacccggttcgcggagatgctgcccttcagcgccaccaccgcatccatgcgtcgcctcatgtactcgtggcactccatctcctccttcttctcttgctctcggattctgaggaaggacatttaaacatttttgaggctctgtcgcccaggctggtgtgcagtggtgcgatcacagctctctgcagcctcgacctcccaggctcaagtgatcctcctgtctcagcctcccaaagcgctgggatcacaggcatgcaccaccacaaacggccacatttttaaccgaggaagtgacacagcgatgccgtgtggggtgttaattacaggagcctcggtgctatcatttccaccaggaatgtgattaatggtgagaacacaagaggtgggatgggcaaaaggtgctggcgcagaggccgggccatgacgacatggtgggaacatgccctggagggccaggccacgaggacatggcgggaacacgcccagcgcatctcaagggcctcttctgaaaagaaacagtacctcagcactaaaaatacacacttattggtttttgatgataaggtggtgattcaataataaaatcaggaggctgggtgcagtggctcacgcctgtaatcccggcactttgggaggctgaggcgggcagatcacctgaggtcaggagttcaagaccagcctggtcaacatggtgaaaccccatctctactaaaaatacaaaaattagccgggcatggtggcgcgtgcctgtaatcccagctactcaggaggctcaggcaggagaatcgcttgaacccgggaggcggagcagtgagccgagatcgcgccacggcaccccagcctgggcgacagagcaaggctccatcttaaataaataaataataaaatcagggcatttcaagacaaaagcaagtgacccgtattcttgggtttctccttaaggacgtcgaagggaggccctaccttcccagggaggccttcaggaaccgcacggcaaccttgtggttcttccgggcgtcctccagcagcttctggtgcctgagcccgagctccttctgggtgttcagggacttcctgtggggatatggggccgtcagagggaaactcggcatcacacgtcccatctgcccccaagccctgcacggctggagctcgtgtcccagagacgccgtgggccctttcgctcagctctgtcccgcacagcctcccttggggaggagcgagggtccctggagagctgatgccgtgggccacacagatgtcaaactctccacgctactggggctccagtgccagggagccaccaaaggcaaggtttgatcccagctgggcaggggtctgggaagaggacggtgcaggcacagcagtgctgtggggagggaggaggcaggggctggggaccttgtgtctgcagccagggcctggattccacaggggtttgtggcctgggcagctgaagggaaggaatgagatgggggaggggatggaggccagaagggggtcccgaggagagaggctcacggcaggttgggacagctggcctgatggcctgtggagcacttggggactggcctagtaggtggccgggccctggctgagcaggagactcatgacagaagacgtgtggggaatgggcctgagtgctccacagccacgcaggtgggggccgtgggaggggtgcaaaggagcagccagaggtggggatggagcccagagaatggcctggctgggaagaggaaggggctgccggagggaaaggggaggggcagtcttgctggagcgtggctttagtagccagctttagcggctgtatggtggctgcggcatcttgggagggctggggctctgggcaggtgcaggggagtgcctgacacttgggaaggactcaagggcccggtggaggagcaagctgggaggaggcagggaggggtggaggtggatctggacagatgtggagggcgaggctgaatctggagacccctgggggagagggcggaggggctggcagaagctgctgggaagggatggaggtgggcctgggtgtcgcctacctgatcctcagcagtcggttccgctccaccttccccagggcctcctgctctctgcagagctgctcggctgcgcgcacctggagccgccgccccgtggcctccacctcctcacggtcagctgtccggaaggcctcgagtcgcccctcctggatctcgatgtgccacatggtgttccttcaaacaagaggcaaagcagctggagacgggccccacagtcatcctggggtgggggtttcggcattgagttctgacaaatcctccaggcagatgttgaacaccccagatgggttagctccctcctctaggggccatctccgctctgagtcacccagacactgaggcccgccctgcctgcctccaacctcaggaaaatcactatgggttcaatccagcccggctagagcctggcctgcactcccgcgtgccacctgccggcctgaggctgtgtccgttggctgcggtgggcctggggcaggccctgcccagcctgaggaaggccttcaggaagggacagccgtgactctttggctgggctggaggatccctggtgcaaattgaccggcacccaagaccacccctcagtcttcaaatgtgcctggggtgggggctatggagcgtggagtcagccagccctgcccggggccacatgtcctggatgacaggggacctgcctgacccctggtcttgggcgaatttgtcctcgactgtgagtgtggcgtctgtggtggccccagatgacacagtgccccttggttcttggcacaactcagggaaatttccggtgaatctttagttggaggagtgcgtgtgctgtggaggctcaggctgggaaagttccttctgaggatgtggacagtgtccttctaacagcggccaggtgagagccgctggagaggcggcctggaaagagacacctggtggagggatgcaaggagccgctcctggagactgcgaacggttccacccagagatgcggctcaggccggggctggccacgcgaggatcagaaccctggacaaggtcagacgcaggcgttgagccggcatcctcactgcattgctgacattccacgtgacgtgtgccacagctctgtcctagacacccgcgatcatgttcatttccacttcgtctttcgttaaaagcttttcctgtggagccgagtccagtctctctccccactgcaacacccggggcaggggtcccaccgccttggccctccgtgaataaagtctgctttacatctttttgaaaaaatcatgaacatatgttgaattgagatactcaatggttttctcttttaacgtgttaatgtcaaggatttctaacgttgagcctttttcggggctcctaggatataaactccaacttggcaagggaggtgtgtctgcgtgtctcacacgtggctggatttcaatgttgaatgtttgatttggggttttctgatttgcctcctgagatcgggttctactttccctctctcgtacgcccacttggttttggcatcgaggttgtgtcactgcattttagaaactgggcataccatgttctttgttggggtaattttaaacagagggctcctttccagggagcatgggtcacttcggatctctggctggtgtcctgtcatgcagcacgttcattgctccccaagtctgggggactccgcggagcttccacgggcgggttatttctattcctccctcgcgtgactcatgaaattctttaatctgaggattcatgctcccatcaattctggaaaacgctcagtcattgttctgctggctgtcacttcccctgcccggtgatcagtgctccagtggccgtgggagctaacagcctgcagggtctcttagtaaagaggcaagacgctgtcccagatgctgtcgtcgcccattcctgctgctgtaggaaaacacccacgaccgggtcttcgcaaacaacagaatttcattcctcagttctggaggccgggaagtccaaggtcaaggtgccagcagcttcgatggcctatgaaagcctgttcctcaaaggcagtgcctgtctgtgtcctcacgtggcagagggacagaaaggctccctcaagcccttttacgaggcactaatcgcccccacgagggcagggcccccatggccgaatctcccagagaccccacctcttcctgccgtcacctccagggcggatttggtttggacgcgtgtcccccgcaggtctcgtgttgaaccggagcccccagtgttggaggtgggcctggtgggaggtgttggggtcgtggggcggctccctcatgaacgggtgggccgtctccttggtgacgagtgagttcacggaagatctggatctttgaaaatgtgtggcacctccaccctcttgcttcccctctcaccatgggagacacggctccttccccttccactgtgattggaggcttccagaggcttcccgaggcgccccgagaagcagatgccatcacgttccctgtacagcctgcagaaccctgaccaatcaaacctcttttcttcttatttttatttcttttaaaatgagtcttgctctctccgccagtctggagtgcagcggcatgatttcagctcactgcaaactccacctcccgggttcaagcaattctcccgcctcagcctcttgaatagctgggattacaggcatgcaccaccacgcccagctagtttttgtatttttagtagagacggggtttcaccatgttggccgggctggtctcaaactcctgacctcaggtgatctgcccaccttggcctcccaaagtgctgggattacaggtgtgagtcactgtgtctggcccaaacctcttttcttttttttttgagacagtctcgctctgttgcccaggctggagtacagtggtgcggtctcagctcactgcaagctccgcctcccgagttcacgccattctcctgcctcagcttcctgagtagctgggactacaggtgcctgccaccatgcccggctaattttttgtattttttttagtagagacggggtttcaccgtgttagccaggatggtctcaatctcctgacctcatgatccacccaccttggcttcccaaggtgctgggattacagatgtgagccacctcgcccagccacctcttttctttatatgacccagtgtcaggcatttctttatagtgacacaaagactgacgaacaatagcgttgagttccagcagaccaatttcaggggcactggccttcagaccacagcagaggctgattgggaaagattgggattttgagaatgggagggaggacatttgagggtatctgcacacatctgagcgagtgccccaaaccgccaagcccctctgcatatccgtccacagggaagcagccttcccctccctcgaaggcaggctctgctgcctgggggccccgtaacacctccctgaggggctgccagagctcctcatgacccccttgccatcctctctggcccagatgctcccaggggcaagaacaaagtctgaactgaactgagaggagaaggatcccagaggagaagaatgtagccaatctacacagcaggacgtgggggaaggtgtgtgggaatgaattccaaccctgccagaccgcagagggaagagcctgtccgaggctggcctgggcatctgatgtggacatgccaccagctcacccacccactgcaggcggctcccatcacaaactcagctgatcgaggaaacctggacccaagagagacctacactgcagaaagctagatgccagaaagtcatgcagaaggaatccaaatgtttggagagacaacccgttggaaagtttgttgttgctgttgttgagatggtgtctcgctctgtggcccaggctggagtgcagtggcgcagtctcagctcactgcatccttgacctcctgggcttgcttaatcaatcctcccacctcagcctgtaatcttgagtagctgggattacaggtgcacgccaccacacccagctaagtttggtattttttgtacagatggggtttcaccatgttcccaggctgatctcaaactccggggctcaagcgatctgcccaccttggcctcccaaagtgttgggattacaggcgtgagccactgcatccagctgttggtgagtgtgacagtgagtgtgaccacatatagaagacatgttcttcattatggctccagtgaggagagtcctgtgccctttgaaagcaccgaggggcactccggactgcgcgggggcctggcagggatgttgcctttgaggggctccctgttgccttggggcgatgctggacctgggaggggtggtggagccctggggtgctgctaggcctgggagggagccgggctggttcctcggtgggcagcagggcagcgtgtctcagcggggatgggtggaaggggtttggggcggtggttaattgattttggggtccctagggctgaagtagatggggaccccactcaagtccagtttatctgaagagccagtgtggtcagtcgcagaggtgatgatgaaggttggaggctggacagatgggacctggctggttttgaagatggaggaggaacgcaggcagctttggagctggaaaaggcgaggacatggattctcctcggaggcttccgtggggaaccagccctgcccacaccttgactttagcccagtgggacccgtgttgggccaatgacctctagaactgcaagctcataaatccgcgtcctgctgagctgttaggtttgtggatttgtcactgcagcgatgggatacgggtgcagtcagggaagcctcagagcaggccgggacacagcaccagcgccctgccgtgggtcccatgtggccaagcggggtgcacacaaagcctcttcttcgtgctgagctgggcgtgggaaggcatcatgtgacgaggctgcacagaacacgtgtgtcgtgctgagctgggcgtgggaaggcgtcacgtgacgaggctgcacagaacacgtgtgtcgtgctgagctgggcgtgggaaggcgtcatgtgacgaggctgcacagaacatgcgtgtggtactgagctgggcgtgggaaggtgtcacgtgacaaggctgcacagaacatgtgtgtggtactgagctgggcgtgggaaggcatcatgtgacaaggctgcacagaacacgtgtgtcgtgctgagctgggcgtgggaaggcgtcatgtgacgaggctgcacagaacacgtgtgtcgtgctgagctgggcgtgggaaggcgtcatgtgacgaggctgcacagaacacgtgtgtcgtgctgagctgggcgtgggaaggcatcatgtgacaaggctgcacagaacatgcgtgtggtactgagctgggcgtgggaaggcgtcacgtgacaaggctgtgcagaacacgcgtgtggtactgagctgggcgtgggaaggcgtcacgtgatgaagctgcacagaacacgcgtgtggtactgagctgggcgtgggaaggcgtcacgtgacgaagctgcgcagaacacgcgtgtggtactgagctgggcgtgggaaggtgtcacgtgacgaggctgcgcagaacatgcgtgtggtactgagctgggtgtgggaaggcatcacgtgacgaggctgcgcagaacacgtgtgtcgtgctgagctgggcgtgggaaggtgtcgcgtgacgaggctgcgcagaacacgcatgtcatgctgagctgggtgtgggaaggcgtcacgtgacgaggctgtgcagaacacgcgtgtggtactgacctgggtgtgggaaggcgtcacatgacgaagctgcgcagaacacgcgtgtggtactgacctgggtgtgggaaggcgtcacatgacgaagctgcgcagaacacacgtgtcgtgctgagctgggcatgggaaggtgtcacgtgacgaggctgcgcagaacacgcgtgtgatcgctcacggcctgcctcccaccaccgaagcagcctccaccaggcagggctctgctgcttcattcatgggagaggcccaaaggcttcggacggcgtctggcacgcagtgggcaccctcttaccgcgtggggaggacgggtgaacgagagtgtatctaagccaccggcacagatcgcagtgggcgccctcttaccgcgtggggaggacgggtgaacgagagactgtatctaagccaccggcacagatcgcagtgggcgccctcttaccgcgtggggaggacgggtgaacgagagactgtatctaagccaccggcacagatcgcagtgggcgccctcttaccgcgtggggaggacgggtgaacgagagactgtatctaagccaccggcacagatcgcagtgggcgccctcttaccgcgtggggaggacgggtgaacgagagactgtatctaagccaccggcacagatcgcagtgggcgccctcttaccgtgtggggaggacgggtgaacgagagactgtatctaagccaccggcacagatcgcagtgggcgcctcacagcagcccccgggcacagggatgggacctgcgcaggcgctgaggaccgggaggtggtgtgagcgggcagggtcgtctctagggccttctttgggggttcctgggacctgctggccaggaaatgcccgtgagtccacagacgcttctgccagcccatggccccttgcgtgcagagatgctggtcctgggagagctgcgggtgagacacatgcagcatcccgtctccaagatgattccaaggaccctcggctgttcatgcctgaagcccctccacggggtctctctcgggctggcctgaacaccccaagcccaaccccctgcccagaccacgaccctcagaaaccgagaccctcagaaaccgagaccatcacgcctgctgccttaggcggctaagggctggggcggcctgttctgtggctgcggatgacgcgcatggtgtggcagcagggacacgtgctggggaaggttcaggtgctgtttccagaacgcggtttgggtcccgaagcagcggccagcctcgtggccgccacctgtcccagagccacaacggaggcctcccgggaccgacgctggaagcggggaccacgctctccaagctgcccctcgcacacacccgtgctatttcgtttctgtgctctctccgttgggctctaccgctggaagcccccgttccagagggaggaggccttgcagagaccctgcaacaatcccactgagtggaagctgaagctgcacccagccgtccagtgcccctgtgcccgcagtgcccagagacgacaaaaggagtcaccacattggccacggagaccttgactgcgagagggagggggcgctgcctccaacgggacccagcgggaaagcgcctggaacccggggaccctcgggggctggcacagccagccgcggacagacacgggggcacgcaggacacccagccgcggacagacacgggggcacgcaggacacccagccgcggtcacacgcgggggcacgcaggacacccaaccacggacagacatgggggcacgcaggacacacagccgcggacagacacggggggcacacaggacacccagccgtggacagacacggggacacgcaggacacacagccgcggacagacacgggggcacgcaggacacacagccgcggacagacacaggggcacgcaggacacccagccgcggacagacacgggggcacgcaggacacccagccgcggacagacacgggggcacgcaggacacccagccgcggtcacacgcgggggcacgcaggacacccagccgcggtcacacgcgggggcacgcaggacacccaaccgcggacagacacgggggcacgcaggacacccagccgcggacagacacgggggcacgcaggacacacagccgcggacagacacgggggcacgcaggacacacagccgcggacagacacgggggcacgcaggacacacagccgcggacagacacggggggcacgcaggacacccagccgtggacagacacggggacacgcaggacacccagccgtggtcacatgcggggacacgcaggacacccagccgtggtcacatgcggggacacgcaggacacccagccacggacagacacggtgacacacaggacacccagccacggacagacacggggacacacaggacacccagccacggacagacacggggacacgcaggacacccagccgtggtcacacgcggggacacgcaggacacccagccgtggtcacacgcggggacacgcaggacacccagccgtggtcacacgcggggacacgcaggacacccagccgtggtcacacgcggggacacgcaggacacccagccgtggtcacacgcggggacatgcaggagtcccagctgtggtcacacgcagggacatgcaggacaccccgccagggacagacacggggacacgcatatgcatgagccccatgcctcaggctgtgcccaggagctccatcggagcaccctgcaaacatctgctggagtgaagtcctagaaaatttaacactgggtggagagcagaccagaggttgcctggtggggtggggctacccactgaagatatgcagggaacgttccagatgctttgtactgcatgcaaattagacccagataaagctgacttaaaggaaagtccacgggcagtccggcagcagccgggcccacaggaggagggcggcaggtgggctccgggcgctcggggccgcctgcgggtagggatggggcaactacctgcccgaaatgagggtggtgggaggcagggttcacaccatcagagaagggggtgaaatagacctgtggctttggttgcaattggaattacagatgtgaacgggtggttttcaatacaggcaggcagagctgcgtgcgtttcccacctctgtctactgacggttaagggtctgggtccaggcaagggcagggaagaagaagggaacctgagcctctcactgtgcccgaaaacgcccacagagcggcagacacgaacgcaggatgcggaaggatgccaccgccaaacgcaaggcggctggagcacccagaccaatcctgatgggccggatcatacccgcagggacacagcacccccagcctacacggagagcgatcacggagggggaacgctcccctaacggtggaaagccaactaataggaagggatggtgcaactggaaactcaccccttagaagccatcacagcaggaatgaattctggcaagaaacacggagggatgccagcgctcgtgtgaaaggggacacggagcgggatttcccagcctcaaagcttctgcccacaagctacgcatcagtttccaagggaacggtgtcgctgcactgaagaagccagcggccccacagtggggctggcagccatcacgtgtcccatgagaggacacccgagggactggtcatcacccccaggggcatcgagcacgggcgctgtgcgggacagcccctggcctgcaatcctcagaaccgcaacgtccgcctgtcacagaagaaccgaggctccttctgactgggggaggcgaggggccaccctcgacacaacgccacatgggcttcaggcacggctctgggatgcggggccgaggggcacagggggtcttgctgccattctgcagctcttctgtaagttcggaattgtttcaaaataaaactttatttatttatttatttttgagacggagtctcgctctgtcgcccaggctggagtgcagtgacgcaatcttggctcactgcaagctccgcctcccgggctcacgccattctcctgcctcagccttccgagtagctgggactacaggcgcctgccagcacgcccggctaattttttgtatttttagtagagatgggggtttcaccgtgttagccaggatggtctcgatctcctgaccttgtgatccacccgcctcggcctcccaaagtgctgggatgacaggcgtgagccaccgcgcccagccattttttttttttttaaaagacagagtcttgctcactctgtcgcccaggctggagtgtggcagtggcgcaatcttggctcactgcaacctctacctctgggctccagcgattctcctgcctcagcctcccgagtagctgggattacaggcatgcaccaccacgcccagttaatttttgtatttttagtagagacagggtttcgctatgttgcctgggctggtcttgaactcctgacctcaggtgatccaccagcctgggcctcccaaagtgttgggattataggcatgagccactgggcccagcccaaaaactttttttttttttttttttaaagaagtggacaatcacatcaacctagtaaagtgaggccttctggggttcattagccctgtgaagcccctcaccctggcgcaggtgctgctgagcagtgagaggggcatgacagagccagttgtcaaaggagtgtcgcaggggacagtgttctccacgctcagccacagctgggttcagcgtcctgtcctcccctgcacccctcccactgcccacacaggtggggccacagtgcagggcactggacaccagcttgggtcgtgactgtatcacagcgagcgtgggtcagagactgggccagaaactacgtcacagcaagtgtgggtcagagactgggtcgtgactacatcacagtgagtgcaggtcagagactgggtcaaagctcagtggtgtcttcagtggagtgaggctgagatgttaggttgcatgagggctggcggcatgggcactcttaggggtggggtggcctgaggcctgcactcagccctctctgtgcctcctgccctgcccaggctggaaagcttaggtcatcccgggcacgtgcagggtcagtgctgtggatgtcatggacctggctgcagctcccggggctgggggctgtgtggttcgggagtcctacttgaggtcagctcagggtcccctcagtcgccctgagaaattcgtgcaccttcccaaaccccttcttgccaaactcgccgaaggcaactcgacgcatccaacccaactccacaggaaagcatttaggacgaggcagctgtctctctcctgggctttgaaaacccagctcgctgttctgtggaagcacaaagcatgagaaacgaggaaagaggaaaaagaacctgattttggagttcctaggaacataaacaaacccagagaaactgaaaaaggcaacgtgaagactaacccttccaaccactgcattcaccgagtcccctttccacttccccgcagtttgccggtcaggtgcaaaaccccccagatcttgctctctgcccccagatgggaaggactcgcaccgttctggggcctgcctgctgccagtcccggctgcacaccgactcactcgctctccttcagcacggcctcagtcctcgactgcaggtctctctcgttctccagctctgcaaacaggcgtctggacacggcctggaggcggcccacagcggccctgcagtggtgaacggacaggccgggcgtgtgtcaggcctcagtcatccaggggccatccaggttcacctggcactccctggcctcctctcgctcaggagggaaatctcggcactgggccacctagccaatggagcgtggggctggcgggaggctctccacatgcccctttccgctgggcaggcagtgcccacatggcacagccccagggggagtgagggcttggggagcctgccctggaccctcagtggcccctgcatgaagcccctgggggcagcagccatccaggcctgtgacccgggaaggacccagcacgtgcgacaagccccaagccctcgcgtcagggcgccctgggtcccctccctccctcctgttcccctcctgggcatcatccaccccagcacacatccagtgccagcccagccacgttcctagagaccacttcccgggcggtgggcggttgcccacgagagcggcacagtgtgatgctggccagaggtcccggccatgtggacacgggtggtgggctttgagcagctggccgggtatggcagtcacccctagatcctgggtgccacagtccaggaatgaggcaggtcaaaaccctgcagagggctgggtgcggtggctcacgcctgtaattccagcaatttgggaggccgaggcgggtggatcacaaggtcaggagttcaagaccagcctggccaagatggtgaaaccctgtctctactaaaaatacaaaaaaaaattagccaggtgtggtggcacatgcctgtaatcccagctactccggaggctgcagcagagaattgcttaaacctggaggggcagaggttgcagtggcccgaagcccctcaccccccagggccgggaggacctgctggttcccttgcccctggctgctggccctctgctccccatggctgcactagcccctccaggtcgggcaccctgctggggccttccagggctgggctgaactcggcaggccctgcaggcacctggtgcccccagagggtgaggcgaggccagagctgcagccgtggagccatccaggctcccggagcaatgcctgttggtgagtgttggcgtttccagcgtcccccaggcccctcccacctgggagtgtgggacgcatgcaggcctctcacctctcacctcgccctcagctgcctcaccctgctgctccaggcaagagtggcccaagaggccttcccctgactgctgacccactcggccttgcctcccagagatccagccccagtgccctccaggccccagcagtgccgacctcacatgcttctgcatgttcgtgttgtggcctcacactggggctcctcattggcctgaacacagcaggtgcttcacgcctcactttgggtgaaccagtgaacctccggccctgacctcatgcccggttccctgccccctggcgagggccacctacatgttgcccgcctcttcctctgtggcgatctcggctgccacagcctcctgctgcttgtcgatcaggtcccgcctctgccgacaggcgcgcagctcccctctggaacagggaaacaaaggtcagatgatggttccctgaaactccagcctccaaagtgacagtgggcgtggcaatggggccaggtgaggcagagccagacccccagagcccccctcacccgggccaggggtctctctaacaccttcaagccacacaagcagggtcttgtcgtccatttttggaaaactgcccaggggcagctgtgtggcccccacccgaaggtgacatgctccccagggccgaggacggtgcaggagcgggagggaacctgggtctgcataaacaagcgcactcctgcgtgtgaagggcacgtggtgggaggtctggggcccacgggaggggaggagctggagctcctccaccatcttccagagagcgggccaggcaggcccaggtcaccagtggggcatgggccgggacagaatccagttcacatggtagctcctgggggcgactcaggcctcaggtacaaacaacggagcaaagcccagagcatgaactctggaggtcgcttttttttttcccgagacagagcctcgcttgtcacccaggctggagtgcagtggcgcgatctcggctcactgcaacctccgccccccaggttcaagcgattctgctgtctcagcctcccaagtggctgggactacaggcgcccaccaccacgcacagctaatttttgtatttttagtagagacggggtttcaccatattggccaggctggtctcaaactcctgacctcgtgatccacccaccttggcctcccaaagtgctgggattacaggtgtgagccaccgcgcccggccatgacggtcacttggaaaacacacgggcgctgccggagccgaggagggaaatcgtagtttccccgggtgaagtacccaagttaggtgcccgagttatgggcaagaagttatgcagaagaacatttgtctttcagttttttatttttagagacagggtcttgctctgtcacccaggcttgctgcagccttgacctcctgggctcaagccatcctctggcctcagcctcccaagtcactgggaccacaggcgtgcgccaccactctccgctgaatgtttttagtttttaggagacgctgaaatatttaggagtgacgtatcatgtctgtgatttgctttaacataatttagcacaaaatcccatagatataaaatacaaacacacacaaacacagaaagaagctacaacgaaagcttgacaggtggcaactctgggtggcgctgggggcagcggggccacttgtttccgccttttctgtgggaagggggctgggagcgctgggcactagctcccgggtggggcttgcagaactgctcctccatggagaccctgtgcgaccctcccttgcaggccctcagggtgacgacaggtacaggaccacccctgctgcacccatgtcacggcctggggggcatcaagaggtgcaggtgcagcggcctcagccccagctcacctcatcttctcagtgaaaagctcttgctcctcatgcatcttatccagggcgctcaggttctgccgcaggtgaaatgcctgcgttctgtcctcagctgttttcttcttcaatttatcagcatcagtatctagttctttcactgagcttaggatgaaaaggacgtcagctgccaccaccccagctgcaggctcagaactcattcctcggtgtggctgccggggtaggtgcctgacagttctgcttcagggcgggagctgcgggagctacagcctgtgggagggaggaagcagccgccccgctcccttcacccacccccccacccccacccccacccccacccccccacacccacctccacccccgatcctccgagttacctgctgtgtcccgggtccacgtcatcctcagcttcctgtagaagacatttgatgtcaaactccggatcctctaattcatctctttctagaaatcaaggcaagagtttaaaaaaaaaaaaaagcagatcaaacatttgcatctgaagttttaggataaatctttttctttttttgggacagggtgtaaggaacctgctgcactgcagccacacaagcacaggcagaggtaaacagcctgggtgactcagtgggactggggcgctggcgccttgagagagagagagagagtcagggacatccgtctttgcagacggacagcggggagcaagggcacagcaccgcttggctggtgtccagagaaagagttaagctgctgaccctgaagtcaagggagagccggccacgcagctgtgtgtgtgggagccgccggactaaccagccaggacagggcggacggtgtgagacaaagccgttggggagagctgctgctgaataaaatcctttttcacctgcctacggcccccgagcgttccttctgctcatccacccactccctttggacctcaacatgacgttcggcgtagtcatgaacctgacgtggagtctctgttgcccaggctggagtgcggtggcgtgatcttggctctctgccaccttcgcctcccaggttcaagggatcctcccacctcagcctcccgagtagctgaggctacagatgtgtcctaccatgcccagctaatttttatatttttagtagagagagggtttccctatgatgaccaggctggtcttggactcctgacctcaagtgagccacccgtctcggcctccccaagtgctgggatgacaggcgtgggccaccacacccggcccgtgttaggataaatcttgacacgcactaacttggtggtaccacacccggccagtgttaggataaatcttgacaagtctaacttgatggttctcaaagcaaaatccgaggaaccctgagggtcccttagtgtccttcagggcctgtgaggtgaaaactgtcttcatgatcacactcgcacgccatttgtctcctcactctcttcccatgagaggacagtggcgttttccagaggctgcatgacaggtgacgtcacaacagacagctctaagactccagctgtcttccattaaacccaactcttaacgttactgccaataggttcgttattgctattttaagtggctacgtattaaaatgtttccagctttaatttttgatacagtaagtatggaaagatacaggcaacataaacaaatgttctctgtgtcttcaataatttttaagaatgtaaaggggttctcagacaaaagaggctgaaggtcactatctcagaagattacagcggacttccggcaaaacacggcaaagggaacacagtttttcttcccttcattaaatctcagtaaaaatgatggaaaaggcagaaagccacagtcacaaggggggcgggagagggagacagtggcggggggcaggggggagaaggccacacagcgccaggagctgactcagcacacaacagaacccaaaacggggtggggagtggggtgggggtgggaaggaaatgcgttcccagattgcgatggcctgcctgtgcccagaactagaaccaaatcaaggcacgtctcagtaacatttcagatcatcagagattttttaaaaacagcttccaggaaaagaaaacaaaaataggtcacattcaaaggattgggataaaaatggcatcagatttctcaatactgatgttggaaactagaaaactatggtctgccgccttcaacatctcagccacaatttatctttctttcaaataaagacaataatataagctccctctttgagagaaaaatatgagtgtaaaagataccctctcccagaaataaagggaattaaagggctactatgaagcatgtcatttgtttgtctttttgctgaaacttccgttactgtgaaagaagctttattaccatcttccaaaagaagggcatcggccaaaagctcgtcctcagggagcaggctgccgtcatcctccatgctgggagatagaaattagctgcaaaagatgatcgcaaaatatagatcaataaaatcatagatttaaaagacggtgaattaaccatttctcttaaagaaggcattaagaaaacaaacgacagattaggaaaaaatatttgcagcacacacatatctgacacaagtcttacatctggaacacatgaagagctcctatcaaccacatgaagtccaaactccagtttaaaaggtcaaagaggccgggcgcggtggctcatgcctgtaatcccagcactttgggaggccgaggcaggtggatcacctgaggtcaggagttccagaccagcctggccaacgtggtgaggctacagtgagctgtgatggcaccactgcactccagcctgggcaacagagtgagaccctgtcacaaaagaaaaaagaaactgcccaacagtatcctcgagtatcactttacactcccaccagcaaataccaaattaaaataatgaaatacaacattagctgggtgtggtggcgcatgcctataatcccagctactcaggaggctgaggcaggagaattgcttgaacccgggaggcagaggttgcagtgagccgagatagtgccactgcactccagcctggggacaagagcgagactccatctcaagaaaaaaatgtcaaaagatttggaattccataagaaaagagatatacaaatggccaatatgcatgtgaaactgtgtaacatcagtatctttaaggaaatatgaatcaagccataatgagatactattatatactgagtagaatgcctgagattggctgggcgtggtggctcacacctgtaatcccagcactttgggaggccaaggtgggcggatcacgaggtcaggagatcgagactatcctggctagcacagtgaaaccccatctctactaaaaaacagaaaaaattagccgggcatggtggcaggcgcctgcggtcccagctactcgggaggctgaggcaggagaatggtgtgaacccaggaggcggagcttgcagtgagccgagatcgcgccactgcactccagcctgggtgacagagcgagactccgtctcaaaaaaaaaaaaatgcctgagatcaaaacgctgccaacagtgagcactggcaaggctatggaagggctggcatcgtcacgcgttgctggtgggagtgtaaagggatactctggaacactgttgggcaatttctgttttcttttgtgacagggtctcactctgttgcccaggctggagtgcagtgacacaatcacagtttactacagcctcaaacttctgggctcaagcaatcttcccgcctcagcttcacaagtgctaagactacacgcacatgccgccatgcccaggtaattttcaaattattggttgagatggtgggtctctctttgttgcccaggctagtcttgaactcctggtctcagccaggattcacccacctcaacctcccaaagtgctgggattacaagcttgagccactacatctggcaccaaaaacaatttttttttttttggagatgaagtctcgctcagtctcccaggctggagtgcagtggcgggatcttggctcactgcaagctctgcctcctgggttcacgcccctctcctgtctcagcctcccgagtagctgggactacaggcgcccaccactacgcccagctaatttttttgtatttttattagagatggggtttcactgtgttagccaggatggtctcgatctcctgacctcgtgacccacctgtctcggcctcccaaagtgctgggattacaggcgtgagccaccacgcctggcccaaaaacaattcttaaataatttcaaaattatcattacactttgcttatcattttgggaatgttaggagcttgctcgtgtggaactcttggtaccgaatcttctgtgtccagatgttggaactaaataatttcacttaagaaacaggccgggcacagtggctcgcgcttataatcccagcactttgggaggccaaggtgggcagatcacttgaggtcaggaatttgagaccagcctggccagcatggtgaaaccccatctctactaaaaatacaaaaactagccaggtatggtggcaggcacctgtagtcccagctacttgggaggctgaggcccgagaattgcttgagcccaggaggcggaggttgcagtgagccgagatcacgccactgcattctagcctgggcgacaggggaagactgtctcaaaaaaaaaaaaaaaaaaaagaaacaatgttaaaatcacaaactctttacttatttttttctggtgagaattaaatttaatggctaactttcttttatttttttgagacagggtttgactctgtcacccaggctggagtgcagtggtgcgatcacagctcactgcagcctccaactcctgggctcaattgatcctcctgcttcagcctcccaaaggagctgggactacaggcacgcaccaccacacccaactgatttttgtattttctgtagagacagggttttgccatgttgcccaggctggtctcaaacttttgggatcaagtgatccacctgccttggccttcccaagtgttagaactagaggcgtgagccaccgtgcccggccggtggctgttttctattagaccttaaatatgtgattggttttaacgcctattaatcacattgtgcttgtaccatgattaatatacaaaacagctgatgtcaaatgcttataaatcagcagggcacagtggctcacgcctgcaatcccagcactttgggaggccgaggcaggtggatcacgaggtcaggagatcgagaccatcctggctaacacaatgaaaccccacctctactaaaaatacaaaaaattagccgggcgtggtggcgggcgcctatagtcccagctactcgggaggctgaggcaggagaatggcgtgaacccgggaggcggagcttgcagtgagccgagatcacaccactgcactccagcctgggcgacagagcaagactccgtctcaaaaaaaataaaaataaaataaaaataaaaaaatgtagccaggcgtggtggtgggcacctgtagtcccacctattcaggaggctgcggtgggaggatcacttgagcccaggaggtcgaggctgccgtgagctgtgattgtgccactgcaggccagcctgggtgacagagcaagaccctgactctaaaagggttaaaaaaaaaaaaaaaaaaagctttaagtcaatgtacctagtatagagacagacatttaacattgggaattagcactaccattttgcattgaaataatgagtaattccgggtgaaatgtacataaatgttgacattatgtatgagatgctaaaactgtaaaattgtagaggactgtgtttcattgcttaacttagcaatcgcttcagaataattcactaaaaatattttcagtgcctagcaatgtttcttggataaattattaatgtatcaatgccagtaattttttaaacttacaaagaaacaattgcattttaaagtcctgggaggcagaattttaaggcatcttgtaaaattccaacaatattttttccacttgaaagaactgattaagctgctagtctttgaatggcaggattttcagaaactatttagaaaatggccaaacctattcagctctgtgcttgtgaattccatgcggcctccgcgacgtcattttgctggacaccccgtggatgtcagtcttctaaaaggtgtcattgcacacacacagttcctctgaagatgatcacactaaaccatatacactgagcatccggttaaagacggcacttccaacaggcagccacctctgatctctcctgagtcctcactaacaacagggggtagatttattgttttcagtacatgaatctaccagggcaagggtcattgggagaaacaggagcaaagagaagcgggaggtggagggatgagggtagctgtccctgcagacagaggcgctggctgaccctctgcaggagaagctgagaacaaacccgacgtcgccacacagctgtgaaaggttcaggactgggcagcttcaggtggtcctccagtgggagcagtgggattgggaactgagagacccaggaaagcgtgctgaagaagcagtggaagttccactgtggtgacatggctagccagtgtgctggcatcacactgaaaatcatcagaaatgccggataggactgtactttaattctcgtaaaaatgttgaagaacaaaccaggtgaggtggctcacacctgtaatcccagcactttgggaagccgaggtgggcggatcacttaaggtttgagaccagcctggccaacatagtgaaaccccgtctctactaaaaatacaaaaattagccgggcgtgatggcgcatccctgtaatcccagctacttaggaggctgagacaggagaatcgtttgaacccgggaggcggaggttgcagtgagctgagatcataccactgcactccagcctgggcgacagaatgagactcagtctcaaaaaaaagaaaaaaaaaaacagttgaagaacggacaaaataagaaactttcaggttaaaacctaagtaaaaatatagattaaataagcaagctaaagggaagtatattatcgagttgcattaaaaactaagaacaggccgggctcggtggctcacgcctgtaatcccagcattttgggaggcagaggtgggtggatcacgaggtcaggagatcgagaccatcctggctaacacggtgaaaccccgtctctactaaaaatacaaaatttagccgggtgtggtggcgggcacctgtagtcccagctactcaggaggctgaggcaggagaatggcatgaacccgggaggcggaacttgcagtgagccgagattgcaccactgcactccagcctgggcgacagagcgagactccgtctcaaacaaacaaacaaaatgaaaacaacaacaacaacaaacccaagaacaaccaaaaaaaatcaaactaactttttttgtttttgtttttgttttttgaggcagagtctcactctgtcgcccacgctggagtgcagaggtacgatctcggctcactgcaacctctgcctcccggagtcaagcaattcttgtaccccagcctcctgggcagctgggattacaggcacaggccaccacgcctggctaatttttgtatttttaatagagacggagtttcatcatgttggccaggctggtttcaaactcaagacctcgggtaatccgcccgcctcagccttccgaagtgctgggattacaggtgtgaaccactgtgcctgcccaaactctctacagtttaagagagagacgtctaaaacacaagcttaagaagcattgcgtcagaaagaaaggcaggaagcataaacaggaagttagtggagttgtctagaaacagacaaaaaacttaggcaaaaagcaggaacggcagtggggacacattctaaccgcatgttcaattcaccaggaagactcagcagcttcaattctgcacttcacgttgattgatcagattattcactatgggagctactttaaacatacgaaaaaatagagaaaaaatcagattaagtgtgtgtaatctcatgtgggcttctaagtggactggcagtaacagaaagaaggtctcctgaaatactggccgggtgcgggcgctcatgtctgtgatctcagcacttttggaggccgaggcgggtggatcacttgaggtccggagtttgagaccagcctgaccaacatggtgaaaccccgtctctactaaaaatacaaaaattagctgggtgtggtggcaggcacctgtcatcccagctactcaggaggctgaggcaggagaatcgcttaaactcaggaggtggaggttgcagtgagccaagatcatgccactgcactccagcctgggtgacagagcaagactctgtctcaaaaaaaaaaaaaaagaaaaaaaaaaagaagaagaagaaatgaacatctgtaatgtgatagagtatatatataccaaaaattaccacagcaaacgtcacacttaaacattaaaaacattcccttaagaccgagaacaaaacagggacgctctctaaaaccacttctcagtattcatcacgtccccagccagaacaatcagatgtaaaagaaataaaaggcggccgggcgcggtggcgcacgcctgtaatcccagcactttgggaggctaaggttggtggatcacctgaggtcaggagttcgagaccagcctgaccaatgtggggaaaccccgcctctaccaaaaatacaaaattagccaggcgtggtggcgcacgcctgtaatcccagctacttgggaggctgaggcaggagaaacgtttgaacccaggaggcggaggttgcagtgagctgagattgagccactgcactccagcctgggcgacaagagcgaaactccgtctcaaaaaaaaaaaaaaggaaataaaaggcataaggaatggaagggaaaaatggtcattatttcagataaaatgactctacatagaaaatccaaacaaatatacagataagttatttaattaaaacaacttagtaatgttgcttggtacaacttcaataatgaaaagcaagtatatttctatttatcagaagaaataatgagaaaatgagatttagaaaagctaccgtttataatcacatcaaaaaccatgaagtactcaagaagaaatacaacaaaagacacacagacctctacagagaatgcgaggaaccccctcgggcagcatgaaaggagacagacataaaaataaatggaacaaacgacccatttcttcaacaaataaatggcctggaggaaaataaggaaggggaggtctttaagtgaaaagagcctcaagagacaagtcggccacatgcaacctggggatcttgttcaaatctcgattcaagcaaaccagctgtaaaagacatttttgagacaattcctgaaagtgagcacaaactggcattagtttccattaagaaattatcaatgtgggccgggcgtggtggctcatgcctataatcccagcactttgggaggctgaggcgggtggatcacctgaggtcaggagttcgagacctgcctggccaatatggtaaaacctcatctctactaaaaatacaaaaattagccgagtgtggtggcgggcacctgtaatcccagctacttcggaggctgaggcagaagaatcacttgaatctgggaggcagaggttgcagtgagccaagatcgtgccattgcactccagcctgggtgacagagcgagacttcatctcaaaaaaaacaagaaattattaattgtattggggttgatgatgattttgtggttatgctaaaaatgagtttctatctgtcagaggcatctgcaaaggtttttacaggtgaaatgatatatcgcctgggattttctttgaaacatgctagtccagatctacacgtagggaggggtaatgggagaggaatgctgtgaggctgatagttgctgaggcagggacgggcacctggggcttcgtattatcattctctttacttttttgactttgcaattttccataataaaagttttttctaaaagaaagtctaaataaatagcctgggcgcggtggctcacgcctgtaatcccagcactttgggaggccgaggtgggcagatcgtgaggtcaggagatcaagaccatcctggctaacagggtgaaacctcatctctactaaaaatacaaaaaaaaattagccgggcgtggtggcgggcacctgtagtcccagctactcgggaggctgaggtaggagaatggcgtgaagccaggaggcggagcttgcagtgagctgagatcttgccactgcactctagcctaggcgacagagtgagactccgtctcgaaaaaagtaataataaaataaaattaaaattaaaaaataaaataaataaataaatagctcatgttcaagcactacaaactcaatgttgtcaggaagtcagttccttccagattgctctatagattccctaaaacccctatccaaatcccaacagaaatgtgtgtgtgtgtctacatgcaagagcaagagaatgagaaactcgtctggtgaattttaaaatgtatatggaagaacaatggaacaatagttttgaagggggaaggggtgccccaccagatatcaagattgattctaaagctgtaaaactaagacagtagagtgctttggacaagacaaacagaccaatggaacagatcagagaggccagaaacaggcccccacgtactagcgctatgcaggatagaagcagggttgctgaacagcagccacggaatggacatctttgtcggcacccacccaaagatcagtctcacgtggattaaagactcgtatgggaaaaatcaaaattcagctacagtgtgtgttagcggggagtcgatggggggtgggaatggagccttgttacttcagaatttctcaaataaaacgctaaagacattaggcacaaagggaaaattgggtagagtcgcccacatttcaattaaaaattttcattcaggccaggtgcagtggctcacacctgtaatcccagcactttgggaggccgaggcaggtgggtcacttgaggtcaggagttcgagaccagcctggccaacatggtgaaaccccgtctctacaaaaaatacaaaaattagccaggcgcggtggcgtgcggctgtaaccccagctactcgggaggctgaggcaagagactcctttgaacctgggaggaggaggttgcagtgagccaagattgtgccactgcactacagcttaggcgacagagcaagactctgtctcaaacaaataaacaaaaccaaatcttttgttcagatgacatcctagggaaagttaaagaaaacctacaggccgggcgcggtggctcacgcctgtaatcccagcactttgggaggctgaggcgggcggatcatgaggtcaggagatcaagaccatcctggctaacacggtgaaaccccgtctctactaaaaatacaaaaaattagccaggtgtggtgcaggcgcctggagtcccagctcctcaggaggttgaagcaggagagttgcttgaactggtgaggtggaggttgcagtgagctgagatcgtgccactgcactccagcctgggcgacagagcgagactccatctcaaaaaaaagaaaaaagaaaacctacaaagtagaagacaatcacagcacataacccagaattttactgtcaagaccatgtaaggaatatccatgaatggataaagacagacagccccacagcaaaatgggcaaaagacgtcaacaggcacttcacagttaaggacgtgccacgtcccctaacacgcgcatgggttcggaggaccaggacatgggttttttggggaagggggagatcatcctgcctatggcaccctctggctctgcgattcctctcccaggagcacaccctacagaaaatcccacctgttgtgttagcttcccggggtcgccataacaaagtaccacaacctaggtggcttcaacaacagagttgtctcacggttctggaagccatcgtctaaaaccgagttgatggcagggccatgcttcctctgaaggcacgagggaagggcctgtttcaggcctctcttttagcttctgctagttctgtggcttgtggcagcaaaattccaatcttcataggacattctctctgtgtgcatttgtatgtccaaatttctcctttttataaggacaccggtcataccagatgaggcactcaccctattctagtatgtcctcctcttagctacttacaggcatcactgtaagtccaaataaggtcatattctcaggtcctgaggcttagagacagccccgatggccacggtgccactgtgtggatgaatctctcgcacaaccccgaggagaaaaagacagaggcccgcctgatgctcttcctctcccccttcccttcactgtcacagtaggttccctgggtagggcaggtggagcaggatccacagtggcccaggctgggctgtcggagcctggctgggtgaggagggtgagggtatgtggctgaggctcagagctgtttgcaggtgcctggctgggtgaggagggtgccggtgtgcgtggctgaggctcagagctggatgtcagagcctgagaagaaagagggcggccccaggtgtggtccagcagagggtatcagagcccaggcaggagaagaaggtgtccaccatgagagcctcccaggccaagcctgggagtgatgacatatttgcatagcttccaaatacctcctacaaaatgcttgtgtttttgttttgttttgtttttcattttgtttttttttttttgagacggagtctcgctctgtcgcccaggctggagtgcagtggcgcagggtcggctcactgcaaactccgcctcctgggttcacgccattctcctgcctcagcctcccgagtagctgggactacaggcaaccgccaccacacctggctaatttttgtatttttagtagagacggtttcaccgtgttagccaggatggtctcgatctactgacctcgtgatccgccctcctcagcctcccaaagtgctgggattacaggcgtgagccactgcacccggccaaaatgcttgttaattacgaaggaaaaaagaacttcccagtggagatgttggcagataccaccttaatcaagagctcaaagtgaacatcatcagtaacgtgacaacgtgaccactgtgagccactgactggatggaatgaacaggccacggtgtcacctctgcgactttcctgtccgagacgtgcagtgggaatctaatcacgaggacacagcagacgaaaccaaatggagggactttctccaaagtaattggcccatgaccttcagaggtgtcagggtcatgacagccaaagcaaggccaaggaatgttctggactgaaggggaataaagaggtatgtgagaattcagtgcaaagtgactctaggctggatccttccacgctggggccctgatgcaatcaactggcaaagcgtgtttgacaggctgaggggtaaacacggcaacaggcctgtgtcctctcctgactcgggccatgtgtggctgtgttggagaatgtcctcgtttgtggaaaatacactctacaagggtggggggcgacagagcatcatgaaggcaacttactctcaaatccttcacgagaagtttttttgtgctgagcttgcaacttttatacaagtttgggattgtttcaaaaaatgttaaagaatgtatgtggtattacataaagtttatatatattattaaacttatataaaccttatataataccacacatattctttaaaattttatataaataaatttatataaaatttaaaataaatgaaagttggctgggtgtggtggctcaccgcctgtaattccagcactttgggaggcggaggtgggtggatcatttgagatcaggagttcaagaccatcctggccaacacgcggaaaccccgtctatactaaaaatacaaaaattagccaggcatgctataatcccagctacttgggaggctgaggcaggagaatcgcttgaacccaggaggtggaggttgcagtgagccgagatcgccctgctgcattccaacctgggcaacacagtgagactctgtctcaaaaaaacaaaaatttaaagaatatatgtagtattatatgaagtttaatatatattattaaacttacataaaactatatgtggcattatatatagtctatatatttatattatatattgtttatataacaccacatatattctttaaaattttatataaagtttatataaagtttaaaataagtgaaagttaactatattgtttagggacacatgcataggtagtaaaactaaagaaatttatatatcatctttaaaattttatataaatataaagtttatataaagtttaaaataagtgaaagttaactatattgtttagggacgcatgcataggtagtaaaactaaagaaaaagtcagccatggtcaagaagagcgggtctgtgagtggcatgggggagagactttggggtgctgatgaggttctatttcttaacttgggtagtggctactgatgttcgatttataaccaatctctaagtcgcacatgcgcatttatgcaccatcgttatgcagagaatatcagtccatttcttttcaactgtgggccctacagcaggcctgcttactacctcagtacctggcttatgcagataaaaggagtattcctttaagaaaaacaaaatactagaggcaaatcagcttccaaaactaggttatacatactaaaactaaatgactttggggctatggaccatgctctcctttttagctaggcagacactcacgagtcttaactgttcaccagacaggctggcccttgatttttgtttaatgtttttgtaaatgtgttataataatactttattataacatctgctgcaaagtcaggggcgggtccctcaacagaggctgtgccagcgccggggttccctgaaacgaaccagggactagaactattaacaaagtcatttttctggcacagctttccgggaaaggcgtttcatatgggacggagttctgcctggggggcgggggtcaaacccttccagctcagccccagggtcaaacgcatccgcccccacacccacctctggctggcctgggtcccaggttctcgggctccggaggcacagacaccccgggctgctcaggcaggcggcggtccttggcgattgccctccgcggcgccggcggcgtggtttggggcgggcagctccatggcaac

SEQ ID NO: 2291 - DNA, 1713 bp, Homo sapiens
gaccacttaaatacaaactttattctctctccaagaagatgcagacgtcacaggtggccctgagctcccacccgaggcttaggcccaaggggcctcttccaggctgagggcctgctggggctgggccaggggctgaggctgaaagcagcagcctgcctagtgggtgacgccaggggccggtgtaacatggcaccgaggttggggccacagcaatgtgtgggacggtggggtgggctggggcccttggctccaagcattagttctccaagctctggtccgttctcctacctccttcaaggggcaccagggctacaaggtggtagttgagtattggggcccgactcctggggcactggagtggtctctaggcccgaggccccaaggagagggctgggtttctgggagagtgctggtccttcctctctgggcttggccatcttgacagcttcatcgtaggagggtggaggctccggggtgtacaggctgtaggcaggaggagccatggagtccaggtccagctccccaaagggcaggggcaaccgcatgcccagtgggtactgcacggagctgtaggctgcagggaaccagagtgggttcgtggaggcgggcttggcatttacccccgccatctccaccctcaactggcgggcccctaggcactcacaggtcacagtgctgtgtacagggctgtcactgtccatagggatgactgccacgtcgcagggctgccgtgctggtggcagatgtggctgggcctgtgcctgcttccggaggcagcagaaccggacacaaccagctgtgacaccacacagcagaagcaggaggaccgccagcaggatgagcctaggagagcaaggctctaccactggactgaccctcggccaccgggcacctgcaccctggggaatgtcgtggcacaaccaccgaagacaggttaacaggataaaaagcagacaatgtctctccatgtcggagaccgccgtggccagagcctggcctcgggctgctgggcctgccctggctatctctcctgggctggccaggggtggccttgggctcactcccaggactcgctgtcctcagcgagtgccccactgctgagcgggatcgtaggggactcccgcggaggccaggcgggagaggtgggagggaaggtcctgcttgctccaggtcagttcccgccagcggccgggactgggcgacagcggaggcggcctggtgaggtaagggcctggcgggcctggccccggtgacccccgccccagaaccgtcggacgcacggctccgccgcggcctccacttaccccacgtgccacaggctgctccagcgggcctggggcgggcacctgtggggacggcggcacctggagcaggcggggcatgggacggccgacctcgccacccgtgcctccccatagggcggggccaggccccggctccctcccccccgacttactggtccgaggggtcgcagctgccgtccgcgaagcccagcgccacctgtggggacaagggtgagcccgggaggggcgtggtccgagcagggacccgccccgcggtggccgaaccgagagagaacgccgcccgacccacctgcggcagcggcaggagcggcaggagcggcaggagcggcagcagcagccgcagtccgcgggcggccagcggcccccgggccatgctctgaggaggttggagcaaagcccggcggcgcgg

SEQ ID NO: 2292 - DNA, 2469 bp, Homo sapiens
gggtaattagacccagacagggagggctcagtgcgggtctgaggagggaacacacgtgtgcaggcgtgtgctccacggtggcatgttgatacggaccagcctgggcaccaggccccctcgggagccagctttgctgttctgagtggaagggagatcaggtttccctgagaaaccccaaaatagcccccaactgtgcctggcttccagcgggcagcccagcccccaggccctgttttgctccctttcccccttcacccccagcccatgtcctgctgtctcctccctgaatggtggaccctcagcccctcctgtacaagatggtcaagcggtgcctcatgcatttgttcattcgacctgtcctgagagtttgtgacatgctggcacggggccaatgttgagtccaccaggatgggagggtggccaggctctgagccactgagcaccagctggccaggatgggtcttcaacaagaaatctcactggtaagtgatgacagcatgggaccagggtcccatgaagacctgctggagggccgcacctctgggaaggtagacttggagcttggtccagtgaagagggaacagcacggggaacagcgtgtgtgagggtcccgccatgtctcagccctttcctggcccccgcacttagccttcggtgcccatcttcagggtcaggggaagcccaggccaaagcgggccgggaaggggccctgtggataaggccgagagcctgtcccaaaatagggccggcaggatttcccacccataaaaggctcttggaatctggaccccggggaccccaggcagccaggcccagctaaaactcagctgccaccactgccccagcactctgcccacagcagccctggtgtcaccaccctgcagaatcctgtcagacaaccaccgacatggtaaggctgctctctgtgcccgatggagtctctggtgggctggctgggtaggttgagctggaacctggaggtgcaatgacctgccacggagcctgggcaggaaggggctgaggtagaagagggggccaagccctgctgccaccaacacagcccttgttccggggccagggtggagcagccctttctgaaagctggctcccagatgggcagcagcagtggtggcaggcaggtgtggcccggtgctggactctccctccggaatgccacacaggctggagcccagggttctgcttcctgggctgtatcccaatcctgggctggaagcctttcccgggccagggctgggctcctccccaccctgctctcggcttccttcacctgcctcacctggtgtccattgccaggctccagggccgctgcctggcccgcctggccctgcagctgctgctgttccctcgcacgctggctcctgcctgtctggcccttgcccctgttagctgcctggcagagccctgctggccctgcaaacccctggcgtgtgaccccttgtcctggaagcctgctctccgctgggggcctcctctcttaccactcaccttgaaaggctgccaatggaggaatgggtgcagggggtacctctgacccttccctggacacaggggcagaaggggctcctggtcaggccggtgcgggtgtcccctgcagacagagcgcctgtcggctgagcagatcaaggagtacaagggagtctttgagatgttcgacgaagagggcaacggggaggtgaagacgggggagctggagtggctcatgagcctgctgggtatcaaccccaccaagagtgagctggcctcaatggccaaggatgtggacagagacagtgagctcatggctggagtggggtgggcagcctcgggggggccctgggtcaggtgtcagtgcctacggggggaagaggcaaagcccatggggagtgctgtgccccatcccttgagccccagctgtgccccttgcagacaaagggttcttcaactgcgatggtttcctggcactaatgggagtttaccatgagaaggcccagaaccaggagagcgagctgagggcggcattccgtgtctttgacaaagagggcaagggctacattgactggaacacactcaagtagggcccgggttgggggcgggtggtgggcgggcacgggcagggccgatggagtggctcagcgccaggccccgtaggtacgtgctaatgaacgcaggggagcccctcaacgaggtggaggcggagcagatgatgaaggaggccgacaaggatggggacaggaccatcgactatgagggtgagtggcctggagccctgggagccgttggctgggccggggcaagctgctgacctgcccctctgttcccagagtttgtggccatgatgacgggggagtccttcaagctgatccagtaggtgcagctgccgcagccgggggaggcctgcccgggaaggctgctgcccctgccccctggcccccactcccccggctccgtgtaaaataaatgttccagccc

SEQ ID NO: 2293 - DNA, 5390 bp, Homo sapiens
tttttctggatagctttattgaagtgtcatgtacaaagcatacatttcatgcacttaaaatgattaaaaatcaatgatgtttagtatattcgcagagttacaaccatcaccactactgaaatttagaaagttttcatcacgacacaaagaaacgttctatcaattagtggtcatctcctatttcaacctccctgagacattggcaaccactattctactttctgtctccatgggtttgactgttcttggtacttcctataagctgactcacataacatgcaacttttagaaaggctgaaaaccacaaataccatgttgagcaaaatgagcccgacacaaatgctaggatgtctgtactttagtaattgtgtgcatcctatttcaataattgatttagaatttttgtatcagagcaaataacataattcattttcagatttatgcaatcataatatttctattttaagaaatataaaatgtatctgatgcactgcaaacgcaaatgctttacttctaaagcttatgcttacaatgatatatcattgaagatccacactgggctgatttaagtcgatttacttgtagcactgcacagttaagttcagcattatctgagtcttttatcctgtaatggagaaaaatccattttctgttacattttaagcaaatgattcatgagacgaaagcattttccatgtactgtaagaaaagaatttcatggaaaagggtaattaaatttttcataatattagtaagagtcattattctgaacactcaacagagtagtccctcttcatccacgagggatatgtttcaagaccccagtggatgcctgaaatggcagatagtgcagaacctatagagagattatgttttctctacacattcataactgtgataaagtttaatttataaattaggcacaataagagattgacaacaataactaataataaaaaaattatagcaatatgccaacagcactattattgtgctttgaggatattcttaagtaaaaaagtaagcgtggctttttaataaaaacaagcactgcagttccctgatagtccagctcgaggttgtccaactcgctgcccatgggccgcacgtgacccaggacagctttgaatgcggcccaacacaaatacgtaaactttcttaaaacattctgtgattttttttttttttttagctcgtcagctatcgttagtgttagtgtattctatgtgtggcccaagactattcgtcttctaacgtggcccacagaagccaaagatgggacacccctggtccatctgataaccaagaaggttactagcagaccaatgagcggttgaaatatatggactactatggtctattgtaaaatatttatatcaacatttcactaactttccacatctttcttcatgtcaatgattccacataaatttattcatattattcttctgaatttatcctttatatatattttttatatagcgccatacaaaagaacttacttatgtttgaaagccaaaccatttattgtcacccatggatgatgactgctgttacgaaacacaccaatccatgaggaaggtaaaatgctggccagaaatttctaaaagaaaagaaataattttcacttaaataataattatgaaaacattacaaaaacaatatattaaagttgaaaaccactatttgcagtgccaaaaactttcataaatgtttgaattttttatttaaatgaactcttcaacgtttatacttagtactttcattcttattctcatgttaataaagacattttaattcttgcaatgtaatagttactccaattaacagaataaacgcaggaagggttttaataagtttcctgatactgtgcattcattcctccagatactgtgactaaatcaatctatttttgtgctatatttctcagagttggagatttagaagggaattgaggggttgtcattcagaaatagatgacatggaagctacagattgggttttctgggtaccacaccattctttaactagataagccctcaatttttatccgattcggtttttgcggaataacaggggtcctggccaggtggtgtagactcgtctctctctgctactcccgactaaaaacaactataaactctgggattaatgaaagacaaaagcaatggagaactctgaaaggtggaaagagaaagatgaaattgtctgggaccctagcatcagggatcaaccaagtgtccgagtgagcatgttaagtcctccacacgacagaagaaggtgacctaggcctgctgtttccctacacccaacctggcaataggaggagggtatcgaaggagagtcccctccacaataccaggcaaggctggtgccactggcaaggatgatctaccaggagacctgctaccaatatggagctagagaaagtgcttccttctcataccaagagacaccaggatggctgtggatgaggaggatcagcaaagggaccccatgactaacagtgcaccgtaaaccacctagggtcctctttgtccctgagggcatgagacccacttccccatccagagacaaggactcaatggattcttactgttctttgtacatagtacagcagtgaacagtaacatactactgataactgcaataatatggaggaattgcacaaatatcagataggattgaaaaagacatgaaattcacactgcttgattccctttatataaataaattcaagaacaggcaatcattatttataatattaaaagtcaagactgcgttttggagaggagtcaggataagtgatgagggcatacacaggggtggaactgctagagctggaaacttttatttcatgatctgacttgtatcacatgcattcattcactttgtgatcaatctgcatgaccagatgatatcatgcccgataaaattagatagcaaaatttattgtggattcaaagcacttatagaagcatggttttccttgaaaaacaaaaactgaaaataaatgtacattagcagtatataactttaaaaacattattaagtcaatcaattgaatattacatacacttgaaaatatatgagataaatatatgtacacacatatggatgttttctacaaatgtattattcactgaaggaagcttttcataaaatgtttgaaacatttacatcttaccatttcttcttcattatctatagaaagcagactggagttcttcgaagtacaggccagcaaactctcttcccaagttcttctttccttaccaatgtaataacaactgttggaatatgtaatccactcctcaggacaatggccacaatgacgtgctaataaagatatgaattactatctagaccaatatgaatttttaaaaatgaaaattagttcacatatttcaacagtataaacatatatgtgcttaacatatttacgcatccttacaggcttataaatgtatatttttaataactgagtcagtcatacacacatgcacagacaagggttagcctctcctccctaattgtgttcccatataaagcaaatgaacaaacaaaaatacactctacacatgtgttgaacatcgctgatacacaactgcttttttagaatagtaaaattatttatttggtatcatctcacagcagtaggaaacctctgttaattgggagaaagagggtagaatgattttaagtgagtatttctactcactggagaaaaggaaatgctgcctcataatctttctttataaatatttatggctgaatttatggcttattttctgcaaaaatgccactattcttttacatgccttaaaacagacacaaaatataaattgtactaatatcagaacattgaaaataaaaatgtacctttctgcgttcttgtattcggggaaaaattgttctgctccaggactgtaatagaaaaattaaaatgatttttataaaaactgatatctagataaaccataacgagtttagtttcttactttgaaactttgtgtgttatttaaaatggggagaatctttaataaaattaactttttctataaaaatatataaagtaatagacctttgaaataaacatttttaaagactttagcacaaacttcaccatctcttgtagtatttgatgtaaccactttcaaaaattaatttgtttttctaaatacttttcttctatagcatgcctttgaattatgaaatcagaaaatatctttgtgtgtgtatgtatatacatatatatagattacacacaaaaaataaacacatgttctctacaatgattttgttatttatgttgtgaaaaattcagaataaccatattacttttggttccaaattgtactaatatcagaactttgaaaataaaaatgtacttttctgggttcttgtatttggggaagaattgttctgctccaggactgtaacagaaaaattaaaatgatttttataaaaagtaatatttagataaaccataatgagtttagtttcttactttgaaactttgtgtgttatttaaaatggggacaatctttaataaaattaactttttctataaaaataaatgaagtaatagatctttgaaagaaacagtaaaataagagttctattcttcaacagtatgaaatattttgaggcacttccaagcattaaagtaaaacgttcccttctaatctttcaagaatatgcttacaaggaataagaactattgtttttaacacagtggccatcaggacaatgcaaatgattcctaggacctcggcagtgagcttctctggaggtggcagtaaacctgcagggagagaaatagaggcactgagagaggggagatagagagttgattaggattacatactagagaattacatactagagaacccacatgcacagggaaacataatgataaactctggcctctaaatctacatctactctagtaatctttctctcagaatataccatttcattttcagtaaatataatgttccatgagtggaccgcagattacagttgaacaatgcccgaataaaattagtcttctgatttcatattagaattttagatcccaattatgaactccgattctcacaagtgcaaaatattccctaatctttcctcacccttctgcattcaactgcacatcctagaacaataatattgaagatatatttaatgttttaccttggcagtcatatattttatcaatcccttgatgattcagggaaggattttgaagatttaattctacttggaatatttcctgttcggttcctgaaatggagcttttattgcctttaggtttcctttgctgccgctttgggtcctgggccagactcacttctgagaaggttcctctttgtttattcatctctgca

SEQ ID NO: 2294 - DNA, 7344 bp, Homo sapiens
ttttctggatagctttattgaagtgtcgtgtacaaagcatacatttcatgcacttaaaatgattaaaaatcaatgatgtttagtatattcgcagagttacaaccatcaccactactgaaatttagaaagttttcatcacgacacaaagtaacgttctatcagttagaggtcatctcctatttcaacctccctcagacattggcaaccactattctactttctgtctccatgggtttgactgttcttggtacttcctataagctgactcacataacatgcaacttttagaaaggctgaaaaccacaaataccatgttgagcaaaatgagcccgacacaaatgctaggatgtctgtactttagtaattgtgtgtatcctgtttcaataattgatttagaattttcttattagagcaaataacataattcattttaagatttatgcaatcataatatatttctattttaagaaatatacaatttatctgatgcactgcaaatgcaaacgctttacctctaaagcttatgcttacaatgatatattattgaagatccacactgggctgatttaagtcgatttacttgtagcactgcacagttaagttcagcattatctgagtcttttatcctgtaatggagaaaaatccatattctgttacattttaagcaaatgattcatgagacgaaagcattttccatgtactgtaagaaaataatttcatggaaaagggtaattaaatttttcataatattagtaagagtcattattctgaacactcaacagagtagtcccccttcatccacgagggatatgtttcaagattccagtggatgcctgaaacggcagatagtgcagaacctatagagagattatgttttctctacacattcataactgtgataaaatttaatttataaattaggcacaataagagattgacaacaataactactaataacaaaattatagcaatatgccaacagcactactcttgtgctttgaggatattcttaagaaaaaaagtaagtgtggctttttaataaaaacaagcactgcaattccctgatagtccagctcgagcttgtccaactcgctgcccacgggccgcatgtgacccaggacagcttcaaatgcggcccaatacatatacgtaaactttcttaaaacattctgtgattttttttttcttttttttgctcgtcagctatcgttagtgttagtgtattttatgtgtggcccaagactcttcttcttccaatgtggcccacagaagccaaagattggacacctgataatcaagaaggttactagctgaccaatgagcggttgaaatatatggactactatggtctattgtaaaatatttatgtcagcatttcactaactttccacatctttcttcatctctatgattccacatagatttattcatattattcttctgaatttatcctttatatatatattgttatatagcgccatacaaaacaacttactcatgtttgaaagccaaaccattcattgtcacccatggatgatgactgctgttacgaaacacaccaatccatgaggatggtgaaatgatggacagaaatttctaaaagaaaagaaagaattttcacttaaataataattatgaaaacattacaaaaacaatatattaaatttgaaaaccactatttgcagtgccaaaaactttcataaatgtttataattttgatataaatgaacccgtcaatgtttatacttagtacttttattcttctcatgttaataaagaagttttaattcttgcattataatagttaccccaattgactgaataaacacagtaaggatttaaataagtctcctgatactgtgcattcattcctccagatactgtgactaaatcaaactatttttgtgctatatttctcagagttggagatttagaagagaaattagaggttgtgattcagaaataaatgacatggaagctacatattgggttttctgggtaccacaccattctttaactagataagccctcacttttttatctgatttggttttggtggaataacagtgatcctgaccaggtggtgtagactcgtctctctctgctactccctactaaaaacaactataaactctgggattaatgaaagacaaaagcaatggagaactctgaaaggtggaaagagaaagatgaaattgtctgggaccctagcatcagggatcaaccaagtgtccgagcgagcatgttaagtcctccacacgacagaagaaggtgacctaggcctgctgtttccctacacccaacctggcaataggaggaggcccagcaaagctcactcctgttctgtattgaaggggagtcccctccgcaacaacaggcaaggctggtaccactggcaaggatgatctaccaggagacttgctaccaatacagccagaggaagtacttccttctcataccaagagacaccagagtggatgtgggtgaggaggatcagcaaaggaacccaatgactaccagtgcaccacccagggtcctctttgtccctgagggcatgagactcacttccccatccagagacacaggattgaatggattcttagtgttctttgtacatactacagcagtgaacagtaataaacgacagataaccgcaataatatggaggaattgcataaatatcagataggagtgaaaaacacagacatgaaattcacagtgtatgattccctttatataaattcaaaagcaggtaaacgttatttataacattaaaagtcaagacagtgttttggagaggagtcaggataagtgatgagggcatacacaggggtggaactactagagctggaaacttttatttcatgatctgacttgtatcacaggagttcattcactttgtgatcaatctgcatgaccagatcacatcatgcccgataaaattagatagcaaaatgtattgtggattgaaagcatttctagaagcatggttttccatgaaaagcaaaaactgaaaataatcaaaagtacattagcagtatatgaattttaaaacattattaagtcaatcaattaaatactacataaacttgaaaacatataagctaaatgtatatacccacacatatggatgatttctacaaatatattatcgaccgaaagaagcttttcataaagtgtttaaaacatttacatcttaccatttcttcttcattatctatagaaagcagactggagttcttcgaagtacaggccagcaaactctcttcccaagttcttctttccttaccaatgtagtaacaactgttggaatatgtaatccactcctcaggacaatggccacaatgacgtgctaaataaagatatgaattactatctagaccaatatgaatttttaaaaatgaaaattagttcacatatttgcaaacatataaacctatacgtatgcaacatatctatacatcttcatgggctggtaaatatatagtgtcaaaatacccagtcacttatacacacatgcgcaataaagggtcagcctttcatctcctaattgtgttcccatataaagcaaaccagcaaacaaaaatccactctatacatgtcttgaaaaatcaatgaactaatctgatttttaaggaacaataaataacttgtatcttatcatattatagcagtaagaatttgaacacaacagataaaaagaaagcatagtgattttacttatagttgatgacaagtgaatgccttactctaattttatttatgaacacttattgccaaattttataatttttcacccaaaattttatttttgtacagcctaagatcaagaaaaaataaactgtacaatattaaaactttaaaaattattatatacctttctgagttcttgtattcagggaagaattgttgtgcctctgtattaatgtagctagaaaaattaaagtaatctttgtaaaaaaattagcatctaaatcaatcataataattttaagtttttgtttgaatttttttgtattatttagagttagaataatatggaataaaattgattttaagaaaaatttgataaagtaatggtggttttttggaaaagtatttcatagatctaaagaaccaaatttcaccatctcatatagttcttataattcttgatttaactactttcaaaaattaatttctatttctcagtaaggtttttcagactcctagaacatatttttgagttatgaaatccaaatatatacatacgattgcatcagaagcgaatactttcaacaattattctttcatttattctttgacaaattcagaataatcattccacatttagtccaaatatatacattacaatgagaactctattccctgaaaatatgaaatgtttagaggcacattcaatcattaacgtgaaaattccccttgtaatcttcgaaaatagacttacagggaataacaactatcgttaccacagaggccattaagataagacagataattcccaggatcccaacaatgagcttctctggagctgatggtaaatctgcagggagagaaatgggaacagtgcgaaaggagaggtggatacagtcgtttagaagattcacagacaagagaacctgaatgcacaggaatcatacagagaaacttggaccccaaaccctcatctcccattgtaatctttttctcagaataatataccattgaattttcaggaaaaataatgctccatgaattatttgacaaagactacaaacttcaacaatgagttcaatcagtcttcatactttacattgaaatagcatatctcaacttggaattctgatctttgcaaatagaagatatatgagcactcccttctctttccccacattcctgtaccccaagctgcacatcctagactgttatattgaggatcttttaaatgctttacctttgcagtgataggttttgtcattcccttgaaaatcctgagaagctttttgaaggtttaattccgcataggttatttcctgttcagttgctaaaatggagtttttattgcctttaggttttcgttgctgcctctttgggtttgggggcagattcaggtctgagtagattactccttggttatccatctctgcagtgtgtgatgtcagggactgtactctataataacagtagttaagaagttaataaatggtttatatacaggattccctagtgcaattaaaagggtgaggtggagaacgagtattggagctcattttgcattaaataatctaaagttctttctctgattttcttcaagcctaaacacgtttcttatgaatatttgttttaaaaaaagatttttaggccgggcgcggtggctcacgcctgtaatcccagcactttgggaggccgaggcatgccgatcacgaggtcaggagatcgagaccatcctggctaacacggtgaaactccgtctctactaaaaatacaaaaagtagtcgggcatgatgtcaggcgcctgtagtcctagctactcgggaggctgaggcaggagaatctcttgaacatgggcggcagaggttgcagtgagcggagattgtgccactgcactccagcctgggcgacagagtgagactccgactcaaaaaaaaaagataaattttctgcatttgacaaaatattattgctggggcaatgagaagcaataaattactaaggaataaagaagttcaggaataaaaatatatttcttaaagtctgatgttttacctgtgttaaaaattaaaatgttgtattagaaaaacttctgcactcatttttatgttaattttgaaatccagtaatggttaagactatgtggtctgcacatgagtaatagtaaagttgacatatatatatataaaaatttcttgcactacattacttttaattagtaatttatacacattaatgaaaatcaatagaggtaattaaatggtcttttcttaatggctgaaatgttctaagaaattattaaaaattatttattaaaaattataaaaaattaaatatttgtatatgacagaaaatgctatgtgacacagttaacttatgcataacctaaatagtattaggaacactacataaattgttaatacttacagaagtattggtaatttaattagtaattggtaatttatttcctggctaaattatgaaccaaaaaatgataaataaaagtataggtaattcatgttaaagcacatttcatttaaacttatagaatgattttatggttgtcaaagtgagtaaaggccactttagttgtataagtacttgtaaaatttcagataatgtaattaaatcatttagtcaatgggctctggagtcagtgagatctagaattaattctagctttgacacttataatgtgcgacctttaaaaagttattctatttttaataacccagtttgttaatctaaaatgggcataagaacatataaaacgttgcatgtaaaacatttaccactcaacctggcacttaaagttctcaataagcattagctactttaattattattttagtcacaattgttatgttactgtttctgattcatgtcagttaaagcatggaaaataaatcttcagataagtctcctatgtccatgcgctacatctttttttgcaatattttgatcaatttttaaaaagtatttttattgctttgtaatacctttagcattttatgtaatctacctcattctgatttttattaaaaataaaaactgcttttctctaatctacgtgtctgaggaattgtatttggctttcatcaattgattgatttattttaataatctttaatggctaagctaaatataaattattattcaaagatacatgatgtactgattacaaaatacaaaattaattgttcattattgtgatgttaatagctttcccttaaacgatattgatcaacaaacccactagatttccacaaacaataatttgaaaactttaagaaatccttcaacatatttcatattttaggtttttaccctgagttattcaaatgaagacagcaatattctactttgattttattgtatattaattatacctcctttgtatcatattgagcacttgaaatcacccactaaatgaggtaggctagtagagagttggagagtagcaatacataccttctgtccccagaaagtcacacatcctttagtggagaggccaggttagtctcataaaaaggcctgctatagctgtgtaataaaaggtgaaatttaaaggcataaatccaagacaagaacaaacaatgcctgcaatcttcgcagactgccctgtgaaggctcagagtgagtcaagagtggaaa

SEQ ID NO: 2295 - DNA, 8580 bp, Homo sapiens
ttttctggatagctttattgaagtgtcgtgtacaaagcatacatttcatgcacttaaaatgattaaaaatcaatgatgtttagtatattcgcagagttacaaccatcaccactactgaaatttagaaagttttcatcacgacacaaagtaacgttctatcagttagaggtcatctcctatttcaacctccctcagacattggcaaccactattctactttctgtctccatgggtttgactgttcttggtacttcctataagctgactcacataacatgcaacttttagaaaggctgaaaaccacaaataccatgttgagcaaaatgagcccgacacaaatgctaggatgtctgtactttagtaattgtgtgtatcctgtttcaataattgatttagaattttcttattagagcaaataacataattcattttaagatttatgcaatcataatatatttctattttaagaaatatacaatttatctgatgcactgcaaatgcaaacgctttacctctaaagcttatgcttacaatgatatattattgaagatccacactgggctgatttaagtcgatttacttgtagcactgcacagttaagttcagcattatctgagtcttttatcctgtaatggagaaaaatccatattctgttacattttaagcaaatgattcatgagacgaaagcattttccatgtactgtaagaaaataatttcatggaaaagggtaattaaatttttcataatattagtaagagtcattattctgaacactcaacagagtagtcccccttcatccacgagggatatgtttcaagattccagtggatgcctgaaacggcagatagtgcagaacctatagagagattatgttttctctacacattcataactgtgataaaatttaatttataaattaggcacaataagagattgacaacaataactactaataacaaaattatagcaatatgccaacagcactactcttgtgctttgaggatattcttaagaaaaaaagtaagtgtggctttttaataaaaacaagcactgcaattccctgatagtccagctcgagcttgtccaactcgctgcccacgggccgcatgtgacccaggacagcttcaaatgcggcccaatacatatacgtaaactttcttaaaacattctgtgattttttttttcttttttttgctcgtcagctatcgttagtgttagtgtattttatgtgtggcccaagactcttcttcttccaatgtggcccacagaagccaaagattggacacctgataatcaagaaggttactagctgaccaatgagcggttgaaatatatggactactatggtctattgtaaaatatttatgtcagcatttcactaactttccacatctttcttcatctctatgattccacatagatttattcatattattcttctgaatttatcctttatatatatattgttatatagcgccatacaaaacaacttactcatgtttgaaagccaaaccattcattgtcacccatggatgatgactgctgttacgaaacacaccaatccatgaggatggtgaaatgatggacagaaatttctaaaagaaaagaaagaattttcacttaaataataattatgaaaacattacaaaaacaatatattaaatttgaaaaccactatttgcagtgccaaaaactttcataaatgtttataattttgatataaatgaacccgtcaatgtttatacttagtacttttattcttctcatgttaataaagaagttttaattcttgcattataatagttaccccaattgactgaataaacacagtaaggatttaaataagtctcctgatactgtgcattcattcctccagatactgtgactaaatcaaactatttttgtgctatatttctcagagttggagatttagaagagaaattagaggttgtgattcagaaataaatgacatggaagctacatattgggttttctgggtaccacaccattctttaactagataagccctcacttttttatctgatttggttttggtggaataacagtgatcctgaccaggtggtgtagactcgtctctctctgctactccctactaaaaacaactataaactctgggattaatgaaagacaaaagcaatggagaactctgaaaggtggaaagagaaagatgaaattgtctgggaccctagcatcagggatcaaccaagtgtccgagcgagcatgttaagtcctccacacgacagaagaaggtgacctaggcctgctgtttccctacacccaacctggcaataggaggaggcccagcaaagctcactcctgttctgtattgaaggggagtcccctccgcaacaacaggcaaggctggtaccactggcaaggatgatctaccaggagacttgctaccaatacagccagaggaagtacttccttctcataccaagagacaccagagtggatgtgggtgaggaggatcagcaaaggaacccaatgactaccagtgcaccacccagggtcctctttgtccctgagggcatgagactcacttccccatccagagacacaggattgaatggattcttagtgttctttgtacatactacagcagtgaacagtaataaacgacagataaccgcaataatatggaggaattgcataaatatcagataggagtgaaaaacacagacatgaaattcacagtgtatgattccctttatataaattcaaaagcaggtaaacgttatttataacattaaaagtcaagacagtgttttggagaggagtcaggataagtgatgagggcatacacaggggtggaactactagagctggaaacttttatttcatgatctgacttgtatcacaggagttcattcactttgtgatcaatctgcatgaccagatcacatcatgcccgataaaattagatagcaaaatgtattgtggattgaaagcatttctagaagcatggttttccatgaaaagcaaaaactgaaaataatcaaaagtacattagcagtatatgaattttaaaacattattaagtcaatcaattaaatactacataaacttgaaaacatataagctaaatgtatatacccacacatatggatgatttctacaaatatattatcgaccgaaagaagcttttcataaagtgtttaaaacatttacatcttaccatttcttcttcattatctatagaaagcagactggagttcttcgaagtacaggccagcaaactctcttcccaagttcttctttccttaccaatgtagtaacaactgttggaatatgtaatccactcctcaggacaatggccacaatgacgtgctaaataaagatatgaattactatctagaccaatatgaatttttaaaaatgaaaattagttcacatatttgcaaacatataaacctatacgtatgcaacatatctatacatcttcatgggctggtaaatatatagtgtcaaaatacccagtcacttatacacacatgcgcaataaagggtcagcctttcatctcctaattgtgttcccatataaagcaaaccagcaaacaaaaatccactctatacatgtcttgaaaaatcaatgaactaatctgatttttaaggaacaataaataacttgtatcttatcatattatagcagtaagaatttgaacacaacagataaaaagaaagcatagtgattttacttatagttgatgacaagtgaatgccttactctaattttatttatgaacacttattgccaaattttataatttttcacccaaaattttatttttgtacagcctaagatcaagaaaaaataaactgtacaatattaaaactttaaaaattattatatacctttctgagttcttgtattcagggaagaattgttgtgcctctgtattaatgtagctagaaaaattaaagtaatctttgtaaaaaaattagcatctaaatcaatcataataattttaagtttttgtttgaatttttttgtattatttagagttagaataatatggaataaaattgattttaagaaaaatttgataaagtaatggtggttttttggaaaagtatttcatagatctaaagaaccaaatttcaccatctcatatagttcttataattcttgatttaactactttcaaaaattaatttctatttctcagtaaggtttttcagactcctagaacatatttttgagttatgaaatccaaatatatacatacgattgcatcagaagcgaatactttcaacaattattctttcatttattctttgacaaattcagaataatcattccacatttagtccaaatatatacattacaatgagaactctattccctgaaaatatgaaatgtttagaggcacattcaatcattaacgtgaaaattccccttgtaatcttcgaaaatagacttacagggaataacaactatcgttaccacagaggccattaagataagacagataattcccaggatcccaacaatgagcttctctggagctgatggtaaatctgcagggagagaaatgggaacagtgcgaaaggagaggtggatacagtcgtttagaagattcacagacaagagaacctgaatgcacaggaatcatacagagaaacttggaccccaaaccctcatctcccattgtaatctttttctcagaataatataccattgaattttcaggaaaaataatgctccatgaattatttgacaaagactacaaacttcaacaatgagttcaatcagtcttcatactttacattgaaatagcatatctcaacttggaattctgatctttgcaaatagaagatatatgagcactcccttctctttccccacattcctgtaccccaagctgcacatcctagactgttatattgaggatcttttaaatgctttacctttgcagtgataggttttgtcattcccttgaaaatcctgagaagctttttgaaggtttaattccgcataggttatttcctgttcagttgctaaaatggagtttttattgcctttaggttttcgttgctgcctctttgggtttgggggcagattcaggtctgagtagattactccttggttatccatctctgcagtgtgtgatgtcagggactgtactctataataacagtagttaagaagttaataaatggtttatatacaggattccctagtgcaattaaaagggtgaggtggagaacgagtattggagctcattttgcattaaataatctaaagttctttctctgattttcttcaagcctaaacacgtttcttatgaatatttgttttaaaaaaagatttttaggccgggcgcggtggctcacgcctgtaatcccagcactttgggaggccgaggcatgccgatcacgaggtcaggagatcgagaccatcctggctaacacggtgaaactccgtctctactaaaaatacaaaaagtagtcgggcatgatgtcaggcgcctgtagtcctagctactcgggaggctgaggcaggagaatctcttgaacatgggcggcagaggttgcagtgagcggagattgtgccactgcactccagcctgggcgacagagtgagactccgactcaaaaaaaaaagataaattttctgcatttgacaaaatattattgctggggcaatgagaagcaataaattactaaggaataaagaagttcaggaataaaaatatatttcttaaagtctgatgttttacctgtgttaaaaattaaaatgttgtattagaaaaacttctgcactcatttttatgttaattttgaaatccagtaatggttaagactatgtggtctgcacatgagtaatagtaaagttgacatatatatatataaaaatttcttgcactacattacttttaattagtaatttatacacattaatgaaaatcaatagaggtaattaaatggtcttttcttaatggctgaaatgttctaagaaattattaaaaattatttattaaaaattataaaaaattaaatatttgtatatgacagaaaatgctatgtgacacagttaacttatgcataacctaaatagtattaggaacactacataaattgttaatacttacagaagtattggtaatttaattagtaattggtaatttatttcctggctaaattatgaaccaaaaaatgataaataaaagtataggtaattcatgttaaagcacatttcatttaaacttatagaatgattttatggttgtcaaagtgagtaaaggccactttagttgtataagtacttgtaaaatttcagataatgtaattaaatcatttagtcaatgggctctggagtcagtgagatctagaattaattctagctttgacacttataatgtgcgacctttaaaaagttattctatttttaataacccagtttgttaatctaaaatgggcataagaacatataaaacgttgcatgtaaaacatttaccactcaacctggcacttaaagttctcaataagcattagctactttaattattattttagtcacaattgttatgttactgtttctgattcatgtcagttaaagcatggaaaataaatcttcagataagtctcctatgtccatgcgctacatctttttttgcaatattttgatcaatttttaaaaagtatttttattgctttgtaatacctttagcattttatgtaatctacctcattctgatttttattaaaaataaaaactgcttttctctaatctacgtgtctgaggaattgtatttggctttcatcaattgattgatttattttaataatctttaatggctaagctaaatataaattattattcaaagatacatgatgtactgattacaaaatacaaaattaattgttcattattgtgatgttaatagctttcccttaaacgatattgatcaacaaacccactagatttccacaaacaataatttgaaaactttaagaaatccttcaacatatttcatattttaggtttttaccctgagttattcaaatgaagacagcaatattctactttgattttattgtatattaattatacctcctttgtatcatattgagcacttgaaatcacccactaaatgaggtaggctagtagagagttggagagtagcaatacataccttctgtccccagaaagtcacacatcctttagtggagaggccaggttagtctcataaaaaggcctgctatagctgtgtaataaaaggtgaaatttaaaggcataaatccaagacaagaacaaacaatgcctgcaatcttcgcagactgccctgtgaaggctcagagtgagtcaagagtggaaaaagtagatttctcatcaacgtgttactaaggtttgaacaggaaattctacacatgggctattgtgaaatcagttttatctcatcacacacctccaaaatataggatacttggtctattaaaagtacaaggttgactttgaaagtgtgtcatttagttggttcatttttcaagtgcctatgagaattttttttttttctgtcttgatcacgaacattgtcaaccctcaccttgttaagagtgccttttagactaggttgctaaatcttaacattgcatacttcttttctttatattattttattatgtcacttccattataatagaaaacattctaaaactcatagtaatattatcaactgatatctactgattttttccttaattattctgaaaaattactgcagtaattactcaattgattgtagctggcacaaaaagcatcattgccaaagttatattattaacttctcttagttcttaaatttttgcacttaatttttaaaaatagattatttaatcttcagattacccttgataaaaatatcttggataggtaaaatattaatcaattttgaaatatattagcataccagaaattgaaatattaaatagctattcattacattcttcatttattcatcctccgccataacaaattatgtcgactttcatagaaatatttagttgtaaatgacaaaaactgaagtcaaactatgtatggggaaaaagtaattttaaaatcttactaggaggaaagtcagtaaattggcagaataggtggtcccccacacatatgcccccacagcaacaataatttttcagccatccacagacaaaagttcctttgagggagtttggaattcaagtaggagtttgtaaaatgccagtggaacccaagacctaggaaggttgttttagggaatagatttgcatccaagtggcagacttaccaacagtgattccatctccagacctgaaaagggacccatcctcctgtgcttgccttcagccccatttaggccttggtcatgctgccaaaaccatttgcccaggggcccaggaggagactcacacactagtgtctcaggaggtaggcatatcaactgtagtctcaatgtagaccctgaaacagccctctaacttggctttaactagtgtcagccacaacttgagatcagtccttcacccacagagacttcctgggagacatatacatctgtacctctggggcatgc

SEQ ID NO: 2296 - DNA, 8580 bp, Homo sapiens; identical to SEQ ID NO: 2295

SEQ ID NO: 2297 - DNA, 7344 bp, Homo sapiens; identical to SEQ ID NO: 2294

SEQ ID NO: 2298 - DNA, 8282 bp, Homo sapiens
atattgttcattgatttattttccaatcataacggtctgcattttaatattaatatttgttgtaaatgactaatgcttaaatcaaactatatagagagggaaaagtaatttttaaaacatcatctagttaaaaatagggagggcagaaaaagtagatttttaaaacacaagctaaatggtacatgagcactcaggggcggtggcttgtgtcagtaatcccagcaacttgggaggccaagatgtgttgatttcttgagctcaggagttcaagaccagcctggtcaacatgatgaaaccccgtctctacaaaaaaatacgaaaattagccagcatgatggtattggcctgtagccagctactctggttgctgaggtgggaggatcgcttgagccttggaggtgaggtcgaggctgcagtgagccgagatgaaatttactgaaattggggaaatatacttcataatgataaattaattttccaaaccattagtaatatattttttatcattgcatatacctaatgatacaagttcaacatatagttgaataaagtgaacaagtaaacaatcataaatgggatttttaaagactcttctcttgatgcttaatacaagacaggccagtgagcctatagaaagatttaaactagacaagtaaccatcactcatatgaatgcattcacacacatatactcacacggatactcaatttcaatgtagtaccgctagccaagcttggctaggagacagttgaaatgtagctattcaaatttaacattaattaataaaaataaataacatttaaaaccagtacctcaccacatgagccacatttataaagggatgaagaacatttccagtttaatagaaaatgttctaactatattttacctacaacagaagtcaataaacaaaaatctgagaaccttatatggtttttaattcagtaatatatgtcaaaataacatatgggccaaagaaattatcaagatgaatggtcacaaaggactactaagggaagattttgaaaaggcacagatattttattcccagtttaaacatggcaataccattatggtctttacagttattaaacaggcaataaaactatattatcaatgcattttaatgtccatatgaaatagaaaattcctgggaaatgctcattaccaaaatatagtacctcaaatagaaatctgagtaaaccctacatgtattgaagaaattcagtttagccataaacttttctacaaaaatagcctgcaaactcagatggcataactagtgaatgataacatttaaaaataaagcggtactctttattattattattatattttaagttctagggtatatgtgcacaacgtgcaggtttgttacataggcatagatgtgccatgttggtgtgctgcacccatcaactcatcatttacattaggtatttctcctaatgctatccctcccccaaccccccaccccccgacaggccccggtgtgtgatgttctcctccctgtgtccatgtgttctcattgttcaattcccacctatgagtgagaacatgcggtgtttggttttctgtccttgtgatagtttgctgagaatgatggtttccagcttcatccatgtccctgcagaggacatgaactcatccttttttatggctaaagcagtactcttaacaaatgcttccaggttatagagaaacagaaaatcttcccaagatagccttgagaccaaaactttttcaagtacatagctacaaataaaaacgtggtcaaatatccttgtgaacatagatgaagaaacatatcttaccctagatatagtagtatgtgcactgatattttataaggggcaatatacaatgatcagcatggatttgtttcggaaacaaagcctagtttaacatttgacaaaaataaaattattttataaaatgttgtataaagaaaacatatatcattctaagtaataaaaaataaaaatgttacaattgataacatctattgaaaaaaggaatattataaaaccacttcaatataagaaagatatgatgaaaaaaacaccaaactttgtaaatatgaataatatgttgaattattttttgccaaaaccagaaaatgatacatatgatacatgtaaaatttgattgtaccttctattcaactctggatataaagtactagccagagaaaataaatgaagaaaaaataagttgtggcacatggatagaaaaaataaaagtgtgattatttgcaggacacaggcaggggaacatcacacacaggggactgttgtggggtggggggaggggggagggatagcattaggagatatacctaatgctaaatgacgagttaatgggtgcagcacaccaacatggcacatgtatacatatgtaacaaacctgcacattgtgcacatgtaccctaaaacttaaagtataataataataaaaaaagaaaaaaaaagaaaaagaaaagaaaataaaattgctgtttatatagaaaatccagaaaaatctgtttgaaatgatagatttaaatatgtaaaataagtgaaaatgcagacatcagttgtatttctatttacagtaacaaaagttattaaagggaatattaaaatcagaatgctatttacaaaagcatgaatgtaaaatatctgcatttctgtatgattcaaacccccaaaatacataatatgatagagagaaattaaagaaaaccccatacattgaacccagtacattgaaggacacaatatgatattgtatggaaatgtcaagaagctaatctttaaaaattactttagagattaaatgcagactcaagcaatcccaggacagtatatatttttgttttggacagcttcattgaggtacggtgcacatagcataaatttcatccacttaaaatgattaaaaatcagtgatgtttagtgtattcacagagttacaaccatcactgctactgaaatttagaaagttttcatcactgacacaaagaaacattctagcaattagtggacacctcctatttcaacctcccttaggcattagcaacgctattttattttctgtctccatggttttgcttgttcttgatacttcatataaactgaccaacataacatgcaacttttaggaagcctgaatgccacaaacatcacgttcagcaaaatgagcctgacttaaatgcgagggtatctgtacttccgtaattgtgtgtattatatttcaataattgatttggaattttcttattattagagcaaataacacaattcattttaaggcttatgcaatcataatatcatttctgtttgaacaaatataaaattttatctgatgcactgcaagctcaagcgctttaattctaaagcttatgctcacaatgattcttgaagatccacactggtctgatataagtccacgtacatgtagcattgcacagttacgttcagcatgatctgagtcttttatcctgtaatggagaaaaatccataattctgttacattttatgcaaatgacccatgagacaaaagcattttccatgtactgtaagaaaataattttatgaaaaagggtaattaaatttttcatatgctattactaaaagtcattattctgaacactcaatacagtactcccccttcatccacgggggatatgtttcaagaccccactgaatgtctgaaatagtacagaacctatagagagattatgttttctctacacattcataactgtgataaagtttaatttaaaaattaggcacaataagagattgacaacaataactactaataaaaaattgtaagcaatataccaacagcactactattgtgctttgaggatattcttaagtaaaataagggtgactttttaatgaaaacaagcactgcaattccctgatagtccatctcaagcttgtctaacttacggcccatgggccgcatgtggcccaggaagctttcaatgcggcccaacacaaatacataagctttcttaaaacattctgagatatttttgcaatttttttgtttagctcatcagctagcgttagtgttagtgtcttttatgtgtggcccaagactcttcttcttccaatgtggcccacagaagccaaagattagacacccctggtccatctcataaccaagaaagttactagctgaccaatgagtggtggacatatatggactactatggtctattgtaaaatatttgtatcaacatttcactaactttccacatctttcttcatatcaatgattccacatagatttattcatattattcttctgaatttatcctttatatttttttatatagcaccctataaaacaacttactcatgtttgaaagccaaaccatttattgtcacccatggatgatgactgctgttacgaaacacaccaatccatgaggaaggtaaaatgctggccagaaatttctaaaagaaaagaaataattttcacttaaataataattatgaaaacattacaaaaacaatatattaaagttgaaaaccactatttgcagtgccaaaaactttcataaatgtttgaattttttatttaaatgaactcttcaacgtttatacttagtactttcattcttattctcatgttaataaagacattttaattcttgcaatgtaatagttactccaattaacagaataaacacaggaagggttttaataagtttcctgatactgtgcattcatttctccagatactgtgactaaatcaatctatttttgtgctatatttctcagagttggagatttagaagggaattgaggggttgtcattcagaaataaatgacatggaagctacagattgggtttccttggtaccacaccattctttaactagataagccctcaatttttatccgattcggtttttgtggaataacaggggtcctggccaggtggtgtagactcgtctctctctgctactccctactaaaaacaactataaactctgggattaatgaaagacaaaagtaatggagaactctgaaaggtggaaagagaaagatgaaattgtctgggaccctagcatcagggatcaaccaagtgtccgagtgagcatgttaagtcctccacacgacagaagaaggtgacctaggcctgctgtttccctacacccaacctggcaataggaggagggtatcgaaggagagtcccctccacaataccaggcaaggctggtgccactggcaaggatgatctaccaggagacctgccaccaatacggagctagagaaagtgcttccttctcataccaggagacaccagggtggttgtgggtgaggaggatcaggaaagggacccacgactaccaatgcaccatccagggtcctctttgcccctgagggcatgagactcacttccccatctagagacataagacagaatgaattcttagtgttctttgtacatagtacagcagtgaacagtaacaaactacagataaccgcaataatatggaggaattccacaaatatcagataggagtgaaaaagacagacatgaaattcacactgtataattccgttttttataaattcaagaacaggcaaaccttatttataacttcaaaagtcaagacagtgttttggagaggagtcaggataagtgatgagggcatacacaggggtggaactgctagagctggaaacttatttcatgatctcacttgtatcacatgagatcattcactttgtgatcaatctgcatgactagatcatatcatgctcaataaaattaaatagtaaaatttattgtggattcaaagcattaatagaagcatggttttccataaaaagcaaaaactgaaaataaaagtacattagcggtatataactttaaaaacattattaagtcaatcaactgaataatgcatacacttgaaaatatataagctaaatatatgtacacacatatggatgttttctacaaatgtattattcactgaaagaagcttttcataaaatgtttgaaacatttacatcttaccatttcttcttcattatctatacaaagcagactagaagagttctttgaagcacaggcctgcaaactctcttcccaagttcttctttccttaccaatgtaataacaactgttggaatatgtaatccactcctcaggacaatggccacaatgacgtgctaataaagatatgaattactatctagaccaatatgaatttttaaaaatgaaaattagttcacatatttgcaacagtataaacatatatgtgcttaacatatttatgcatccttacaggcttataagtatatattttttaataactgagtcagtcatacacacatacacagaaaagggttagcctctctcccctaattgtgttcccatataaagcaaaccaacaaacaaaaatacactccacacatgtcttgaacctcactgatacacaactgcttttttagaatagtaaaattatttatttggtatcatctcacagcagtaggagacttctgttaattgggagaaagagggtagaatgattttaagtgagtatttctacttactggagaaaaggaaatgctgcctcataatctttctttataaatatttatggctgaatttatggcttattttctgcaaaaatgccactattcttttacatgccttaaaacagacacaaaatataaattgtactaatatcagagcattgaaaataaaaatgtacctttctgggttcttgcattcggggaagaattgttctgctccaggactgtaatagaaaaattaaaatgatttttataaaaactgatatctagataaaccataatgagtttagtttcttactttgaaactttgtgtgttatttaaaatggggagaatctttaataaaattaactttttctataaaaatatataaagtaatagacctttgaaataaacatttttaaagactttagcacaaaacttcaccatctcttgtagtatttgatgtaaccactttcaaaaattagtttttctaaatacttttcttctatagcatgcctttgaattatgaaatcagaaaatatctttgtgtgtgtatgtatatacatatatatagattacacacaaaaaataaacacatgttctctacaatgattttgttatttatgttgtgaaaaattcagaataaccatattattttggttccaaattgtactaatatcagaactttgaaaataaaaatgtacttttctgggttcttgtatttggggaagaattgttctgctccaggactgtaatagaaaaattaaaatgatttttataaaaagtaatatttagataaaccataatgagtttagtttcttactttgaaactttgtgtgttatttaaaatggggacaatctttaataaaattaactttttctataaaaataaatgaagtaatagatctttgaaagaaacagtaaaataagagttctattcttcaacagtatgaaatattttgaggcacttccaagcattaaagtaaaacgttcccttctaatctttcaagaatatgcttacaaggaataagaactattgtttttaacacagtggccatcaggacaatgcaaatgattcctaggacctcggcagtgagcttttctggaggtggcagtaaacctgcagggagagaaatagaggcactgagagaggggagatagagagttgattaggattacatactagagaattacatactagagaacccacatgcacagggaaacataatgataaactctggccgctaaatctacatctactctagtaatctttctctcagaatataccatttcattttcagtaaatgtaatgttccatgagtggattgcagattacagttgattacagttgaacaatgcctgaataaaattagtcttctgatttcatattagaatattagatcccatttatgaactctgattctcacaagtgtaaaatattccctaatctttcctcacccttctgcattcaactgcacatcccagaacaataacattgaagatatatttaatgttttaccttggcagtcatatattttatcaatcccttgatgattcagagaagcattttgaaggtttaattctacttggaatatttcctgttcggttcctgaaatggagcttttattgcctttaggtttcctttgctgccactttgggtcctgggccagactcacttctgagaaggttcctctttgtttactcatctctgcagctgtgtgatgtgagggactgtgctctatgataactgc

SEQ ID NO: 2299 - DNA, 5013 bp, Homo sapiens
caaataacacaattcattttaaggcttatgcaatcataatatcatttctgtttgaacaaatataaaattttatctgatgcactgcaagctcaagcgctttaattctaaagcttatgctcacaatgattcttgaagatccacactggtctgatataagtccacgtacatgtagcattgcacagttacgttcagcatgatctgagtcttttatcctgtaatggagaaaaatccataattctgttacattttatgcaaatgacccatgagacaaaagcattttccatgtactgtaagaaaataattttatgaaaaagggtaattaaatttttcatatgctattactaaaagtcattattctgaacactcaatacagtactcccccttcatccacgggggatatgtttcaagaccccactgaatgtctgaaatagtacagaacctatagagagattatgttttctctacacattcataactgtgataaagtttaatttaaaaattaggcacaataagagattgacaacaataactactaataaaaaattgtaagcaatataccaacagcactactattgtgctttgaggatattcttaagtaaaataagggtgactttttaatgaaaacaagcactgcaattccctgatagtccatctcaagcttgtctaacttacggcccatgggccgcatgtggcccaggaagctttcaatgcggcccaacacaaatacataagctttcttaaaacattctgagatatttttgcaatttttttgtttagctcatcagctagcgttagtgttagtgtcttttatgtgtggcccaagactcttcttcttccaatgtggcccacagaagccaaagattagacacccctggtccatctcataaccaagaaagttactagctgaccaatgagtggtggacatatatggactactatggtctattgtaaaatatttgtatcaacatttcactaactttccacatctttcttcatatcaatgattccacatagatttattcatattattcttctgaatttatcctttatatttttttatatagcaccctataaaacaacttactcatgtttgaaagccaaaccatttattgtcacccatggatgatgactgctgttacgaaacacaccaatccatgaggaaggtaaaatgctggccagaaatttctaaaagaaaagaaataattttcacttaaataataattatgaaaacattacaaaaacaatatattaaagttgaaaaccactatttgcagtgccaaaaactttcataaatgtttgaattttttatttaaatgaactcttcaacgtttatacttagtactttcattcttattctcatgttaataaagacattttaattcttgcaatgtaatagttactccaattaacagaataaacacaggaagggttttaataagtttcctgatactgtgcattcatttctccagatactgtgactaaatcaatctatttttgtgctatatttctcagagttggagatttagaagggaattgaggggttgtcattcagaaataaatgacatggaagctacagattgggtttccttggtaccacaccattctttaactagataagccctcaatttttatccgattcggtttttgtggaataacaggggtcctggccaggtggtgtagactcgtctctctctgctactccctactaaaaacaactataaactctgggattaatgaaagacaaaagtaatggagaactctgaaaggtggaaagagaaagatgaaattgtctgggaccctagcatcagggatcaaccaagtgtccgagtgagcatgttaagtcctccacacgacagaagaaggtgacctaggcctgctgtttccctacacccaacctggcaataggaggagggtatcgaaggagagtcccctccacaataccaggcaaggctggtgccactggcaaggatgatctaccaggagacctgccaccaatacggagctagagaaagtgcttccttctcataccaggagacaccagggtggttgtgggtgaggaggatcaggaaagggacccacgactaccaatgcaccatccagggtcctctttgcccctgagggcatgagactcacttccccatctagagacataagacagaatgaattcttagtgttctttgtacatagtacagcagtgaacagtaacaaactacagataaccgcaataatatggaggaattccacaaatatcagataggagtgaaaaagacagacatgaaattcacactgtataattccgttttttataaattcaagaacaggcaaaccttatttataacttcaaaagtcaagacagtgttttggagaggagtcaggataagtgatgagggcatacacaggggtggaactgctagagctggaaacttatttcatgatctcacttgtatcacatgagatcattcactttgtgatcaatctgcatgactagatcatatcatgctcaataaaattaaatagtaaaatttattgtggattcaaagcattaatagaagcatggttttccataaaaagcaaaaactgaaaataaaagtacattagcggtatataactttaaaaacattattaagtcaatcaactgaataatgcatacacttgaaaatatataagctaaatatatgtacacacatatggatgttttctacaaatgtattattcactgaaagaagcttttcataaaatgtttgaaacatttacatcttaccatttcttcttcattatctatacaaagcagactagaagagttctttgaagcacaggcctgcaaactctcttcccaagttcttctttccttaccaatgtaataacaactgttggaatatgtaatccactcctcaggacaatggccacaatgacgtgctaataaagatatgaattactatctagaccaatatgaatttttaaaaatgaaaattagttcacatatttgcaacagtataaacatatatgtgcttaacatatttatgcatccttacaggcttataagtatatattttttaataactgagtcagtcatacacacatacacagaaaagggttagcctctctcccctaattgtgttcccatataaagcaaaccaacaaacaaaaatacactccacacatgtcttgaacctcactgatacacaactgcttttttagaatagtaaaattatttatttggtatcatctcacagcagtaggagacttctgttaattgggagaaagagggtagaatgattttaagtgagtatttctacttactggagaaaaggaaatgctgcctcataatctttctttataaatatttatggctgaatttatggcttattttctgcaaaaatgccactattcttttacatgccttaaaacagacacaaaatataaattgtactaatatcagagcattgaaaataaaaatgtacctttctgggttcttgcattcggggaagaattgttctgctccaggactgtaatagaaaaattaaaatgatttttataaaaactgatatctagataaaccataatgagtttagtttcttactttgaaactttgtgtgttatttaaaatggggagaatctttaataaaattaactttttctataaaaatatataaagtaatagacctttgaaataaacatttttaaagactttagcacaaaacttcaccatctcttgtagtatttgatgtaaccactttcaaaaattagtttttctaaatacttttcttctatagcatgcctttgaattatgaaatcagaaaatatctttgtgtgtgtatgtatatacatatatatagattacacacaaaaaataaacacatgttctctacaatgattttgttatttatgttgtgaaaaattcagaataaccatattattttggttccaaattgtactaatatcagaactttgaaaataaaaatgtacttttctgggttcttgtatttggggaagaattgttctgctccaggactgtaatagaaaaattaaaatgatttttataaaaagtaatatttagataaaccataatgagtttagtttcttactttgaaactttgtgtgttatttaaaatggggacaatctttaataaaattaactttttctataaaaataaatgaagtaatagatctttgaaagaaacagtaaaataagagttctattcttcaacagtatgaaatattttgaggcacttccaagcattaaagtaaaacgttcccttctaatctttcaagaatatgcttacaaggaataagaactattgtttttaacacagtggccatcaggacaatgcaaatgattcctaggacctcggcagtgagcttttctggaggtggcagtaaacctgcagggagagaaatagaggcactgagagaggggagatagagagttgattaggattacatactagagaattacatactagagaacccacatgcacagggaaacataatgataaactctggccgctaaatctacatctactctagtaatctttctctcagaatataccatttcattttcagtaaatgtaatgttccatgagtggattgcagattacagttgattacagttgaacaatgcctgaataaaattagtcttctgatttcatattagaatattagatcccatttatgaactctgattctcacaagtgtaaaatattccctaatctttcctcacccttctgcattcaactgcacatcccagaacaataacattgaagatatatttaatgttttaccttggcagtcatatattttatcaatcccttgatgattcagagaagcattttgaaggtttaattctacttggaatatttcctgttcggttcctgaaatggagcttttattgcctttaggtttcctttgctgccactttgggtcctgggccagactcacttctgagaaggttcctctttgtttactcatctctgcagctgtgtgatgtgagggactgtgctctatgataactgc

SEQ ID NO: 2300 - DNA, 10935 bp, Homo sapiens
cggataacaacttccgctcgggaagtttgtaaaagtctgggctaccggcgcggcgtagtggatgcagcatcctagtggaggacgcccctgtggtgagtgcgcccgtgtcccccgccgcccctccgtccctgggtcgtgggctgtcaaaccttctaattctgcggccgccccagggctgtgagacccagcgtcgcggctgctgggacagaccggggaggctgcccgtgccctcggctattcgggggctgttcttcagcttcttccggctcggcctcctcttctctcctcgctccttacacttgcaggtttgtcaggacccggttgcgtatcctcttgaagctggtttcttcctggccgaccccgtccgcgatcgtgaccttagttatccctcatagacactttccacacctgtgtctccagccctatcgctccgatgagacccgagcgcttagacttgattcataacacccaaagctccccggccccaggctgagctcctgcaacctccacaccccaccctctggtcctcccaggcattccaccgcgaaggggaggaggcagaaacccgagattcgcttcttctcctttcctgcccacgcccagccacacagtcactggtgcgttagctccataactgaaccatttgcctccttgccattcccaccctgtaagtcccaatcctggccgtcttcctctctcacctgaacgcctccctgtcttctccccacccccatcctgttttgctgctttctcatttgttcatcacagaggatcttttataaaatgtagcttagccaggcaaggtggctcccgcctgtaatctcagctcttgggaggccgaggcaggtggatcacttgagtccaggagttctagaccagcttggtcagcatgttgaaaccttgtctctacaaaaaatacaaaaattagccgggtgtggtggtgcacgcctgtaatcccagttactctggggaggctgaggcaagagaatcgtttgaacccaagaggcagaggttgcagtgagcagagatcgcgccactgcactccagcctgggcgacagagcgagacatcatcttattaaaaaaaaaaaaaaaaaaaaggtagcttaggccggatgctgtggctgacgcctgtaaccccagcacttggggaggctgaggccagaggatctcttgaggccaggagtttgagatcagtcttggcaacatagtgagaccccgtttctgcaaaaaacttaaaacaattgcagggcatgttggcacatgcgcttttggtcccagctactggggagactgaggtgggaggatcacttgagcccaggaggtcgaggctgcagtgagctgtgattgcactactgcattccagcctgggtgacagagcaaggacctgcctcagagaaaaaaaaatcctgtgttaatttgcctaggggaaaaaaagtagctatgacaatatccttctgttctcccgtattaaactttgttgcattacacatgaaaccacggctcaggaggccttgaggaatctggctttagcccctttcctggcctatctcacggttctccctgactctgctttccaggctgggaagcccagtccaggttgtgcaaacacagctgttgagctgaggggagagggtgttttttttttgtttttgtttttgttttttttgagatcgtctcgctctgtctcccaggctgaagtgcagtggcataatctcggctcactgcaacctccgcctcccgggttcaagcagttctcctgcttcagcctcccaagtagcctggctaattttttgcatttgtagtagagatggggtttcaccatgttggccaggctggtctcgaacttctgacctcaggtgatccacctgcctcggcctccccaagtgctgggattacaggcgtgaaccaccgcgaatggccgggagctgttatttttatcactgtggtcattgctacttgctagaggaactcagcaaggtgttctaattggaaaacaccacccatgacccatgtgctcagtgtgccttttcatgtttttatagaccgttgtataactttggttgaagtgtctgttctaatattttgcccagtttaaattttatttctcttttttattgatttgtaggagttacaattctttatataagtcctttgtcagatacatgtattgggaatattttctcttagtctgtggcttacctttgtgtctctttttagaaaaaaaaatttaaacaatagagacagaggtctccctatgttgcccaggctggtctcaaactcctggcctcaagcaatccccctgccttagcctcccaaagtgctgggattacaggcgtgagccactgcaccccgtctccttttttttttttcttaactgccttggtaaacaaaaatttttaattctgataaatccaatttgtgatttttttttttttttgagacggagctttgcttttgttgcccaggctggagtgcaatggcgcgatatcggctcgccgcaacttctgcctcctgggttcaagtgaatctcctgccccagcctcctgagcagctgggatgacaggcaagtgccaccacgcctggctaattttgtatttttagtagagatggggtttctccatgttggccaggctggtctcaaactccgtacctcaggtgatccgcccacctcggcctcccaaagtgctgggattacaggcgtgagccactgcatccggcctgaatttgtaattttttaaaagtgcttttagggatccatgaaagaaatgtttgtctaccccaatgttgtgaagatggtctctctgtgtcacccaggctggagtgcagtggcacaatcttggctcactacaacctctacctccagtttgtgttttttgtttgtttgtttttgtttttgtttttaagacggagttttgctcttgttccccaggccggactgcaggggtgcgatcttggctcacagcaacttccacctcccgggttcaagcgattctcctgcctcagcttcccaagtagctgggatgacaggtgcctgccaccatgcctggctaatttttgtatttttagtagagacagggttttgccatattggccagactggtctcaaactccccacctcaggtgatccacccgcctcagcctcccaaagtgctgggattctaggcatgagccaccacgcccgacctacttctttctttgtaatcttatggctttatgtgttttttctacctccttgcactgactcaggcctccaataaggtgacagagagaagcagtgggcagacagccctgctttttcctggtctcagagggaaagagctccgtagtggcccatgaagcaggatgttggttgcaggtctgccgggttgaagaagttctcttctgttccttgtttgctgagagtttttgttgggattaggtgttgaattttaacaaatgccttttctgcagctattgagataatagctgttatatggttttctcctttattctgttaatttggttagttatatcattttcttttttttttttttttttttgagatggagtctcactctgttgcccaggctggagtacagtggcgtgatctcggctcactgcaagctctgcctcccgggttcgtgccattctcctgcctcaacttcccgagtagctgggactgcaggctcgtgccaccacgcccggctaattttttgttttttagtagagatggggtttcaccgtgttagccaggatggagttatgtcattttcaaatgacagcaaatgttggggattaacattgtgattaaagttgatgctatgctgttgaaagagtgaaaaaaaaatatcaagttgaaaagcatattcatgaaaacatgtagcagttaatgtaaccacctgtgagtgtcagaaggagaaagggaatgtctgtgtacctgctgtgctggaggtgggagggacgaggggtcaggggtgaacgccgagggagccgccccatgcagtgagtgttgagtgcaggtggtggagggagcctcctgggcaccaactgcagttaatggggatcaaaccagctgtgtactcttagggtccatgtcacttggtcatgacagagaattctttttataaactgctggatttggcttcctaatattttttgagaatttgtgtttatgagagtttggtaggtaatttttttgtaatatctttttttttttttttttttttttcagacagcgtctcagtctaacatccaggctggagtgcactggcatgatctcagctcactgcaacctccgcctcccatattcaagcagtccccccacctcagcctcctgagtagctgggactgcatatgtgcactgccacgccccgctaattattgtattgtttatagagacaggctgggcaactgctgggctcgaacagtcctcctgcctcagcctcctagggtgttaggattacaggcgtgagccactgtgcttggccccttgtaatatctctgtcaggttttcggtttgggttttgctggcctcattaagacagactggatagcgtctgctcttcctctgttcactaaatagcttctaagatcagtactgtgcttccgtaggctttggtggagtttaccagggaatccagctgggtgtggtattttctgtgtgggaagggttccagttacattttcaattgccttatcagatggaaggcttccctttcttttgtcagtttcatgatactgtgtttttcatcgagtttgtctgtttcatctcagttgctgaacctgtttgcatgagttgctcctgacggccctttaggatacttccatgtctgtagggtctagagtgacatctcctcccctcccctgacgaggtaaccaggcatgggctatcttcctccagctggttctgtctcttctcaggggtgcctgtggggctggcctcttctgcatcttggggctctgagctttactcacgaaggaggcaggacccactgtggcaggagggcagtgggatgccagggtggttctctacagacctgggggtagaagctggatctcagcgggctggggccctaaggtttaggggatcttgtggcttgatctggagactcagtgaacattattggggtttctcggggctgcaccaggttttcacttgggggaaggctgcgaggtggcctccttgtagcgtacccgagagcatcctcctggcacagtgctgtgggaacgggctgcccgcctgtctcctgaggaggagcctccgctgcctcagttgcggttagactctccagtcatgtgtttgcagctaagctgttggctttcagccagcaatggctggcctgtcctcctctggtgacaggcctggcttgctgtctggtatttcagagttcttgtttgtggaggtggcacactgtacccagctgtcccttaaagatatgttggcccctcaccactgccaagtttccccacacctggtggctgtcagtagttacagagcagaccctgtgtgtgcatcactcatttttcctgaattccccgtgatttgctgagtgggggggctcctggggtcaggtgcggggggcattcccaggccggctatacccgcttacatttcttgtctccccagatctgccctccttggcactgtgcttccccagaggggtggcctcgctgttcccatggacatggcccaggtgagccctgctgctgccgagcgcagcctcccttctgccctgctggctgcctgagaccccagcacacacgcggggagggtctgtggcagtggcttcccaggcactgtgcccgtgtctgcctttctgccttctctcttaaggggtggggaaagaaaaagaaaattggggccaggcgcaatgcctcacgcctgtaatcctagcactttgggaggctgaggcaggtggatctcgaggtcaggagatcaagaccatcctggctaacacggtgaaaccccatctctactaaaaatacaaaaaattagctgggcacgcacctgtaggcccagctactcgggaggctgaggcaggagaattgcttgaacctgggaggcggaggttgcagtgagccaagatcgtgccaccactccagcctggtgacagagcaagactccgtctcaaaaaagaaaaaaaaaaagaaaagaaaattggattcattgacactaggagagtagtggctgttgtaggaaagtagactagattctcttagtccactagagctaccgtaaccaaacatgacacagtgggtggtttacacacatgcacttcctctgttccaaaggctgacgtccaagatcagatgctgcagatctggtttctggtgggggccactattgtgctgtgttcacgcgtgtgcggggagggagccggggggctctctggagtctcctgtgaggaccaggtccatgggtcagggcccctcccttctgacctcacttaaccttaatctcttccacagaggcccatctccagacacagccactcggggctctgggcttcagtgaatggatttaggggacacaaacaatcagtccaccgcagggccactcccattcccccttcccacccagacctgtgggctgagccttctttttcttgggaatggcctcttcgggagctgtgtgtgttgcaggagccagtgaccttcagggacgtggccatctacttctcaagggaggagtgggcgtgtctggaacccagccagagggccctctaccgggacgtgatgctggacaacttcagcagtgtggctgctctgggtgagcacgggctgagcgcagcgtgagcacagggtgagtgctgggagagctctgccgctgcctctgggcccagctcgtccaggacagtagtggggcctcccagctgagggggctcaggagctagaagttattggcttatgtagacagaggggcccactcagcgtttctctcgggctccctggaggcagcctcatcttccttcctctgaccttgccagggccttccgtgggccttggtgtccaggcccctcccttcctgtcatctctgctttggggtggcttctccagggcctcccgagggctggcctggcgtcttaggctgatgcacaactgctctgagcctcgaccctcactttgtcctcagtacaagtaaaacagaaacttttctctcctttgagaaggattttgcagccccagaccagacctcgtctctcgcctggaacagtgggaggagccgtgggttgaagaccgggagagacctgagttccaggcagtgcagaggggaccccggccaggtgagtgctgggctgtctgggctcggcgggccccgtccctgtggcccacagctcctgggtagtgctcagcacgctgcagtgaccaagggtgtgtccttcccatgggagagcagacacacagctgctctctaaattagacaggcattagagacgtaggggcagccacgctcctgccctgatggacactggccgggggtggggctcgaaaggcatagtgctgcaggatgacatacagctgcagctcggaggggcctgaggctggagtgacacttgaagcctgcacctagccacccaggtgctgtccggcggaggccattggtgtgggtgtctgacctccctgtgatggccatgtggggtcccaggcctggtactgactgcacgtgagggtctccaggtatgtggctctgggtaggagtttgctccacgtccttgtttgcaaaactgggacagtggccatgcttccctccattaggtgagggttgctcttggggcagttgtcagcagggttttgctttttacttacattttcagagtgggatggagcagctatgtgaacacgagccctgggaggtccccgggtatgtggagtccccgactgtggagtgtcaggttcctaggtgtgtggagcccccgactgtggagtgtcaggtccctgggtgtgtggagcccctgactctggagtgtcaggtccccgggtgtgtggagcccccggctggggaggtgtcggatccccgggtgtgtggagcccccggctggggaggtgtcggatccccgggtgtgtggagcccccggctggggaggtgtcggatccccgggtgtgtggagcccccggctggggaggtgttgcatccccgggtgtgtggagcccccggctggggaggtgtcggatccccgggtgtgtggagcccccggctggggaggtgtcggatccccgggtgtgtggagcccccggctggggaggtgtcgcatccccgggtgtgtggagcccccggctggggaggtgtcggatccccgggtgtgtggagcccccggctggggaggtgtcgcatccccgggtgtgtggagcccccggctggggaggtgtcgcatccccgggtgtgtggagcccccggctggggaggtgtcgcatccccgggtgtgtggagcccccggctggggaggtgtcgcatccccgggtgtgtggagcccccggctgaagggagccatggctctgaggctgagtggttgagaatcaggtggagctacccgtcttctagacgacatcctagcaccacctccacccgcatgagtggggcctgctggcgtggacagggtgaaaggacattctcttggcccagttgcttctgttggttggcaggcatgtgtcggctctccctcacgtcagcagtgccgggtggcctgcgtaccaccggggctggggaagcatctgagctcatcttggcttccgctgttgatacctgtggctcatctgtgtttctttgaacgagttttcctgatcactcgtaaccatgtggaatgagctgagtcaatggaagccagtccacgcacacagcaggagggtcctctgggctttttttttttttttgagacggagtctcgctctgtcgcccaggctggactgcggactgcagtggcgcaatctcggctcactgcaagctccgcttcccgggttcacgccattctcctgcctcagcctcccgagtagctgggaccacaggcgcccgccactgcgcccggctaattttttgtatttttttttttttagtagagacggggtttcaccttgttagccaggatggtctcgatctcctgacctcatgatccacccgcctcggcctcccaaagtgctgggattacaggcgtgagccaccgcgcccggcctcctctgggctttgctggaggcactgcctggctgtgggccactggctctgtgtaagggtgtctgttccttccacaggggcaaggaagtctgcagaccccaagagaccttgtgatcatccagcttgggctcacaagaaaacccacgtgcggcgagaaagagccagggaaggaagcagctttaggaagggcttcaggctggacacggatgacgggcagcttcccagagctgctccagaaaggacagacgccaagcccacggctttcccgtgtcaggtgctcacgcagcgttgtgggcggcggccgggccgcagagagcgccggaagcagcgcgcagtagagctgtcattcatctgcggcacgtgcgggaaggcgctcagctgccacagccggctgctcgctcaccagacggtgcacacgggaaccaaggccttcgagtgccccgagtgcggccagaccttccggtgggcttcaaacctgcagcgccaccagaagaaccacacgcgcgagaagcccttctgctgcgaggcctgcgggcaggcgttcagcctgaaggaccgcctggctcagcaccgcaaggtccacaccgagcacaggccctactcgtgtggcgactgtgggaaagccttcaagcagaagtccaaccttctcagacaccagctggtgcacaccggggagcggccgttctactgcgcggactgcggcaaagccttccggaccaaggagaacctcagccaccaccagagggtccacagcggggagaagccctacacctgtgccgagtgcggcaagtccttccggtggcccaagggcttcagcatccaccggaggctgcacctgacgaagaggttctacgagtgcggccactgtgggaaaggcttccgtcacctggggttcttcacgcggcatcagaggactcacaggcacggggaggtgtaggggcgcccgaagagtggggtgctgcgcctctgcgggagtactgggtcctgagggagagctgcagtgagaagttgctcttcagcctggaaaatcaacctgaattcagagaagccttcttagtcctcagagctccccagtcccccgagaagtttactgggaaaactgccaggtgggagaagcagagccatgggtacgccggagatggcgggggctctggagatggcgggggctgcgccccggcgccgggcatcctggggatgtgctgagagtgtgcgcgaccccggagccacgtgccaggccgggctcagaggcggagaagcctgcctggtgcccacagccgtctggctcagggactccaccctggccccgagtcgccgtctgctgggcctttccttcctggctctgcaccccatgctggctgcccggtctggcttcccttcttgtctctgtcttgggcgaggcagctgtgagcattgcacagaggcaaagaccctcctgcagcctctgcgctgggccgtagaaacaagagcctttgtaatactgaacctcattcaaggattaggagtggtggttaggtcagggccacccccagtgctgcaggaacggcctccacccagctctgttggtcagagcctgggtcatgcacctggagttgggagatcaagttgggtctcagggcagtgaggtggccatatccaccacatcgcatttcgtgggggaagaggtgacctctttgttttaaacttaaggtgtctgcttatccagccagaaataaaaatctgccagtggtgttcccaagggaagacccccgtgggaatgggtcgggacactgccgtgtttcaggttagccaatta

SEQ ID NO: 2301 - DNA, 1300 bp, Homo sapiens
caggtggggacggagcagctggtgtctcggcagtagatgcggcggatcataaggacttgggttttgagcgccctgcaggaagccactggccgcgtccagggtcacctgtgcctggtcgttagtccctcacaatgctgtcactttgtgacgctcttgtgcaggattaaatgtgaacagcagagacgtgggtgatgcgctgcctcgtcagatgatggtcagttgtccaagcgggctgccttgctcttggtggcctcatcatccagggctcacacactggatggttgggccacagtcgcggtaccccccgggctgcaggctttccaccctgcttagcagggctccagggctccgggtagagcagggggtccctcccttggcacttccccagggaggagcacgaccgtgctcagctgcggtcaggctgctgctcttagttgtctttccttctaacactcaggcttcccttcctgcctcctgggtcgctgaagaaggtcaggtccacagaaaaggcctggggagagaatggtggtgaggagcccatgggggtgtgaggggccgggaggctctgcatcttgccctgttggcctcctcaccacccaggcgggggtggggtgacagaaggggctcacagcaggtgtcccgtaaggagcatcttccttcctggggccagcagccgtcactccctgtgagcctgtagagccgagttttctctgcatttatcttgggcagagaatgcatgaagctacttcgcggccagaatgggtgcacagcagggtccgttgacagccatgcctgtgacctagccttccacccctctgtctccaggggacacttgcctggcctttgtgttagcgctcagcacacatgtgtccagtgtaaagtccaccaagattagcagggcatggtagctgccgcctgtaatcccagcttctcaggagtctgaggcaggagaattgcttgaacctgggaggcggaggttgtagtgagccaagatcgtgccactgcactccagcctgggcgacagagtgagactccatctcaaaaaaaaaaaagtccgtcgagagagcaggtggcggatgcagctgagagctccaggaatgggagggccacgtggtagccactggcagccttgactgaaagatgaaggagtccatggtgctaggaggaggagttgcatcccagcaggctcagctcctggagctgcctctctgcactctgaagggaggcccagtggctgcaatattcttctttgggaagtacaatgccaagtaaataaagatatttggggtcattctagtta

SEQ ID NO: 2302 - DNA, 10935 bp, Homo sapiens; identical to SEQ ID NO: 2300

SEQ ID NO: 2303 - DNA, 1417 bp, Homo sapiens
ttcaggctctacccggggaggcttctgccgcagcttcagcgttcacgctgtcctccgactgtggggggagaagagccggatcccgatcccgggacaggccagagagaagcttggggccagacttcgtggagcggagagtgtcctgtgaggacaccctcggtgaggaccccgaagagatcccagagccctcgagtgactgcaccagcgacagggcccgggagcctgcgcgcgaagcggtcagggatggcatccgggatcccacctttgaagtggccagcgatgggaccctggagtccatgctcgatagcaccaacgaggggacccgggaagcctcgcgcgacgggaccacggacgaggcccggggggccgcgcgcgacggtaccacagacggggtctgggaggccgcgcgcgacgggcttatgggggcggctaatgacccggggcgcgaggtgggctgggagaaggccggccgctcccagagcggcgggcctccggggcccctgcgcagccagccgtgcacacgcgccaggtcccgcgtgtcctcgtgctcgcggtgcagttgctcgcgctgttccagcagctggcgccgcgtgtggtgcagcagctgggtccggcggagcagcagcagcagctcctgccgcaggcgtccgttgtccgctttgatggcctgcgtgtgcgccacaagcgcgcgcaccgcctcccgctccgcgcgccgcgccagtgactgcacgcgctgacgcgcctcgcgctcgaaggccgccttgtcctccaggaagcgccgcttcacgcggtggagcagctgcgtgtgctccacgcgcatatgcagcagctcgcgctccagcgcccggatccgggccagctgctccagctgcagcacctgcggcgggggcgccgtcagctcacccccaccccgcccccggcccggccaccagccccgccccgcctcaccccggccgcgggcgggctcactggccttgtagggctgcagctcttgcacctgctgtgccatctgtgccgcgcgcgcctccatctccaacagctgcgcgcgcaccccgtcctcgcgcccgtggtagagcgaggccagttccgcccgctgccagtggatctgcgctaggtccacgcggttctgctcgtccagccggacgatggctttggcgcagcgctgggcgcgcgcgctcacgtagctggcgtagagccggttctcctcgcgcaggcgcagcgcctcgcggtccaggaaggcgttctctcgcagcacctggtcaacgctctcctcgcaggtgtccagctgctccgagagcagcgcgtgttcgcgttgcaggtactgcgcgcgctccgatagcggctgctcggcacccgcggccgccgcaccacctggctggctccctgcgctcggcccgcgctttttcttgggcgccat

SEQ ID NO: 2304 - DNA, 10935 bp, Homo sapiens; identical to SEQ ID NO: 2300

SEQ ID NO: 2305 - DNA, 559074 bp, Homo sapiens
atcatattataggttttttaatttttttgaaaagtaactggcttcacaaacaccaagtacaacatgatttagacaactgagaaacaggcaagtatattttgaagtgctaaaataaaacatatttatacaagtacaaagcaaaacaatgctgataaaaatgttaaactttatgaaaaaaaatcatttgcagttcacatcaaaataatttaacattctctattattttaatagtacaagctgccacaacagagaaagaacagatacacgcacacaattttaaaaccaaatcagttataagtgcagaaaaaagtaagtacaagcacttttagcccacacaaatcttttaggattggcaccatctttctaaaacatctataatctatatagatttctaattacaacaccatcagcagctgccattgatttctagaaatacacacaatatacatagtatatttgttcacattgggaagatcagtgaaattcaaccaactattttatacatgcctcattcttcaatagacagtagagactctcccaggcctcagaccctcttcaaagtgaattctgacttgtctttatgctttcactgatctgtattttttcacagtataaaattgtaaatggtaactatagagattctgacagcttgagggttattaataagctgttgctaaatgtgaactcacataatacctttgaagtctccaaaacatgtacattttactgggagactagcataggaaatgcttttgttttttgttattcttaaaaagagcatttaattcctggcttggaagtcacagaactgcagcagagctattatacaattcatttacagtcagaaatagctcctagtcttcctgatcacttgctggtaacagcagtagtttgggaaagatagttactttcaaggattagcacgtttggggatttgctttttttccttgcttcagtcaaatctcttataatttttctttccatactccctttctgttccccatccctagcccagaaagacggttcttcccaatccagatatgttcttcttaggctgcccccactcctttcccaaaatggaaggatgagtggactgcttagattagtcagtataacttggttaaaccacgtcttcttctttccatcctgggacatatctctcatttagggtcactttgctgagccttagcatatccccttccttttagtcatgctggtcccgactgaattatcactgggcaccaggaacagattgttttgaaggaaattcaatgagaatgtacccaaatgaattgtgaagttcatatcctatagccctagaatgaatattcagttctctttgtactgtagagttattacttggaacctggtattagaattggcaaagagacagagttagcatcattccaaaataaaagatctcaagaatgcattactaataatcttatgtccaacatacaatgtattcaatggagtggcaaaagttatagaaatacagagaaaaatatatcttgtccttttctaattggataaatcatttttattattacagttgattatgatagcatgtggaagtatcagatggcaatttacttgcattaaatttaatttctgatgaagttttttataaggtagtgtgctttttaagagatatgttactaaaaaaatagaaaatgaatttgaccatgaacaaagtttaaacatgttcttcaactggtctagagtgaaacgtattgtacttgagaataaaatgaaaatcaacataaggattttataaaacaaattttaaaatgtagagcatatcaagaaaggtttttaatacctaagaagtcaagataggaatcctcaggtgaatgccatccttttgatgaggatccaaagggtattaacacctcaaaagatttccatttgtttttcagatagaggcagacatttgcttttaatgaaaccatgaaacttagctagatttcacttacattttaaaagcctcggtgtaatatttgggatcagggtgctgtgatgatgttattttcaaatctagcatgggaggttcgatttcttttaaattaatactttagtacattaatgttagcttttaatgttttgtattgggaggtttgacttaaagttgcaagtaagaacaaatagcagaaaagaaaactcaagcagaatatttattagaattttttaaagtgaagaatgataaattatgccaatggactgacttctatttctcagtttattttctgttaagtagatgtgaaataaaaaaaaatacttaccaaagtaaggatattgagctaaaagaaaaagttttatttattattctctctgccaaaatatacttctgcctcacagcacatatttttcataaggctatcttaagtataaggctgggtcaactgaactttaaatttataggacacctcctccatttattactatccttatttaaaaatcaaaacatttggtacctgaggatagctgcaatgggaggaagaaagagatgacagtggattcaggtcttgaactatgaattctacctatttgagactatcaaagcacacttgtttctgttatactctaaatctcttttctgtagttttaaaaagtgacagtatgaagtgcacaaaatcatattaatcattattttaaaaaagaaaataagaattgctttgcctctttttggaatggctaagaaagactgtgtggttaatattcattaaggttcctcttttttagtattttgtattgctttgaaaaatctacatttgtcatagttcatagctgccctgtttaagcagccaagaatagttaaaatcactgctcactggcatagctaaatctccactaagctgacttgacacagttaaaattttcagtgtattaagattgtgttaatcctttcaacaacagtctctcaaatcatgacaatgtcttcatggggtctatggaccactcttccagtggtgggactcgaaaagaacaaaggagctctttgtgcatcaggttctcaaaataaaggaatgaagaagccccaatgcatattttaatattttagttggcaatgcaaacgcaacagcattcctaaagagtggccatgtttcttgaaagagatagccaggctggagctcaagaatgatttttataaagagaatttccagctacaatgcaccccagtgagggaattacaaaacagtattccagaaaatattttttttgctactccagtattgattggcaacatggtgaaatagtcaagaaatcttccactggttttcttggttaatggaggtgaatctgaaataagtaggtggaatccccgatgcaggcttttggaagagtatttcacaacccaattggagaggaaaatctctggtagaagccctacgtagtacattagcgcagcactcactatccagtagtgtgttatgcatgggacacattcacaacgcctccgtaaatactggacccaagttactgcttttcaaggtctttacaggaaagaaaaaacaaaaagaaagaaaaaagaaagaaaaaagttgatgttttggtcccagattttgagtttgttagaaaatgtacattcatgtttggtgaatcaaagactcttctgggaaaagaattaaagtaaacaaataaaactttttacagttgcttattaactatgctcttcaccctccgttacgctgtttcacacgcactgcttccctagagcaaagcacttggtatggaactgtttgaagagacgccttgtcagccctcaaagatatcagccgtgtttcttaaaagcccatgttttctaaggccactagaagaaaatctgccaaaagatttgtcgtcggtttcttcgtcggttgtcatgagatagcactactgatctcgtgtttccattaaggggtgcccttggcatcttccccctgggccgtaaccaggcgactatgcttgccattgtgtgtgtgtgaacacggggggctccgctccgcacgcgcaggccggcgtgctttccagggacattcacaacgacgaggagctctgagtgtaatctcttatgataagagtgtcatatttgggagacgacgggatacagagggccgactcggacactggcgagttgggggttgtgctccccgagtccaccgagtctctgaagggggacggcggggtgagagccaccagctcctccaggtctggcttggcggccgcagcctcgggaccggccgcggggctctcccgggccgcgtccccagccgcctgcgcccctgccgcgggctgcgcgcctcccgtgacttcgatggccggcagaggctggatttcggcaaaggtcgtcatggtcgtgggcaactggatctctttggggatcaggtaggacgagcagagcggggcgccgacgccggggctgggggccgcggtggacagcatcatggagttgagctcgctgatgttggccgtgaagcgggtgaccacactgctgatctgctccatgagggagccctgcgaggagctgctgcgcgccacaggctccgagtgcagcgacggcacatcgtcgtccgtgcggctggccgagcccgcgcggtggctcagcgtgctgatgggcgacggtgagcgcggccgcgcgggcgccgggaagtgctcctcagcctcggccacatcatacagcgccttggggccggcgtctggggactcgggcccgcctgggccggcgcctgcgcagcccgcaccgcccgtggcccccacgcccccagcgctcccgcctgcgccagcgccagcgcccaggccacggctctccgtgctcttggggaagggcttgatgacggccgtttggttggggttttctttcttgttgatgtggatggacaggcgctgccacaggtgctgcccccggctgctcttctcattctgggcccacgtgacggattttccattggaactgaggagagaagggagaggaaaggtgactcagcgaggtgcccagggggcttggatgccgcttccccaatggtggttgctcatgggccccggactggggaggacttttctcattctttcaggaaacacagcatcaaaaggacatcatggaaagagaccttggaagtggctttcctttgcttgttttgagttaaagactgctttctatatcagggcttcagtttatcataatcgtgaaaatgtgtcaaaggggatgcttgtcaggatgaaggagtgtttattaggattctgcgggagttctgagcccacctgtgagtgcagcagcacacagatgcaagggcttgcagtgtcccggctgtgtgcacaagtgcctggtacaggacaggggcttcctagagttagtggcctctgaaggaaaacattaccactaggacccaaactcaccaacaatcatcagagaggagggaaggggtaagagagtcagggattaccaggaggtagtcagtggttccagttccgcctttattctggaagttggtatatatataactagggttttctgtctgaacccctgattttgaacatagtgttacttaggctgccttacctgctggaaaataaaaatttaatgaacacacatttctaatgagagcttctttacttcacagaaattcacctcacaaatgtattttgagttctgtacttgaataacagttcaatgagtgagagtgctgtataatgccttcggcacttagcagagtgatctcaaattaggatcctggtgaatattgagggactgacaagttttttgaaggcctttctctctctttctcctttgcacttccaccatggggtctgaaagccactctcaagatgtgattggtgcctcagcctcagcgccctagtacctctccttaccactaaaagctgacacaatagcttctgaagctgcagacgttctttcagaaactttacaaaggtcagagaatgtggcctgacactcaagattttttttttattttttgttttttagacggagttttgctcttgttgcccaggctgaagtgcagtggcgccatctcagctcactgcaccctcggcctctgggattcaagcgaatctcctgcctcagcttcctgagaagctgggattgtaggcatgcgccaccacgcccagctaattttgtatttttagtagatacggggtttcaccatgttggtaagactgttctagaactgctgacctcaagtgatcaacctgcctcagcctcctaaagtgttgggattacaggcgtgagccactgcgtctggccaggaatgttatatgaagagattctggtgtagtttcccatcacaaagtaatccaagatctctgttactagggggtctgttattttcagtcaagacagctctgttctaggggctgtgaccaacagatagccttgagcagcctgactacaaaagaagttgaagactacagttttatcatcacagcctatggttattaaactaaattctgtgtaagactcatctagggcatttgtcaaagatataagatgtgaccccaggagagtctgattgtctggattggcttccaaggatctatgcttttgacaagcattctgttcttctgctcccaaagtaaatctgaagcactttgtttctcagattctttcacaatctgagaaactctggcagaaagccatccttttcttctaaatccccatcactccccttgggcccccttgctggagggctggcttgcctttgaggggctggggcgtgtacctcatttggaatccaccagccttgaggctgcctgactggccctgcaggatccactctgtctgagaaacccactcccttggtaacagactgccatttctgcatcccctttaatgacatgctttttgcctctttccacactgcttcccatttctttatctgttcctttctacttcatggtctttctttctccgctctttcctgtgaaatttctttccatgtaatctacccaatatattgtagtctcatgtccttcagaatcctggaatatgagcttcttccaccccactctgcccttcctggaaaggatgaatgaaccattttcaggtttggaggttgctgtgcatccatagtagcagagggggcactgccaaacagttggtgttcctttctagtagtttcaggatttatttttcaattttgcattagcctgacttacgtgtattacaattctttttcccaggtgtccactagcttctggaacatggcagagaagaaatgggccagtttatttacgagatttgattgggaggatggttgccaactacaccctttctcctatcagaaggataagaaacaggtgtttcgaaaggtacaagtattatttcaggtcactaagtccccttttaatacaaagcatggacttgaaatcaggagactaattggatttattccaccaacttttaccttagggacactcttgctcctagtacagagaggttttgcaaacactagcttttaaaaagtttctctctctctctctcgaatgcctttagttgaacatgatggaacataactttggatgttagcagtaacagtctttggaatcacctgtagccatgccccaaaacatgatagcatgttgcaaaacctctaggtgagtgtgtgatgaggaaaccatcctaatcaaccaattctgtacaaagtattgacatctttttcctggctgtgcctttggttacagtgcccatggccataagggagaaagagcaccagaccatctgaataacgtgaaagtggacacaggaaacaccagacacccagagaaatggagtccaaatgtgagtacttcatttcattcttttgaacatgaaagcttttttttccctgaagtaaatgagaactcttaagaaaaaaaacaaaagaaactccctactcacgacattattctgtttattagtagaaagtacattctatgaagacacagatcttatctatctttttcagtgacactcagcatgatcttaataagcatttgatggatgaataggatttttaagttaacagggccactgtggggtgtcatggaaggtgcaatagaatagagatcctaaaatccggttcttattctggatctgccatcccagatacttggaaaagaataatctttttaagcctcggtaagaagcagacagtgtctcatttggttaaggttgttttgagattacatgagacaatgtaggtgaaaagagctggtaaagagaaggtgtctaaggatgttcagtttttatattttatgtgaatacagcatttcagaaaataaaaagtatactcaatgccattttgaaccctggtttaaggaacagagaattcagtgcaaagtaaaatatttggtaagccataaaacctttcaggttctttctcttttacctgacctggagttccatgatccgtggcctcttcacaccctaaactatctccttgggtgatcacctctaccccattaaattccaaattaacctttttcctcaaatgctttctcattgtgctacatcctctcttcctttttgcttaactgtatcctctttttttcttattttattttaccttaattgtcttgtcttaaagaaagctttcctgaccctgctaggctagattcctatggcacctgcattcaggcatatcataactctttgctatatgtctatctcacctgcttgatgggacattatgaaggcacagatggagggtttgctctttcctatatgcccagtagtacccatgcattgtttagaacatggtagtgctcagtaatatttttgggccaatgattgagtagataaaatgcagtttatttttaaaatttatactgaattgttttcctgttagaattaagtttttaaaataattcagtgttaatgaaactctattttgccttatggatctacttttacttcttatatacctccctttaatcaatagtactcaatgtctacatatttaaaaaatttcattaaatatgaaaatacaaagcttgatatctgccatgaaaatcacaaaataattccttctttataactcatatctgtcttagtaaaattgctcagtggtgaaatctcatcgaggcagtagtgatagtggaaagaaaggacccagattctcagtccaggatctgactcagaatgatgttgagcaaatcacttgccacctttgagcttctttctttattggaaaaaaagaaaagaaaagaaaagaaataaacctcccttgcccaccttgcatgatgtctgggaaaaaacaaaaggataatacatatgagggtactttatagagcatagcccttctgcaaatgcaaggggttattcattaacattaaaccttctattcagttgagctaagatgttgtatttattatttaggctgagatttttttttcagcatccatgttatatgtttgtccttgggggctgaagtaagaaaaatgaaagggaacttttctttacccatctatggcacgtcaccttccctcactgaatattttggacattagaaaaggagagggaaagaagaatgaaggagaaagggacaagatgaaatgatctgccacatctgaggagggggccaaaagtaacgtcttgctctcttccaggcaccatttaacccttttgcaaaatataatatgatgccatctaatgttctctctgttataattatttgctctttatttctgaaaaacaaaaagcagcatatcaataatgttatttgaggattaagttttttgtttatttgtttcattagtttttgtttacattttgggtctgccaaaatgacactttctatctttattctcagaggtttatttttcctgtttttcccttccatatcagaaacttagcaaatttattcattttcaagcagggtctgaatgtcatgtcaatgacctcacccagtttctctattcctctgctcaaacctgcagatattagagtattctgccatggtacaccatcattaggaagcaaacattaatagaggaaaaaaaagtttgaccatcaaaaaagtcaatggaatttataattcaatacaggaatacagtgttaaggtattcacaagtgtgacaaaaatgaggatggaaaggaatgtactgacatgaaaactactgtggaaaaaaaaagactttgggtttttcttatcaggattagaaaaattcagagaaaaagttgttcactgaggaaagaagtttcaaggaaggatttgcaaataaagtggatattaacgaggccttaaagcttggggatgttaaaatagcatggataagcaaatctcaattaatacatgtattgcatatatggaaaggaaactaattctacatgtctaatcccaactcctccaacagccctaagtgacgtggattttcacctctctcttaagtagcagtggttacatgtttccacaataattcccccagagaatctttcttaccaggcatttaatccctaataaattcctggtgggaggagaatcactcgatcctctcttaactagtctttggtttaacagcaacaggaagccttttcagaagctacatgttcattcacggtgggttattaaagtgcttaatggtactagtacagtcgctacttcccctgagtcctcataaggagcaagcaccttaacaaaggagaatatgacacgggagcatatgccaagcattggaattgtgttgagtcatcacagatatttccttctcaaatcaaactatttattttgatccacaattctgttacctggactcagcttcaaaactaaactactctaactggtattagttggtaaagtgatacaaaattacagctaggtacaaggaatgagctctggtgttctgcagcattgtagggtgaatatagttaactataatttgttgtatagtttcaagaagctagaataaaggattttgaatgttcacaacacaaagaaatgataaatgtttgtggtcatcgctatgctaattaccctgattttgtcattacacttggtatacatgtaaggaagcattccgtatcctataaatgtgtacaattattaagtgtcaactaaaaataaatttaaaaaaatctcactaaactactcttcatcctgacatttaagttctaggtcttagctgagatgttttaacagcgattagcaagaattttagatttttgtacttctttttcaaaacaggaaatgatttttaccagcaattactataaagctcaattataatttagtaaatagagaacaaagccagacatagctgttttgtgtctagaagctgctgcagtcaggaagactttgtggaggaattcagcttgatttaaaccttgaataaaacatggaattgggattggtggcaaagaagaggagaatcctggaatggtaatagtttccattttaatagaacttttcagctcacaaggtgttttcacctatggcatcatattttaccttcataacagctgtctaggataggatttatcagatagttttttaattacttatttacaagtctgttcctgcactaaacctagagcattgcaagggcagatgctacatgtatctcctgtgcttaatatggtgtctggtgcagagtagtgcagaggagtgttagtgaaataaagtgaactatatgatcttgaatgtttgatattgacaggtattattaaccttcactatagatatgagaaatgaggcttatggaacttaactaagtcgaccaagtcaaagtaaatggcaggacagtgccccaaatctgatgctaaatccagagtcattcccattgtctgtgtactgagtgccaagatacacacaggaaccaaggggctaacaagacatacccctgtggagcatccaagatggcagtgccccaggttttgcccataaaataacctgataaattctaaagctctgcatcaacattgctgagataaatcctgagggactgtaagataaaagttgtcccaggatgtttagaatggttgctgggaaaataattcctgtttaggcaaaagactcctttctgtcttacagcacctcagctgaagcttgtgacttaaatctgatgtacgaaggggatgttagttatgaggcttgaatcctgggtgcagattcaccaccaatatgtttattgtcagtgaagtctcttggtttaagaaggaagtttcttgattatcctggtttttttttttaattggataaaatgggcatatgccttatatctgtcagttctagtcccatttcctgtggaattcttgggatgctgagcactgtatctttgtactattaaaacaaatttaaatctaccatggacaccattattttgcttaatgtcaatcttgttgcttcctcaaagacaatagaaatctttcctttctctggacccttaaaaattaattgggtaggttaattaagatatttccttaatatttccagattaagatattttgttaatatttccagattaagatatttccttaatatttctagattaattgtgtacccaattaattggttacacaaacatacagctattcctgattaatgtttacttttttcttacaattgtaatatattggcttctgtacacacacacacacacacacacacacacacacacgtttctgatcccctcatttacattcttttaatctttaaaaatatctgtgcatatgtgttgtcatatgcatgctattaaattgactacaaaactgaggattagagaggttcaaagaacttgtgtgcataaaagtagaaaatacttaaggtataaacatcttggtaaagccaagatttttgataagctactgattcttggagaatggaagacagtgtgtgtaaaagcttagtgtgctttgaaggcatgtgagacacagtggcaaaaaaagttttaaaaaatgattaataataaataacatttgtgttgaagaatcagttcaaactaactcattaaacatgggattagataaaatgattgatttaaattttcagagcactcagctttgctgagtaactttcgtctacatttcaatattaccattatacataatgggaatatgccaataagattagttggacacaattcccaaattttatccatatctttaggtgagactaaaagtagaaagtattccttaaaattcacttccctctcaagagcatacaagtttggacttgatgactacatgtcaggcggttcccattttggcttggcattttccattagaaatgattttgatttcctttttccttttttacagaaaattacaagctagcaaatctattgtttcagataaaatatatgcatatatattgtatataactactgaattatctacaaaaactatacatttgtacataaatgtgtgcatatagatgtgtgtgtacatatatatgtctatttacaaaatgtttttcacaggcaagaacagcagcctcacacaaggctttgaccagctcctcctttttttcagtaaaaagagtattagataagatgagaattgagcagaaactgagatgagagagtcatagaattcaagtattcctgttacatttctgtattacattttttacaggctaagaaaagagactgttcaatttaataatataaaaaatagaatatgttcaatttaataatataaaaatagaatatactctgagtagttagtaattctttcagaaaaataagaaaagataattagaaatctggttaatatttgtggtatttaataaagctagtaaatttcaattccagtcaccaaacattagttaatctttttggtttttgctggtcttataaggacttatctggaaaaatgcttataataagatttcaaggattactataagctactcatcatacataattttgatgctatgttttttgattaattttttataaaattaattggtaaatggtatagaaagtaagaatgacaatagatggttcatgaataaatggtttcagggtcaaataaatggtttcagggtcaaataagttaaacaaattaaactaatttctgatgaatttatcaattttttatgtaactattcactgagaatttccaagaagggcatatgagcatatatgttggctccattattgttagccatactgtcatccctgcttccctccaatcctgaccaccatccaaatcttggccttattattggtatcacagatttaaaattttaatgtagactattgctcttgcaggttccatcagagcgagttttatttctttattaagattgtaatttcctttagggtggagattattttatacttccccaaacaccccatggtccctaaaacaatgctacctacatacacaaaaattatccaggcacttttattgagtggttgattgactcaatagacttctcacactgttgagtactgaagacgtaaaagtgaaccatacatttttgttttgtggccttaaaaacctcaagtttaatgagaagacacaggcaactagataatatgcaatatcggatgtaaaggtaaaatacattagaattatgaagttgggcagagtttagctagactaagacttttagacacatcaaggaggaatggacattagagttgggttttgaaacctgagtaggtttgctaggtggagcagcaatgggagttccttctccctggaagaagatggatagaaagagaaatgaaggataatccagatagaaacacagcatgtcttaagtcttaagatgtgctgttgtagaaaatagttagcatgtttggagacttgtatatctgggatgtctggaaaggagaacatatgtacagaagcagaaggaatgatggtcaaatagttaggttagggttagtttatgaagaaccttgtattctgagtgcatgagttcgtatttttttcctgggtggctgataacatagtgattatagtatgtgaattgcagaatcagactgagttgggctctaatatgggctttaccaattttttaaggaagattaagtgagcaatcatgcagataaagcatttgacacagtgtctcatgtatctaagtactcaataaatgttggctgcttttataggtaaacatgggagaacatgaattttaaaacagggaaattatatcattgaatttattcttttgttatcattagattttgttttacttacttttccagaattgatttttgagcaaacaaccatggtggcagggtagagaaagacaagacaaaacagtaaatacgtaaaaaacaacctttctaaactgggtggccttggatagtaagagcacatgctaaaatttattgaatgcctattgtgtgtcaggcaatatgctaagtgctgtacttatataattccatttatttttcacagcatcacagtaagataagtgctataatataatctgacgtttatagaaaattgatattaaagagttgaaatgacactccgtggtcacacactggctagtgccagaaccagatattgaagttcctttgattttagatttttcatgagattgctctactgtgtatgttattttatttccctgatcctcattttcctgtgtgtagcatgggaagaaaaaaaattataccttctttatatgttcttgggagaacttaatgcagaacctccatgaagggacttagtatagtgtgggatacatggtaatcatagcaatgttactaattcttcttcttcttattttttagaatatgttagaatattaatatggaattgattttggagataaataaagtgaaggttattgtagaaattctaatctattctcaaaaaccagctggcttctattgtctgtactggaaaggcagaatctttctcttatctatggagtttaaattatataactacatgccttacactttctgaatactcagtttacatctgttattatgtgttattctattacttttaattctgtttgtactggtacaaactatagcatgtggtaagaaatgggcacttaatctgaggcataaactcccctgtgttagaggagttttatattgcattgcagttatctgtttttctgcctgtttctcaatacactgcagattttcaagggcattagtcatatcttggtcatccatttatctctagagtcttttgagtccttggttcataataggtgcttaataaatgagctttacctgaaggaagaaataattgaatgaatgaaaggcaatcctaacacaagacattgtatttggggctatctgaggtcctactcatttaacaaggactattatgacatgactcttaccaaattctccaagcctttattaaacatatgtacctactaaaattagatgctgcatatcacaggagaaaatcagttactcaactaattgaaagttaatagtttgcatagcttatatcacaaaagagtaataataataattctctttttgttcaaaaataaccccatcccaccctccttccttctggcactggagggggactagagagctgtctatttcatttgactgacggagcccttcctcaaagagagactaggaggctcagaatgtctttgtttctccttcgtggcctacatcatgagcacatcagaaagcagattccagccaggagtggtggctcacgcctgtaatcccagctttttgggaggcctaggtgggtggatcacaaggtcaagagttcgagactagcctggccaacatagtgaaaccccgtctctactaaaaatacaaaaaattagccgggcgtggtggcgggcatctgtaatcccagctactcaggagtctgaggcaggagaatcgcttgaacctgggaggcagaagttgcagtgagccaagatcgcaccattgcactccagcctgggtgacattgcagactctgactgagaaaaaagcaagcaagcagattccaagtactccaatgccatgcccctgctgacacagaagataataacattcagtgttgaggtttcagtcattcagtcattcctgaggctggaccatcttgctagcaactcacatggtaacagtgtttagagaatttcagttcttagagccacctccctgtttaggactctcttttacttctcctgcaatcaggaggattctgctctgaatcacacttagactgtccactgtgaaaatatgaaaagatgacaagttatactatattcagacatgaggttaaaaaaaaagcctcttcacataaagggaaaacagcaacatatttcaggaagctagtgtgctatggggacatgttatattctcattcctttcccagcatgagggttgagggaggaaggcagaagtaaaggagcatctgtctaaggccctgctaatgttacagatcagaaaatagtgctctgctctgcttcaactgtaaacactgtgaaatgctttctttccccaccaggcaacttggctctgggataatcatcctaggcatgaattcatagagtactgtccattctacagcttcattatacaaaacaggcaaatgagatgcagagtgacactctcggttttctgtggttgtttgagctccccttaacccctccctggaactagctattcaataatggccacagaggagtcccagatgtttgcagagtaaatgtgatgcttggctttgactcctggaagcaatagggggtggagtagggatgaattacaaagaaaggccttattggttgacgctaaaagtacctataaaagtctcacatacatagagttaacctttcttcagcccttctattccattcctgagtaagcaaatttggattaactacttcaaccccttacttagaaacggcttccatcacagttatctcctctctgacagctttctcttaatgttcattttaaacttatttctcctggataaatatgtgtgtgcaggcatgtgtgtctgtatttatgtgaacaaatgtgaagttggaaaaaaagataccaagaccttgtgaattttgacctctcttttcatatgtctctaggccttttctactccctaagggaaagcttaagcatggcaggtctctcttctctctctctctctctcgctctctctctctctctgtgtgtgtgtgtgtgtgtgtgtgtgtgtgtgtgtgtgtgtcagtttttatatagtgctaaagaaatgagaaggaagagatactaggaagggaagatcatttgttcccaattaactctgcttatctgtgtggctgaggtggatgatctaacacaattgtatttatagtagtatgcattattcccctctcctccaccaggatatatcagtgtaataagcctttctattatcttggctatatccaaacaagtgaggaaacaaaaattaaatgatatcttgcggttgtagagaaactcagaccattcttgctggagatacatcaagtgaatacctttgtagatctggacctgacccaaggaagcctggtatgtttatctgggatctcctactctctgtgtactaccctctctgtccctttcccctcattctcaattaagacagccttgagcaaatttaatttctgtgatgatcagatctaaagctctaagtattgactaaacactgctaagagcatcgaattgcataattgagaccaaatgcttgccacaaacagctccatgtcatctcctacatgaatggattactctaaaatatcagttcatgcactggcttctttgagatgacctaggaaacttgttacatgacagattcctaagttgtattgcccaatattttgcctcagtctgtttgatagtcagctaagtttgccaggtttgggaactccagttttagacctcaaattagaagtcactctgggaagagcccttgagcactcatttggtgaagtcactttaaccttgtccagcttactctggtgctgtttgcctaattttcaaggatatgaattatgctactttgttatatctaagtggaaggaaaataggagccccaatagcattctgttgagtcacttccacaaaatgatcctctgagactcattttgcagatgcactgagatccaaagatagctgtataaagggattgtaggcataaggccatcagatacaccaaagtacacacatatatgcctacacatgtacacacactatcattgccttgtctctgagaaccatagacaaagttggccaagcccttggccaggactgttgtgaatgattgctcaaactgtatgctgaacagttctgggcaccattttcatagactgcaatatgaatagtccaccagcagttgtgcaatatggtgggccttggaaaaatgtagttattattttgaaaataggaaggagcccaccactgaggaagcaaacaaaatgtttgtggtgaaatttcaacaggattatcttcttgttatgcaattaggtctcaagctctgctctcagcacatggacatgcatatgcacatactctacttattgaatttttccttttctctaatccaggatgatttgcaaaagttttccttccatacctctacaccacagatggattgagaaatgtcacaacaaattagaagtgaagagttaagtcatggcaagtgactcctcaactcaaggctccttcaacattctggaactgtttaatgtcaatcttgactttgtctccagggcccttttcttttcttttttctttttctttctttctttctttctttctttttttttttttttttttttgagacagttttcactctcgttgcccaggttggagtgcaatggcatgttatcaactcactgcaacctctgcctcctgggttcaagcagtcctctggcctcagtctcctgagtagctggaattacaagcgtgtgccaccatgcccggctaatttttgtgtttttagtagagacggggtttcaccacattggctaggctgttcttgaactcctgacctcagctgatccacccgccttggcctcccaaagtgttgggattacaggcgtgagccaatgcgcccggccccagggcccttttcttaaaaccaaatcccatgcaataaagcacgtttatttcatgcaacacagcttagttaatgcttatacttccaaatactccggtttactaggtacaactcaatcaggagtgcctagtataaaagaacatgcacagcacagcgacagagaatgttcatcaccaaacacaaggaagcaaaggagatgcaaagctatggtagctagaggaggattagctttcctgatttcagtttgagaaaagccacttgtctctacagtccactagtttggcaaggcatttgcccttggctgtgagatgatgttacattcaaagtaaggtatattaatttccaggcttgtccaggatcaggggctggagtcttccttcaatagtaatcctttccttaaaaccagttctaagctttgtatttgttttattaagtgattggatagccctgaaatatgagtttcctccaatctcttccactttgcaaactccagaaccgtttgaccaataagttaaaacccagaggaggactgactgtgagctaaggcttcagacatgcaaagcgcacaaccctgggaaacagcagcatctgggacaggaggctcccattactacacatgagggtgtcataggttttgcaaatcaaacacacatagaaaaccagtagtagcctgggttggacacactgtatgagttgcacagttgagtgaggacccagaccagggagccacatgttcctctagcttgcatacatttatttcacaccacctcaggccactcatagtttgcttacctgctcattgttgctctcccaccattccccatactccctttgggggtgaaacactctatttccgacttgtgctgggccagtctcctgtctttgtacctggtgagcatgaacaaggacaggagcaaacagaaagacgtgattgtgtgcttaactgccaggctgaggaacggccgtgactgtggagatggtcactctgtgccaaaatgggggttcctgcttctcaatgcaatgaccaacctgtgatacttattagatgaatgtgatggcatatggacaacatcagggatgacgttgttactttttggttaaaccacatgtaacccattctttcacattgcctattaaactgaatatgtcacatttaatagtcaatggtaaaggtgtgcaatttctagcatcttagaaaaagatgaatatcaatcaacacattagaatctattcagtgcttaccatgtgtcagacactatgctagaactttacctaaattgtatccaggcaacagccctgggccagaggctttgttatcatttccattttactgatgaagaaacctaagattatagaggttaagcaaattaatcaaagattagttaattaaataagtggttgggctggattttgaatacagggaatctaagtttagaacccacacttcagccattataatgtgttgccttccattatcaagtttttaagctaattattatcttgagcaagccctcattgagtgataccattctggatgttgttagacattggcaataacagaggagagaagacatgttctttggatattaaaagtttctgtaaacattaagctgaagttttactgtcagtattgggatgccgccattatttttgtattataattggcagttcaccgcgctttgaagataccagatatttcatctaaaataagtgatgagattcccaatattactcttctacgtggtgcatcaagatgagttcttgtatctcaatgacagttttttgagctaacatgatttcacagaaataacctcttttactcattggttcgattctgtaaggtttttaaaaaagaactgttatttccatttgccagatgaggaagctagatttacttaactgacttcatgaaagtcacaagcctcatcagtagagaataaccacctgtagagcttgcaggggcccagagctcttaaggttttattaccttttccctaattaaactggagcctggtataacaccacttcatccaccttcctggtatccagtaggctatgataaagggagttactataataagacttgtttatctcagtacagtcacactctttttagtttattttcctgctgtttcaaaagtagtataaaataaaataaaatgcaacaaagtcaacatcattattgatcctggggcagaggccttcctcttaattttttttcccttctaaaatgtttaaagtatctagtatttgaagaaaaatggcttattacatcaagcaaaatgaatttaatggattacctatttaacggacattagttgagcatttattaaatcctaggtaatggactttgcactacagatgtaaagataagtaatctgcaggccccacctgttagaatttacctaacagtaggagaaggaaggaaataagaaatacgtacacaagtaattttagatgtaggcataaagaagagaggaaaagaacttagagactttgttaaaggaggtaaatcatcagaccaagctagattgagtagacttaattttaccaagaaaataccttagaagtaccaatggccaaatgatgctcaatgtttcaatgcaaagtattttgtgcttctttgtgaattggattgctcaagcaaaatactgctcgacagctcaaattaaaagaatattgatagaataataaattattggtggtcattcacttccttacaaagggatccttaacatatttttgaatatcttctgttaggctaattgtgaattaatcattaaatatttcatagatgagttaagaaacctacagtcttcatgcttataagctcttctctttctttctttctctcatgaccacacacactctgccaggtgacctctgtttatgaaatatggaatagatcctaagcatcttattctatcaaactctaacctctgtgaagaaaaaggaatgcttacacactgctagtgggaatggaaattagttcagccactgtggaaatcagcttggcaatttctcaaagaacttaaagcagaactaccatttgacccagaaatcccattactggtcatatacctaaaggaatataaatctctctatcataaaaacacatccatgtatatgttcactgcagcactattcactataacaaagtcatggaatcaacctaaatgcccatcaacggtaaaatggataaagaaaatgtggtacatatacatcatagaatactatgcagtcataaaaagaatgagatcatgtcctttacacatgaatagcacaggagggcattatcctaaccaaactaatggagaaacagaaaaccaagtacttcatgttttcatttatcaatgggagcttaacactgagtacgcatggacacaaagggaaaaatagacactggggcctccatgagggtggagggtgggaggagagtgaggatcaaaaaactacctaccagattctatacttattacctgggtgatgaaataatctgcatattatacccctgcaaaacacaacttacctataaaacaaacctgcacatatacccctgaacctaaaagtttagaaaaaccatagaaacaaaacaaaaaacaaaaacaaaacctaactgcttttggtaaaagctttcactgacatataaaaaacaaaataatgaaaattcaaaacaataataacaaaactcattttaaaaatgtgagcaatatcttagactttttggaactttcaagcagtttttgtattcaatgcaagctgaaaatggcattaatacagaatgggaaactcatcattgctttcagataggaccctacttgcctgtctgtacctgtaattatattcaccagatatttaaatagatcatatttttattcattcacttactcattatcccatttaccagtaatgtgctgttcaaaattactaatagatttaatagtctcaactgttgagtttaaaaactcaacatttttttccagttgagtttattttagaaatatggaattgtcaattaaaaatagtttaagcttttcagaatttacagatcatggaatatcaattttaaaatttcatttcttttacataataaatttatatatcagatactaaaacacccatacactcatacttgtaaggcactgtttcaagtgctttgcaagtattaactcacttttcaaatgaaatgtttaatttactatatttatattcaaagttataataaaaagtaataatgacaaaatattgagcatgccaggctgtttgctgtacactattgtaaattattaaaacagccatacaaagcagctgctattattctcattctgaagaggcagacactgaagatcagtgtcagtaagcccaacctcatgtggtttatgagcagggagcccaaggttaaaaatcaggtttctctgattctaaagctcatgctatttccattaatttttcctccaagtaacaatattactacgtttaaaaacaaaattacaaaagcttattatttaccttttctcttcttgaccccgttttgcaaataagtagcagagttatcaagtacaggcagtagagaatctagtgataggactttaaattttgttacttcctttaggtccctatgcctgtaccaggcaggtttagttgacatcattcaaaaccgtttactgaatagtccatgtgctgggcactgtgataaggagcatatgggtgattatgtcattgataaggtcacagtcttgaatgagaagatgaaatgtaaacagataatttccaaacaatgtaagaagttttattatagaaacaaatacaagaagggttacttaacccatactagattggcagagaacactttagtgagatatgatacgtaagacaaatctgaaaaattgagcagacatgcaccgtgaagagaaaatcaggtgcaaacatgtagagaggtttagcagcatggtgtatactgggaaacactgtttagtaatttttattgtaagaagtataaaataggaggtcaaaggggaaagcagatggagaagtatataaaaatgatgaatttgcttgttgattatgagatgtcattgtggaatccttatgctacataaaacaggatcagagttgacatttagataaaatgcaatggacttgaaggaacaaaactagagagatagagaaatactactacagttatgcatgtgagagatgataagctaatgcttagggtagcgataatacagatgaaaaatagagcacagtctcaagactatttgggaggcaaaaatgagtaggatttattggatgatgagtataataggaagaagtatagaatgataccccagttactgtgttggatggtgcagttaactgagttaagaaaattcaagagaaggagtatatttgggcaaggaagtaaaaagcttcattttggaatatttgatttgagatgctggtgggacatccaagtggacatattcagcagacacatgagtataaacatttggaggttagaggattgttatacacaggggagctctcagcataccgatggttgcaaatacaatgagaatggttgaaaatattcagaacaggaaaactatgtagacagtggaaagaagaggtgaatagccatgctcattctacctgtccaaaaacttttataacactgttagtgtaagcattcccttaaaacatttactggaaaaaaaatctgctgagtgccttgtatatgctagacatggagtttaaggctcttcaatcttgtaaacctgtaagttttcttataaactatggatttctagatttatgcctaatacagctttgacactttagtttataggccagaagcttggcatgaaaaactctcacaatagatttaataaatttcagaatgacttattctgaaataagttttgcttatcttctgtaaagatttttgttgttgttgttcttcttcttgtaccttctttgtccaggaagttctagctcttctgtactgagttctacaagagcctatactcatctggtaaatctaaaagatgtgcaggtaagaataacttaggatcagatagtaaatgtaattttccattattatttggataaaaaatttcatttcttcacctcaattcctctttcctaccaatatctactgaatattggattactgaaatttctatattggctatgtgattcagaatacataaatgagtgcagaatgaagtgaaagactagaagaaaataaacaagtttaaataataaatgtgtatattaggtgaagtagcagatagatggagaattgtgcctgaagctggcagaaaaggagagattttgatattggaaataatgatgccttatgtgaggctgatcaagtttgagtaagtgaccaggaataggaacattaaaatgtattagaactggggggaagaaagaagcttggtactcatctgtcctttatacaagcactaaattcactcagaatgatagccgggcttgggatagacagaagttctttatccagaagttggcagtaaacagtagttataaatgaagctaaaagatagagggataactagattccatgagtctaaattcagtcagagctttaattttcacatttttgtatgtaagggtgtgatatatgcctggaagcagcgttgagttgctgacctccatctctgtgtcctgtgaaacacgtgatatggaagaataagaaactttacttgagagagatatggcgtagaaatgtccttaggagggaattgggtttcaatttaagaaaacaacagtaaatggagtgtttagtgaagcggttgaataagaaggggggtttaatcattaaataggaattatagacagggactctatatggtttggaagggaaaggtcagtggatgaagcaaagagcaatatatagaagtagaatttacaaatgtgctacaacttatgagatgctaggaagattccattgatgaattctttcctcatttttctctgataccaaggagcaaatgttctccatcctgtatgagtgaggacactcaagatgcaaatgctgttgtgagtatcccatggcatacttagagacatgttttctcatagaaattgcagactctctgagaacatatttggttaaaaatgagtggagaaagagcctaagtttcctagagagttcaagaatggaggggaaaaaacacaaacacagcaaataagaaagctaaaggcaccagaggcacatttcccttactccagttttgtcataggcttatcctgctccaggttttgttctttccaatagataaaattgtcttaaaaaataattttctttcgccactttctctctcacactgacatctactatggcccgtagtcttccccttgaaggagcattgtgctaagccttgtgagcacttaaactcgttttccattcctaagctagctgtcattcagcttagtgaaaaccacagggagatattttcttatatgtgtagaaaccacagtatacctattttacttcatgctataatgctttaaactattcatagaaaaaaacagcctgatttctctaagaagtctgtgaaagcgagttggaaaatgttgcatatttcacatatgtcttatgtgtaaattttagtaactcaatatggaatggacactaatgaggcaggagggtaagtctggggagtaagtgggtaggagtgtgttcttcaaggaaacctctcatttaaaccaatatagatgcatcccatttacaaagcaaatttaaattctctctttcctcaattactttttattatttagaatagaagtatggtatgagcagagaaaaacaatatgggaggaaaagagtctttttggccaagaaagtgccaaaaatagtaaaagttattgaatgagggacatttgaactatagtcatatgacaagtcactgtgaatgttacagaaaatcctataagggattttcataccaaaattgcagtaaagatggcagagttttaggactaagcttgagcataaacatggaagtgcagagacttaaagaaaaatgaccatgtgaataaaccctaaacatagtgcctccattatgtaagccctcaaccaacattttctgagggaatacctccatgaataaatgaataaaatggaattgtaactttagggatgatcaaatctccaatgagatttgctgttgttatttgttttgtttttaataataaatacaaactgaagacattctgtacatgttggtcaagagatcaaggaagatggaaaatattaaagatgtttacagaaagtggtaactaatgtacagagttttgagataaagtaattgtagaaaaaaggaggaaagaacagacttttttgtaatcagtcagcatatactgcaggctccatctgcaaaacatacctaaaatctgaccatttctcaccagtatttattaccctggcccaagccaccaatacctgttaaaattttaacagtttctcaaactggttctgctttgtctgttactaaatttccccaacccagaccaaacccattccaacctccacccagcaagcagaatatcctgtcaaaatagaaatcttttcatatcattcatctgctcaaaacgctgttagttacccatttctctgagtaaattatgaaattttttatcatggtttacaaatccctacacttacctcccactccctgactatctctctgatcccaaaagtcactttttctcccttgctcacattgcttcatctacaatgatcttcttgttgcttgaagacaccagatatcctcccagcatagtgtctttgctttggccatttcctctgcctttaatgctttcattaaaaatatcctcaaagcttacttctttcaaatttttgcctaaatgtcactttctcaatacatcctgccagaccaccctatttaaaaaggcaactaccactctactctttctgttaccatttcctgcttttatcaggaaaacttatctaaaataatttatattttacttatttattttatttattctctgttttcccccagtggaatctgtgatagaatgcaagctctatgaaggcatgggttctgaaccgtatgcttcactgctatcttcccagtgcctatgatagtataggtaataatatttattgaatgaggtatgcatgaatgactgacaaaaaggaaaattaaattataaatttccaggaaatttgcataagtaatgaggagccaaatgttaatccccaagacaatggggaaaatgtctccagagcacgtcagaggtcttcaggcagccccttccatcacagatctggaggcttaggaggaaaaagtggtttcgtgggccaggcctcgggtccctgagctgtgtgcagccagggacttggtgccctgcatcccagccactctagttatggctgaaatgggtcaacatagaactcagactgtggcttcagaggatgcaagccccaggtcttggcagcttccatgtggtgttgagcctgtgggtactcagaagtcaggaattgaggttcaggaaccacctagatttcagaagatgtatgaaaatgtctgacgtccaggcagaagtttgttgcaggagtggggctttcatggagaacctctgctagggcagtgcagaagggaaatgtggggttggagtcctcacacagagtccttactggggcactgcctagtggagctgtaagaagagggctgctgtcctccagacgccagaatgtagatccactgacgacttgcactgtgtgcctggaaaagcggtagacactcaacaccagcctgtgaaagcagctgagagggaggctgtactcttcaaagccacacaggtggagctgcctaagaccatgggaggtcacctcttgcagtagcgtgacctggatgtgagacatgaagtcaaaggaagtttaatatttgactgccctggtggattttggacttacatgggacctgtcacccctttgttttggccaatttctcccatctggaatggctgtatttacccaattcctgtacacccgttgtatctaggaagtaactaacttgcttttgattttacaagcacataggtggaaaggagttgccttgtcttggaagagactttggactgtgcacttttgagttaatgctgaaataatttgagactttaggggactgtcaggaaggcatgattggttttgaaatgtgaagttatgagatttgggaggggctggggcagaataatatggtttggctctgtttccccacacaaatttcatcttcacttgtactcccatgattcccatgtgttgtgggagggaccttgtgggagataattgaatcatgggggcagtttcccctatactgttctcatggtagtgagtaagtctcacaagagctgatggtttgataaggggaaacttgttttgcttggctgtcattctctctttgcctgctgccatccttgtaagatgggacttgcttctccttgccttctgccatgattgtgaggcttccccagccatgtggaactgtaaatccaattaaacctctttcttttgtaaattgcacagtctcgggtatgtctttatcagcagcatgaaaacgaactaatacagttacatggaagatacttatttttttaagatatttgcctttcctttgcattgtcacattcttcttaacaagccatcccatccttaccttcacgatgtagacactgattagactaagatgataatagtaattatcagattcacttgccactttactcatcagttttagccaatgatcatgggagagagtcttctggagacttctgagaacgatttctttagtattaataaaacactggaaaacatagtctctttttctgtggacagtggtctggatgtgatacctgacaatgctccaaccatatggcaggcatgagagaagctaagccaacatttcaaaaactgtggtccagtgattcagtggtagactggaaaggtcgaaataagtaggtccttgagccattgtgtcctttgagctactgaattagcctttttagtgtcagaaattctttttatgtgagattaatttgttatcatttaagccactttgagttaggttatagactttctgaggctgaaatcctcctatctgctatacttggtttcattagtttttcttccaaaactgagtctaagaatttctgaaattgttatagcatttacttaggtttgactgtttataaatactgtgtgtgtctctctgtgtgtgtacacatgtgtgtgagtgtatatatatgatgaatctaaagaagttactactaacaaatactttagtgttacttagatgtttgtgttcttttaaataatgctcctttctgtatgtaccatttatataaaataagtgtgagagttaataagttagatttgtaaggagcaaaaaagagagagatcgattgggtaaaacaaagtattattttctcaataatccacacttagagaaagcctaaacaattggtccttataatcatggaagaaacacccttgttcatttcctgaaagctatgctagttacagtcataaccagttactgtgggtttagtgttacattcttaaactgattaggtcatgggaaatgattcagctcatagtactgaagccttataactactctgaaaacgcttttgttcacatatattgaagaattggcatgggcttatacatatttaacaaaaattgtttgcaattatcttttgtgtaatttgaataagaaggtgtcacacacacaaaaaagaaaatgaacctcagtgggcttatgtgcttattccttattagtcagtgacagatccatatacaagtaatcctggctcaactcagtgatgatttaggagttctttccagccaccatcttctttgagaccagttatagcaaattttggagccagtttttatttgttagctctctctttccctttgcctccctgccttgagacagaatttttctgactttagtttttaatcttgactttgctgtagttattgtatccactccccctttgtaccaacacaaagctttataacagctttgagcacattcaattctgttcccatgttggttccttgaacaccagccaagacctcagcttttcgacctcaggtgaaatttggatcaaacatctacctctagatgatatctttagtgatcacccagaaacacagtttataattttaaaacatcttagggaaaatatatgaggtagaatgctgcacattgcatcttattctacagatttattgccacattccttttgggaccatcctaattttggatcttggcagtcataaagtgaagagagaaactatggtgtaatatacttttgaatagcattcacattattatagaaaaactttccctatatcatttaattttcttaacaaactcaggaatataattatccccattcagcagataaggaaactggctcagaaagcttcacaatttggtcaagaccccatagcttgtaagtctcagaagtgccactagaaaccagatgttttacctccaaatctcatgctcttcattaacaacttactttttctttatttcatgcttaaaaaccccttatttaaataatctgatggcacatttgagagactgaaaaggtcgtacatgaagttaatagtgtatacttagtggagctaggctttgagcacaatatacgcttattttttaaaaggtcaaatttgactacataatggtcaagtggaataaatcaccctctgggccccttgttaacatgcaaacagattggcatttctctggctggagttttcctagacagaaatacaccaaaaatctgaaggctgtaaaagaggcatcactaagaagagctgacaatcagtttcgatgtgtgggatacagtgtgatagcagaagacagacagggacgagatggtagaatattttaacaacttcagagtgttacaaagagagctgaaggaaagcccaagtcagccttccaagtctaattgatcagaggaaaattctagatgaaggcagaagggaagtcattatggatctttaggttagagggaaacagtgaagccaaatttaaaaagatcaatattatgcagtactattgcaaggtaattcctttcttcaatatcatctctcaaccttctatctatctatatatgtaaatatattggaatgatttactagatattccatcagatcttgtggtctccgtgcgcagaaaaacatcttttgcacagacttgaaatgtcaacttgattccttcagataaatcagattaaaaacaaaaactgagcatgattaatagctccagaaactaatggcaaagtgaagataagctgcaaaatgatttgagaaattgccaggtaacatatttcactgtgttctgtgaaaataatggaaaggtaaaagctgaaaagtggggaagcaatgcaaataaggaattaaaaagtaaaaaatcagctgtattgacttagtaattctaggaatttattctaaggaaacaattcaacataagctcaaaggtttctgcacaaagattttttccttcaatgttatagaaaacagaaaaaaaaaaaaacctcaacaaaaaagaacaaaccaaccacgggagaatagtttaataaattacagcatagcaatattatggaaatgtgttaaattttgtattgagtaaagcctttcatttagcttctgaagaattcccaaaggatgtattttaatcctacttatgatgagagcttgttttcagatatgaatcatcataagtcattgccattttattgtgtactttccttcaacattactatttgttacacaatcaatagaaattcaggaagatacagatttcaaaaccaatcctaaggtgctttacaagctttatacaacatcctcaatagggaaaacttttcagggaggaacaaaatgttaactataagaagggtctccataggaaacatttcattatggcattaattaaaagttgctagtttctatcttataggactgaggaattttcagacagataaccttactatttctaaagagagataggtagttttccaacagagatttttcctcacatttttatacatgaacaattggaaatgcagtgaagtcagatgaagctagataataaatgtaataagagccatcacttactgagcacttggaatgttccagacacaattctaagtccctgaatttactgatttaatcattacaacagtcttttgagttaggtactattattattcctactttacaaatgaagaactaggacacaggagatcaagtgatttgcccaggttactagaatggtcaactgtgaggtaaattgcttctcactaaaatgctggctacaaatagtagctgtgccatttgttaaacctagttctgtctttaaatggcctaagggatacaggtaactgtactatttttcaaaccttatcattttttttccccataatctccttggcttgagacactgcctatgcttttacttgagccctttctacccttttggataggaagactgattcctctgtgatactaactttgattaaaatttgcaccagcaactaaattttctcagtctggggactgatggagcttaaacctcagtggtgctcgatggaagcagatttgctctaaagctgatggagtatcagggtccctcactcacagatgcccctggcaaggccctgtttctatttttgtattcacattttgtaatctttttcttaaataaagctccccaagtggaaggaactttaggtctcacaaagcctggatctacttgtttaccagagtttgcctttgacccataagggaatcataaactgtgtttatgttcatagggttagttatgctttctgagttacaatttctccatatatacaatggaaatattgaggatcaggtaagacaattcatgtaaaatgcttgattttatagttgtttcataatgttcctttcatatctgtcattttcttctgtactaataacttctataaccaggcaggcttctcccagatagctctgatacaaaatatttgtcctgtttcctccacacaccccctaatacttatgaaatagtgcttcctcatacgagacataaccaatataatctctattaattcttttaagttaatgcatctttgattttcttacctccatctggacctacctccatctggacctacttccatctggatctgtctgctcccacataccctaatttacgctgctgcgatttaggctggatttgaaaatgatgtagagacaaatgatgctcttctctttacttgtctcagcctgtctcccctgttaatctgtatcagggcctattctcttccttcataccaattattaacaaattataattaaatatctgcctgactactagtttagtaactgtctttctcactacaccgtaaagtttatggctacctgggcacgtctgttcttttaacaagcatctaggatagggcctagtatagagcagcaactcaacaagtgaaatggtaaaagcagggacatttatgaaatgcaaggcagtactatttatctaaatctaactacatcaaaactagcctcccccttctatcatacacagaagttcattcaccagttcttgtctcaactaattcattccgtttgccaccctcctttctttctctagccttcttccttcacctttcttgcccttttaacccctcctgtcctatctcaatgcataaaacttgtctttgttttcctcattcctttgtctttggacaacttagaaacaaaaaaagctttctacatttttgccaagaagcttagtttccatttatttcaggatgtaaaataactggattttcacaagaacaagatgagatggggtggaggaaggagattgggatgtttcttttgcctatatacatgcgaggggtgaagactgaagggaggggaatcatgcttacttttgatagatgcagctgcccacgagtgggaatgacacccagggagagagaagcagttctggaaagtcctgggcatgcaattacaggtagccagtgtaagttgtgcacttacatggccatcaaaagaatcatctccacttcatgacacggggaggagggaactcaaatcacaagtctatgactagagattacctttccactgcctctattcttcatcacattgtctttatttttatttctattttttatttttatttttttgagacagagtctcgctctgtcatccaggctggagtgcagtggcgtgatcgtgatctcagctcactgtaagctctgcctcctgggttcacgccattctcctgcctcagcctcctgagtagctgggattacaggtgcccaccaccacgcctggttaattttttttttgtatttttagtagagatggggtttcaccatgttagccaggatggtctcaatctcctgaccttgtgatccgcccgcctcggcttcccaaagtgctggaattacaggcgtgagtcaccgcgcccagccccatcacattgtcttaagattattattttaataaaggtaattatatttctcctggtattaggataacgttttatgtttaattataatcacacatgattacaacagatggatttcctaattctgtcatttccaagcagatttccacactgccgagtgtctatcacaataaaggaaagtgagattactttaatttcacaatgcaaaatatccaaagaaacgtttactgatgtttcttaagtacttagtatttgctaggtcctaagctaggagtttcattgtgatctgttatagatattaggaatttatcatgtcagagtgtgataagctaatgcatgaagttaagtagtatcatctgtatacatacaagtatataagcatatataaatatatagacacagatacatgtatatacacacatacaatcacacacttatacatatataaacatacatatagatagatataccatagctcttcagatttgtctaacttgactgggctttagtttgcctgagatgggcaatatattatggaaattaagtgtactggatttggagttaattaacatggattttattctcagcaataccacttactagctatattgttatgaataacttatataactttttctcaaattttcttttcgcataatggaagaaataccatgtaatttacaggattgatgttttatgtagattttagcatttaatttcactaagacacttatatggtttggctctctgtccccactcaaatctcatctcaaattgtaattctcacatgtcaagggagggatctgtaatccccatgtgtggaggaagggaggtgattggatcgtgagggggagtttcccccatgctcttctcatgatagtgagtgacttcttgtgagatctaaaggttttacaggggctcttcccccttagctttctcttctctctcctgctcccttgtgaagaaggtacctgcttaacatttggccatgattgtaagtttcctgaagcctccccagccatgtggaactgggagtcaattaaacctctttcctttataaattacccaatctcatgtagtacctttatagaagggtgagagcagactaatacactatgagatatgtactattattatccccctttcaccgataaaaataactgaggcacagagtggctgggtagcttgctgaaagtcacacagttagatgaggcaaagccaggactcatatttgggctgttgaacactgaggcttgtattgtagaacactagattaaagaaaataaccaaaattaccaaaggcatggctaaaaaggaaaaaacaaacaaacaaaaatcaagtagagggcaaagaataaagaagagaaagaggaagagcaagcatacgtaacaggcactatactcagagctttttaaacattgtttcaaacattgtctctttacaaccctagggaggggtattgatgatcctgtttaaaagagatctattggtcacaaagtttataaatgttgatgttggaattcaaagctaggttcttctgtttgtaaatgatatacttaaacatatattgtgtattttctagatacctggcatagtacttggttttctacttgacatccagaaaatacatttcacagcctctcaactcaaggagcttagaatccaatggggatgataaacattggctgtcatagacaaacaaatagagcacactaaactcatggtaaagataataacacctgccgggcttggtggcttatgtctgtactcgcagcactttgggaggaagaggctggtggatcacctgaggtcaggagttcgagaccagcctggccaacatggtgaaaccccgtctctactaaaaatacaaaattagctaggtatggtggcacatacctgtaatcccagctacaaaggaggctgaggcaggagaatcacctgagcccgggaagtggaggttgcagtaagctgagattgggccactgcactccagcctgggcgacagaacaagacttcatttcaaaaaaggttaataacacctaggtgtcctagaatgaaaaaataaatctcctagaactaaaatggaaaatgccgtggtgtaatttgaacttaccctggcctgagaggcacaagcttggcacactgtgcacaacaactatttgttaactgcataagcgataagagctgattaagtgaaaagacatgatattctttatctgttacctttctttctcacatggggccttgtagagctgaccgtttaagctttctccttcaagcctaggaagagggcagggtgcagaatgtgtcattggaagaaacaaatgggtgcaagctgactgccttgcttgtgactgtcacgttcaccacaaataaaatagcagaaggtttctgaaggcagggaccatgtatgtatcccagtgcccacaacagtgagtggggcctggcaagactcaataataaaaaaagtgctgaatgagagaataaataaatgagaaagaaaaatattatttcagggaagacatagagaaatcagagaagaggaaaaaaaaaacccacaaccaggacccataccatcatgttatccttttttttttttttttgaggcctttcctgtcctctctcatcattatttccctttttgtatacccacaaaggatcgagttatctatacttccttactaacattattttttatgagtctgaatttattatgaagagaaaagttatctgggggaaggatggtattgtattcatttttatatctccagtgcctaacctatcatctagcccatagcagataacatggttgctatagcttgaaaatgtcaccaaaagttcacgtgttgaaaacttaattgccgtgtaacagtattaagaggtgggacatttaggggtgattttgtgagggctctgccctcacgaatggattaatgttgttatcatgggagtgggttagttattgggagagttggctcctggtaaaaagataagtttgtctcccatttgctctcactctctctctctctcacacacacacatacacatacacatacacatgctctcttgcccttccaccatgggatgaccctccccagatgctggtgccatggtcttggatttcccagtcttcagaactgagaaataaatttcatttaaatagtgttacccagtccgtggtattctcttatagcaacacaaaacagactaggaaaatggtgaaatggtacctgtttattatgattgcttgggtcataacattcactgagcagacaagccttgctttcctgtgactgacttctggtcactcttttctttcctagcccagccttgtgtttgctgtctggttcacattttagacttttctactccttgtattacggacttccttcatttcacaaagcttaacttcattctccgtaaatgtgtgcattgcctccttgtgtctccttgagtgaaactccccactaacctctgttttgggctttctccccactcctgtgaggctctgctgccctctagggggccttgttcatcacacacttctcagggcccagttggatctgcacttggcaatacagtcctagtgtaggagtgtcatgacagtgctgcaaagcctcagtgctccttttcctgctcctacagtccccagtataaaatgtgtggctatataatgcagttgatttaggaacattaaacttgggcataagcaagcaagaagtctgtcaagaactgaaactcattacaagaggaggctggaagaggctaccacagggtctcagtgctcttggtaccaacgaaatccttggctatgagtatcacacctgcatcttgatagtttgcacattatattaaggtttgcactatagaatccggtagccaactaatgagaatgttctatttgacgaatgaacattgatttacatctttgcctgggcctttgggagacaaaaaacttcctcaaagagatgggacctgaaattgctttttgctaaaccctcaaccaacatctggtttccatacccaatgatgactcttaactctatctaacctgactcatctgcaactggaactattgactacttcttcatctttgaaacacatttttcctgtcatgctatcacttgtatctgggtctcagttcttggactttctttatttatctagtctctgggctctgttcttggttcttccaaattgtgcttacaaacaaaccccaaactctcctaattattggtccaattttcttgcagtttcctggacttgttcacttagatgtctcttagaaattttaaatttaatagttccaaaaacaaacacatatttcttcaaacctattctcttttaccttacccaccccaatccaaattatttctaatttagtcctattattatcaaatgcagttggccccccctcccccaccctttgattctctagtctgaacctttctttgagctcataggacataatataaacatgtccaaacttagttatcaattttacccttcaaacctcttctccttgaggttgaattacacaggtccaaatcctccattcacaaaggtaaaatctagcacccatctttaagtattctcttttctttatacgcaacattcaatcagttattaagtttcatcattatacattctagttgaaaccatcgtgatttctcacctatcctgttgcaatggacatctgatttccctcttctcttcttgtcactctaaattttattctatctacagaaaccagaaagatatcttgaacatattaatcttatgatgtaactcctcttctcaaagcttccgaagcttcctatcacattcaggacaatatacaaaatatatattttgtatattgtctgatccccaatcctcacctagtctgatccccaaataccagtccacatttttctgttgtcattctctccttttctcattttactttaatcacaatggagtttttgctagtctcctaaaatgaaaatctgtttcctgccttaagatctttttggttgttgctgtctttgcttgggatacatacctccacctcccagaactctgtgtgtcttattttctcgcttcattcttccttctctttaacttattcagaaggctgttcatgacactgtatctaaacatatctaaaattagtcccaaatcaatttcactgtaatacctcatcttgcttctctttttttaatgacaattaatactatgtatttgtttatgttttattggcattctctctgactatagttgaagttctttgagagctgagattttaggttgttcttcattttatcctcaaagcatagaacagtttctggcacacagcatattctcaatgaatagttactgaatgtgctaatgagtaaagtcaagatattaaattatagctaaagttccccagaattgtcctctattacaatgacttttgctttgctttatgtttaataattatatatgttaaaacttttgttgcagtttgcttggaatttggctaaatggagttttcttttaggaagatgtatacacatatatatgttcatagccatttcagtgaatggtaaagtcttaatatgggccctatgtgttcaaaacttctgtagactagatagtgaagaaagactttgtacgtggtgtaagcttgatgcgtggggataaatttcatgctaatgagattcatgtaaatgaatttctgtaaattcaatgaatttactttgtagaaacagcaatgtacaagaacaatttgagtggtgagggagcttggtttatgcagaagattaatgctgaggagaagcataaggttaaattgaaaaggtaagaagagcaagctgaagatactatgaggaattgccagtagtgtatttttcaacaaaaatggggaggtattgaatattttttagttggtcagatgtattggtttctcattcttctattaattaagatgtatagatatatgatattcaattgtatagcaattgtgaaaattaaaatgaggatacaaaatcaaaacattaaaaaacagttttacctatatctgattaaaaatgggtaaattgaggaccaggaaaaattaaacatgattgcattttcagagtgggaagtagaaaaatttgttgcatttaatagaaaactgggaagaaagaaactattacaaatggatttatttgatataaaagaaagtgagtttggatatgttaaggttgaggtgatcccaggtatgaaagtggagctatctagttgtcatttgtagactcacaaccagaactcaaggaagactaatactccagaattgaaagtgtaatgatgggatggttgaattctccaaagaagagaacaaaagtagacagaactcaaggaccacagattgaccttagggaataccctcagttaggagatgggagactgcctcaagtagccccaaaccttatctttgtgcctgccgttatctcttgctggaatgccttccctatataagcaactcaaacactcccattattcttgtactcaaggctatctcctctatgagttcctttaatagatcacttgagagttgaaattctatacctgattccatcttttcagactgacaggcaaatatttttcagctaaagaataatggaggctataataaggcatagtatgaagagcacaaggagtaggctggcagtcatgggttcacatcagctcaataacaagctgggcatacaggctcaaattatttcacctgtctgagtctcagctttcacaagtgtaaaaattagcatatttttattttacaaggctattgtacaatgaaataagatataatatgaaatagcacacagtactttgaaggaacttgataaatatgttttcttctttaaccagccaccagatatatctctatgcctaccaactaatggaaatatttgatctacaaaatgccttgtgggaggtggggaagggaaggagttgggacatagaaggtgagaccaaaaatgtgtgtccaggtgattgagaaaaggtagaaaacttattttagccaaagggctagagaaaaggatattcctatctttttcttgtttaatttctttccttgttaccaaaggaatgctgcttgggagaagagagttgttaactcacagaattatgcctgaggcatacttttctctcatattaagtgttatgttctgaaggaaatatgatttgcatgcaccagatacggtgcagcaagaccacttctaagcaggactaatgtaaataaaaggaacatttcttgagacagaattttgaaaataaaactgcttagtttaccttaccattcagagaatttataacaattaatcaaaaacatttcaatcaaatttaagtagtaacaaatgaggccactaacatcacatgcaaattaaaaaaatccactgtaatcacagcacttaaaaatatcaattcattatgcgaagggagtgttttagatgcaattcatcaaaatcatccagacatagtctttaatagctccacaaatatacttcaattattacggagccaaaccatttaattaatcactacaaagcatttcttccctcaaaataaaacactttaaaatatatcattcataacattacaacctgccagatctaaatcttcttagcatttaccttctacatctccagtgagagacattaatatatttaaaaagtatattactaggcactagtggagcacttggaaagttgacttattctcttggaaaatgaactactattgagtgttgattcacattaagggaggagctaagacttcaccagagactagagaagtgaatctttgctggtcacccagcacatatttatcagataacttgctaaaaacaagcaccaaattagttgctgagggtggaggcaaagaaagcaatgcctgcaagaaatttacagtcaagcacaggggaaaaacatgcaaatcaatggtacaatataacctgatgagttttataggagatctagagaatctaatggaaataacagttgataaaataagtgaaacacttgggttaggaattggagagtaagaaggcattttctaggtaatagaaagggagataaattcaggcattagtagaggcaggaagaataccaaagaaatggccaggaggcctggcacagttgctcatgcctgtaatcccagcaatttgggagaccagggagggtggatttcttgagctcaggggttcaagaccaagtgggggcaacatggtaatacctggtctctacaaaaaatacaaaaattagccaggtgtggtggcatgcacctgtggttccatttacttgggaggatcactttagcccaggccatggacgttgcttatgccactgcactccagcctgggtgacagagccacaccttgtctcaaagaaaaaaaaaaaaaacccaaacaaaacgaaacaaaccaaaccccaaccccccagagaacaaacaacaacaacaaaagaaatgtccaaggattgttgaaattgggaactatatgcagtttggcaccgtgttatagtatgtgtttggaggctatatagtatggtatacattttatatagccatactatatggctatatagtatgtgtttggaggtatagtatggcactggtggtgggggctctaggggcttgatgtagcagactggtggctggatccaaggttgggaaggccaagtcatcaagggccaggtcactaaggctctgtgagccatgtgaaagagttttagatttttatattctaaggcatgtatacccgctgaactcaatttgagtattgaataatgtgattacattttcactttaggaagattacgctggtagctgctgggacagggtggtggatcaacaagagagatttagaaaattatgtcagcagttcagacaataggttatgaagacctcatccatgaagatatcagtgaaaatgcaaaagataaggtaaaattagtaggagaaatgactggttggatgtgaagggtcagagcaagtaaaatgttaaggatgacacaggtttgggcaattagttgaagttacagcttttatccagagaagaaatagaagaagaagaagaaacttcaatcaaggtctggagaagtgatgataaaatcatcacttaatttcttggtcaaaatagtattttcttctaatgatctgatttaaatattaaaattatccagattgtcaagtacacttaattctaaaaattgacttaagtatttctactaggtaggtgcttaagaaatagctgatgaaattgaactgtacctgaccactttctaaaatacatgttccacaacaactttagaagtagttttcatttgaagaaaggaaataaaaataaaactgataaaatgaaaccgtgtacttcatctgaatctgtctttaggacacacatccaactccgtgtaccaatttagttcaagtcagccctgcttgcattatgcagacatttcagctaagaaacttaaatgtgcttcttgtgtacatttgctttcatgaccaaaccatattgtcttcagacgttgactggattataatacagatgagtacttcagacagtggctttatatcttctgaaagagaaactgataagggagtgggggggataaaaaaagaaaacagggaaatggacagtcatttattcagtttatcaagaggcttaaataggaagattcctaactgaaatcaagttgtaatgatgataatttcccaaatgtctttctcaatactgacatttcattgattcctacaaattctttaccagtctttcaaatacaatcttagtgtttataatttctggtagctaagctaatggactctagagacaaactgcttagatttgaatttaaagtccaatcctttccagctgtttgtccttgggcaatttatttaacctcacatgtctcaacttccttacttataaaatggggatactaatgttacctgtctcatggggttgttttaatggttcagtgaatatctatgtggtattgacagtagtacctgctactgtcagtctcaatttcacatgtctcaatttccttatttataaaatgggaatagtaatgttacctgtctcatggggttgttttagtggttcagtgaatgtctatgtggtactgacagtagtacctgctacatcataaatgctcattgaagttagttatcattagcccctatcatcccctttccacatcctacactccactttcccttctgtgggttctgcctatttagacttcagctggagtgtccaagaacttgactttaaatcctgtgatagttgcaaaaacagtctgacttcattcttggtctcttttctcatctacctcccaccagcagacctcaacctcttcatacttgcattgagcacttacttaggtataaaatgttgcagactctgacatattaattttccctgatagtaaaaggctacgtgccccttcacaattcttttttccccctccagaaatgggatgagtaagcatgtgacaaggcagattcgattcttattcacaaggtcaagctttagagaaattgatacattttagtagattttagagctaaaattcttaacctcaacagttgaattcaaaccttagtttagccgctcactgccttgggcaagcttctttccctctccacacttcagtgtcctcatcagtataggggtctaataaacttttcttacagggttattgtaagaagtgaattagattaaacagagagtacacatgggcacatggtacatcaccaatcaatggaagatcatggtagtttgactctgaagaattaacactggaagcagaactcattgaattgtaaaggtattttcactgtcaaaagtgactggtaggaagatatttaggcaagccttcttctatggtgtgtgaggtgtatgtttttaaaatctagcatcaacattctaggaaacagctacagctcattttttccaacttttaaatgtcacatctttttttttttttgagtcaggatctttgttgcccaggctggagtgcagtggcatgaccatagctcactgttgcctcaaactcctgggctcaagtgattctcccacctcagcctcctgagtaactggtatgatagctgtctgtcaccacatctagctattttgtttaatttttttgtagcgatggggtcttgctatgtcatccaggctggtcttgaactcctggcctcaagtgattctttcccactggcctcccaacattctaggattataagcataagccatcgtggctggactgttatatcatttttatggttatggaaatgtgatatcaatgataatcagcaaaccaagagatgaaatttagaaatttgtattaggaatcttcttcagctggtccatctgggaatcagcacctctactcttaccactgcttctgcaaaagtttgtctctgctgcttacattgagctctctgtgcaaacccacagtggtagtctttgattattgctacacaagctgagtgcatcttgggcagaaaggctttctcactggagttgcccaaagaacttcgcctgccacctactggccaggaaagggacctggtcgactgactgctggggaccaggttaggggttgaggggagaagaaaaggaggaggaaaaacagtccatagactgttgacacacaaggtctgattcttctctagcattactgaggatggtcagaaatgccccagagtttaaaagctgtctgctcctctcagcccataactcgtagtctgtctggcactattctccctggagatacagtcacagagcagtgtctgtacagtgaatgcaattaaacaaaagcctctaaaaatttccaaggggaaattagataacatgtgctttgatgtagggatttggagtttgaaggtgaaaaagacagccaagacatcagaagtctgcaactgcttagctccagttcatcacattagcattctgctaacatgtctttttttgttgttttttaaagtttttcactaaagtcaatttgctcagtttttctcaagtaccatcggacattttaaacattctttagattaagacaagtcctgaagttggacttctgttgtgagtgaatgatgaaatcaatttttcttgtgtttttattagttaatcaatcaaagggaaaagtgcttgctagtccatttgggctagaacatttggttctcattttgctatgctggcaggccgtagctctgtgcatggatgagaaaagtctacttttgtcctggtccattctccagcaataagccgtacactcagctgtatccagtggctagatagttcctgagagatgtgtccacagttcactcagagttcctgttccccctcattttcctctgatgttccttctgtgccttttctgcattgtcataatgtgtctgcctgagtcagagcacaatgtctggtgtgcctgactctcactaatgggccaagtgtggtcctgctctctttagcttctaatcaagactccagtgggatccagagtaaaagtgaacaggccacagcataggggaaaattaagatggatggtatagcacagcaggagcttgtttatccctgaggaatataagtagggggaattggtagaacttgctctcattttcacaccttgtattaccacgacagtgatttactgagtatctactcagagccaacctagggatgaatatattcttgtcctcaatgatctctggtagaacatgcatgttggggggaaaaatacagtgactttctgtgtgatacgtatgaccaaagtaaaaccttgtaagatgtcataaaacctcacaggagttttgggtagggaagaccaaaatctcctctccttttgcctaatccaagatagtctaccttttaaggagtgttgtggttaggaaaggatcattcatctgggatccagatcttatgaagggtgtattagttttctattgctgctttaaaagttgaccacaaatttagtggctttaaagcaaaagaaatttaatatcttacagttctggagatcagaaggctgaaatggcttccactgagttaaaatcatggtgtcagtagggctacattcctttctggaggctgtaggggacaatccatttccttgtatttttcggcttctagaggctgcttgcattccttggcttctatacccttcctccacattcaaagccagcagaatagcactttcaaatgtctctccgactctggcaccccgcttccctcttgtaatatctttgtgatcacattgggcccactggataatccaggatcatctttccttaacataattgcacctgcaagtcccttttgccatgtaagataacatagtcacaggttccagggaatagcatgtgaccatgtttgggggccatcatctggctactaaagaggacttccaggttgatattattctatcctattacttcccttgttttattcatgctattgaagatgtaataagatttttttgtttaatttagcttttgtttttacagcaattctacatgatgatgctgagatactagccaacttatatcccaagttcttttctaattccctgttaattaactatgttcctgcatctggcactgatgcagttgtttgtttggacctgaatgtaggggaagggcaaataatcttttggattggacattggctcctagtgaggtgaaaaagtgttcccctcaaccagaagtggagaaggtggatgaagacttttcacataatctctgagactgctatggaatttaccagatgggcagagtggagagtatgcttaataaccaatagcaagcctcttataatggcagtgttattatcttaccctcaggtgggccagcaatgtcctagagtttaatgaatctgcaaaacaaaagtttgaatatggagcaaacaggaaggagggaacaattacccacttgacatatcctcttgaaagcttaccagtcatggtactgtggaaagaacatgctgtttggactcagacaaccttggatgtcaggaccatttgtgtcccttaccagctatgtaatcttagatcacttaacctccctcagcttcaagtttctcacttttaaaacagagttaataatatctgactcatatcactggtgtgagcttagaatatgtaagtccattgttctcaaagtgaatctatgttgtgattcctaacccaggaatgtcatcattacttggaagttccttagcaaagcaatctctctggccctactccagacaaactgaatcagaaactctgggttgggaagtcttaccccataaaatagtagtacgcaaaacacatggaaaagagtctcacgcgactggactgggacttacttaacaaatgctgattgtaattattcttttcactgggagcctcattatattcaccatgctttttgcttttcagttactgtttgttttggaagaacatggccaatgacagatttatgtttgtttaccaagttgtggtctctcttttttctcaaactaaaaagtcacataaataaatgaaagaaacagcattattagtttgtatttctggctgtgccgttttaactcagcagagggggagtcacgcactctggcaacttctttatccagaatgtgctgtcgtgatgccacagagcaaggctaggcacaaagcttatgcacctgagagatgctgtgactattttcttcagttgcttttttaaattttttgactaaatatacatgaaaaacataagcgcacacatacctcaccaaatacagcttcatattatatgatgcataaaatttattgcagtgatttatcatttagtttctatgtaattaagtaaagatggatccacatgttctgggccaagttaaaactcatattttttatgaagaatcataaatgcactgccaaaccacaacaggaatgagggaaatggctaaaactcacaaaccgcctttaaaccctgaggaaagtttgacttctagaaaagcagttaagcagaaacttattaacttgccaccgaaggatgtaatgaaaatttggagggccatggatccccaggatagagcaatgatttcctagtagttcaggcaggattcctgaagtcaaatatttccatgtcagtagcattctaaagagtaaagtcatgtaacctactcagattgtcaccaggactgtctattaggtggggtcatgagatgaccccaggattagtgaaaagaaaactcacatttcatggatatgaactgtgggacacattcttttcttttctttttttttttttttttagatggagtcttgctctgtcacctaggctggagtgcaatggcgcaatcttggctcactgcaatctccaccttctgggtttaagcaattctcctgcctcagtctcccaagtagctgggattacaggtgcccaccatcatgccccgctaatttttatatttttggtagagacagggtttcaccatgttggtcaggctggtcttaaactcctgacctcatgatccgcctgccttagcctcccaaagttctgggattacaggcatgagccaccatgcatggccctgtgggatacatcctgtattatgttcacagtggacctttgagcacaatacagagtgaaatgaatatttttgtccttattttctagaggctctgagaatttaagtgcttagtctagggtcctggcttataaatgtcaaagtcaggattagaatgcatgtcttcgctgacaaggctcacttccctataccacactacttctgtcaaattatgacatgagagacaccgacggctaccttgttccatcagggtcacttggactgatttgcctatataccaaaaaaagaaaaaaaatgttgcatttagggttatttctctgggactaaaaatctgtgtcaaaatatgtggcagaaatacattcatcatgaccttatttatcaacagtaacaagaacaaaatgagatacatgcttgagaaaataaatccaccagtaaagcaatgttggaatgaaaaagagctttgaagatacatagacctgcgtttgaatcctaaattttggttctaccacctattagttcactaactaaaggctattaggcctctatgtgcttccgttactaatttttctttatatgtggataggcgatgatagtttctattttaaaatactatgtgaagatccaatgagataacagataaaagtacttagcacagtatctgtcataaagtagttgctcattaagtgtttactgcataaaggatgaagcaagccattattaatccttatcatcatagcacagattaatttatctcttctctagcagagaggaggggaagttttgattgcatatggtgtgtggaggcatcaggctgatgctggggaggtagccatgagtattatggaattggatgtctaaagtgggtgttaagaagggaaaagaggcaactgaaaggaaattgggaaagctggaaggtggttggctgatggctccttgaggctaagcttataaggaaacaatagaggatcctcctctgccccttccctgtcagcttcatctcctgttacctgctgacacacattttacatgcttgtgattccctgcacacaccatgttgtttcatacttctgggctgttgctcctgttgtttcccagtatggtgtattccacggttttcacgtggcttaatcatccttttttttttttttttaatactttaagttctggggtacatgtgcagaacatgtaggtttgttacataggtatacacgtgccatggtggtttgcttcacccctcaacccatcacctacattaggtatttctcctaatgctatccctttgagattcaactcaagtgtcacctttcctgaaaccttcaaattggacttagtttattcttcagtgacttctgatttctctgtgcatttttctctctcatcacttcatactctaaaacattgctttgtgtatgaattgatctcccccactactctgtgagcttttccaaagggcaggctttgtgtcttgtttatctttattctcccagaactcagcaatgtacccagtatataatgattattctaaaaactctggttgaattacactggactgaaccaaggtgggaagcataaggatcctttgcctatttcatttcacttcagattaggcactctctccaaagaaaagtaactatatcagggtttgtgactcagctcttggcgatttatggccaggtgagtttgtaaatacagccccacattcgaaacaacaatcccagcttgttgttctcactgcttttgggagctgtcattccagtcagtgtttctgcagttcctcattaattgttattatccaaagtaagcacctgttgaatgccattgtgctaagggataggtgggatttggaaaagggttgcaatttctgctgttgagatttcacaggctgcactcctgtaattttgttctaaggggagagagtgggaaagggttagatgacttgaaacattgacctgctggcaggtggatcatgaggtcaagagatcgagaccatcctggacaacatggtgaaaccccatctcttctaaaaatccaaaaattagctgggtgtggtggtgcgcgcttatagtcccacaacttgggaggctgaggcaggagaatcgcttgaaactgagaggtggaggttgcagtgagcccagatcatacctctgcactacagcctggcaacagagtgagactccatctcaaaaaaaaaaaaaaaaaaaaaaaaaatacaacaaacaacacaaacacaaaacagcataattctcaaagtatatttataaagttctatttttttaagtttgtgggacttcttggagggaaaaattagtaaatagaagcagagtaaaaatgtggtttataaagagctcataataaaagtttataataaaaactttgtaactaaaaatattataccaaaaagtagtgtaagtcttctcaattcctgtaaaaatattatacataataaaaataagtcagtcagattttattctcataaagaaaatctatacaaatatttgaaaatcaccaccaaatttcaggcagttcttaaggtttaaattttatctcagaagcttttgtgtactctattcacaatcaaatttggttcattcaggatatgatggaatcagaagtgtgcagtgcaataaagatgcagggagcagttttcaaggaaattccttggcggggagttctactcctcactcattaatctcagtttttcctcagttagggctgccatgtttgtcataagggctggaataaggaacacagcttaaaggttacctgagtgggctatgaagctagcttccttttattctaatccttcctcttctacttactatctgaatggggaagtcaattagcttctgtttgcctcagtttcctcatgtgtacaataaatgagctaataatgcctaccccatagattgttgtggatataaaaagattcattacatttaaggggtttagagcagtgcctggcccatagcaagtgctcaataactattactccctagcttcagccttttcttgttcactggcaaatgccagtgcagctcagacattagttatttatccatgtattcatttaacaaacatttttgagtattgagtatgtgattggcactgtgcacggtgcaaatgatacagaaaatgagtaagctcctctctttaataagttcatggtatagtgtgtgtctgtggcgagtctagagatgatggtgcaaaagagtctttcaattaaacagacaattctaacgtgggatgataaatgctctgtagtgagaagcacatggctcatttggatcataaggaggggaacttaatgcagtctcagagggccaggagaggctttccagcagaattggtatctaagatgagtatgagttggccaagtgagagttgagggtgagatggggtaggtgtatttcataccaaagtagctgcctctctagaggccatagagcaaggaaattgtataaggatcagtgtggaaagtcaggcagggggtggccagaagcaaggctagctaagggtgaaggagtcagattagcaagggcctttcctattatgcaaaagaactttatggctctatcctgtcctactgggcggagaagccctgaaggcttctaaacagggtttaaaacacttagatagtttttcttgtttgaatgagtatcttttaaacattatttctaatttcgggcagaatttactacttctacctttgggtccttctgtttctctataggctcctatcatggcactgtattgctttattgaacttaactgtttctaatcctgcctttcctgggagactgagggcttcccaaagattgttttttatctatctctgtatccctaggatctggaacagttactgatgctgctgagtaggcattcaatggaagcttgattttaaaaagaaaagttgattttagaaagaaagcattttttttcttatatttttaggacaaagcattatcagataaaatctggcccatcaagtcagcaaagtgagtaatcttgttcactctgaaggcagtgtgagctccatgaggtgctgcccaacagatctctaatccacctgtccttctgtgtgctctttattaatcactgcatggcaagcactgtgctaggcaccaagggagatataaatacgctgaagacagcattagatagttgtgaaaatgttacatatgtacacaaaacaaactcaatatcccgagggcctagcacagtggtggtattgctcagtcctcagtcaatgtctgtgaataaataacaagtgaagaaagggagagtgatatgtgtgaaatatatggaatacataataaatgctccaagagtccagatgtgggaaaatctgtgagatgggtaaatctgatagggtctcattgaggtgtcctagccttggaagatgagtaggatctggagagatagaaggaaaaggtggaggactctaaagaacgagaaatagcatgaacatcacttcatgcagactaataatgcctgaaggaaatataagccattggaaattatgaaagctctgacaacaattggagtatattggaattcacacaaatgaaccagttttctaggcatattgtaattcggccaatgaatgtggggagaccagcagttgctttagcagacagccaaagtgggccctcgtgacaatgctaattaaagcaaagttaattagttaattaaaacagaagtggcaaatggcagtttctaaatttcagttaaggtggaggcaacactaatgattctgccccctgactagaatcccaggggagggttttgacttctgagaaaatttataacttccagctgtaggtctctgtcatcaatttagccatgaaaggcccattgcattttagaaccccagttccatgtgcctggaaattctgaatcttgcagagctagaactttagattcatcagattcaatgctttatttaggtcagaactggccttgtgttcatttgtcaatttgcagctgaagtgaatgccttaaacggaagcctggcattatctgcttgacaatgatttgatgctgcaccatgttgtgctggaaattagtgtctagaaccaaaatgttaatcacagggacctctatacattgatggcataaatagcatgtttccatataaaaaaatctgtagtgactcatttccatttaaataaaaatctccctttgctatttcagtgaattgaatggctgattccgggcccttttctatttgtgctctaggttgagccaatttaacttcacagaaaattgttggatctgttagaattacctctgttgtctccttaggtgctcagagagctcaaagtgattctttctccatgatgagaggtggaaatttgcttcgtctagcccccttctcactaaagatatgaactactcttcaggccccataaacatgtcttctcttgggtctatgatgatgttttccaaagtaagttctttggagcatcagttcttcagaatgttaagaggtttacttggaaaaaaatggtcttgtatacatgtttgcaaaatgatagaaagagttaacaaatagatgataggtttctacagtgcaagacttctcagtgtttatctccaataagagaatagagttttttcacctttttgaccaaataatttctttttcatggagctatttaatttttcaaagaatatactaattttccaaagaaaacagtccatatatgcttagctctagtaatcatcagctaagaccttaatttaaaaactgctccattactcattagtcatgaaacaataggcaagtattctcaccgtgcaggacctcaaatttcccatctgaaaaatgggaggattgttgcttcaacttgcagtattttatgacaattagaaatgttagactagttatacatacaaaaagttctgtaaggtggcagaacatagtaggtaggtaataaatgaaccattttgggggactactctgatttgaaacttttttccagtctcctactttgtgctccacttcttcttacttctttcctcttctttgctctcttctctgttccattcctcttccttctgcgactgctaccaccgtgactactactaggtgctaacattttaggcactatgcactggattatctaacaaacacctgacacgccattttttctttccatttccatgatagagatggaagaggctaaatgtcactttcccatattctcttatattagacagtttgggccagtgagacacaagggcaattcttatgggactctgagaagacttttgttttccctaatgaaagtacacaatgtatggaaccatgacaactatattacaaccattagtaaaaggcctagagaatggtagaagtgtttgcctttgcatcactgaaccaacacccgaagaaatctccctccacaatttttataacatgaggaaaatgaactctaaagagtataagtgtttgaaaacaggctttctgctacttgcagacacaattctaaaaggttgaggtagcatttattgaatactttctacgtgctggtactaaacacttaatgcatattacctcatttactactcaaaataggaattattatctaccattttacagttgagaaaacagactaaagtgccttattcaaattcatagctgaattgaaatccaggtgtggttccaaagccagaactctaaactagtatgctgcctttgcattttccatctgtgtacatacacctttccaggagcctgtacaaacttttggagacatagttaccataatcttagatattattatagtcttcattttgaggtacacaattagtatcctctttaagatagagagcccttaccatctgccattccatgtggaagggacacacacgaccccatccagaaacagagggcatacccaatctcagattatagcagcctgtttcttcatacacctgacagaggacagcagaacagggctgggtcgagcatggtagatgcttctccaccaaagacctacatccagagactttatttacctatttaagcccacatgacatcccaagagatgggctcaatagcatattaaaattttcaagactgagaagcacaactcagggaagcaatttagaagaaaatgtaaaaatattagaaatacctgaatttatttgtttcccattagttaagctgaagtgcggtgaaccatgtgttatacactggcttttcataaaagtaattatcaaatgggagctgaatccctgcataaccagctatatcctatagtgtaataaatatgctaaacatcacagattttgtatcacagagaagaaatatttagttttggagctcatggaagccatagaggaaaggaattttagtttgcatctctttctaatgactgtgggttaaaaaggagagcagatatcagatgcatgtgatacaaaagaattatagctttccctgcccctttttcttatccatatcaaaagcaggttctagcttgaatatgccagttgatgtcaaaaaagaaatctccatataatcagactgtggcctgtgtcagctataatcacatagacagatcaagatttgccaagattgcagaaagaagaccaaacacttgccaaaggtttctctttaccctctttcagattctaacatccaaatgcacagatttcaaaaaaactacatggccctgtaggaaaaacaagttaaaatattgcaacaaaaatctttagaatttccgttttctagtggttggcactatcagtaaaatttgttgcttttgtttgtccctttgtttattaaattagaaacaaaacagttgaaaatatttattgaatgttactagagaaactttataactatagtaaagcaagggatcagtgatccgattctagagcagagactgatgaccacaggagtgagagagatatctgtaatacagggcactgttgccttaatcttataaaagttaatagtacaactagggagtaagagtgtgcacatttgaagacaagcaaaaaaagtacctaccacattaataccatcccaaattcattcaacaaacataccaaaaatcattattgagcatattctatgtgtcaagcacccttcaaggtacaggtaggtattggaggcacagtgatgagcaaggtaaagaaggcctccatccctaaggagcttgctctgcttaaattggaagacaggatgtgctatacagaatggcaaagagctggacaacatgaagatcgagatgccctgtaaaactcagattgtataatcaatgtctccataggtttgtgctgccgtttatagtgctgtctttgttattaagatcatccagattgtgtattgggtacagtaactttcatgagtaaaagaagactgacaatggttaacttagttaatcaaaatagcaaatacttaagaagggcttactatgtggcagacactatacacatgttaacttattcagtcatcacaaccagtctatgaagtatgcatttctttatctccattttttcggaggaagaaatcaaagcatagagaggttaagtgaatttgcctaaggttctgcacctgctaagtgatgctgccagtatttaatcccagtgctctccagcactatactgtgctaccttcaataaagtgcctactatgtgccagccattacacatattatctccttcattttttacaatccagtttgtcagatgatagaaataaggtgcagagagacaaagtagcactgctgttgttcaaacccaaaacaatctggctaggcagccagtgttctctgccaccactccatgctgtctccctaaggggctttctctagtgagttttttacgtgctcagacatagactcacaattcccttcctccatcaatatgcttgttttatataccaggctttcctgggagattctgtttacagataggacttgaagaaaagctgataaaacaaaagtttgaaaaataaattttcttagccaaaaggaaaggctgatcttgcagaaatttcagaaaaagaatggttcatacaggagtcaggaaggcagatggaaaataggccagcaggttagatatatgaaaggcctgctgtgtacagaccatgacattgccaggatttattgaaaaagaagacatgagttacagtttaattgaatgtcttgtacaatgtacgtagaaagagatgagaagtgtaaaacaagtagaaaagagttgaaagaggtaagagtacaagttaataatgtaaacgaattggaccttgtggataaaattcaactatcctctgatttattttcaaacttcagcagacatagtatctttaccatcataataagtcatactttgaagatttagggctgacagaaaagtaggactttcctgcaggctaagtgatagtataggagaatagttcaagagatgttatttagatatgtagcttccatttgaaatctacatatcttccatttatttatctagattttagaaatactgttaaatttcagaagagttagcagggctgatgtcttgaccagctcttttgattacacattacacttcttaaatagaggtgatacttagtcccagttatcaacaattggtgttgcctttttcatacttcaacatttttcccaagccactgataacatgatcttgtcttttgaagtgctttgggatcatttatcacataaggaagttccttatatgggggaaatcattggcttctggctttagattcttttcagattgaaatggtcgaataactactacctgtgatattgaacttggggtgggatgagactataggcaacaaagaattgggaaaatgactggttgtttttatgtgcaaagtcactttgttgttttgcccttttcagctgcttagacatctcctaaagatttcatcttgcccattaagaactaaaatataaatcctacattcttgtgcctctattggatgggcatttaagcactcttctggcttgaataaggtttaggcacgtacaagtgcagtctgatgtgtcgagttcttggcattttgctctcagtataatctttgttagtaatatatttttactctgttctggtgaactagaatttaacccacagtataactctgtcccctcagaacttgagggtccttgccttggctttgtgagctaactctgctctgtctgccctctcaacctcactccccctacgctgtaactctgctttattagagattttgacttccatgtttctagacttggcctaagtaattggacccacatcccattaaccccataaataccattttatgagaaggtccatgccgtaagtcaccctgcctcacatggtttcatttacccagatttctcccatttaaaagacccaggaaacacatgcctctgctccagttttaggggccagcatccctgtaagcccccacaacttttaccttaaggtttccccagaggagccccttctcttccacaggttgactaggctgctggatctgctggctgcggaggatgacttgccatcccctacatgcatgcgcaccacggtagatgtggtgaaggcgctgcgcacgtttctctctggtttggccaggatgatgtacaccttcggcacaaacatgcagcctagggccactgtggcactgaggctgaccgagaaacacatggtgatgattttgtagttgctgccaaagtagattggcacaaaagctagccatataatgcaggtcgtgtacattgtgaaggcgatatacttggcctcgttgaagttagctggaacatttctggtcttgaacgcatagaaggtgcagctcaaaatcaacaatccattgtatccaagtggagtgacaactcctaggttggtggtgttacagatcaggtagacttctcgaatgcttgggtagtcatgcattatgtcaggaggctccattataaagagggcaacgatgatgcccaactggatgcatatgagaatgaaagcaatcactagctgggcacaggcactcatgaatctgggctttttggtacagatcttcttcttgctgccagccaggatccttgcaatacggttggtctttgttacaagggctgagtagctcatggctggggagagaccaatgccaattctctgaaggtagcagtaaatctgtttgggcttcgcaatgaggcagaaggtacataagtagcccaggcagatgccagcaaggataatgtagcagagttccctgcttgaggacttgactactggtgtatcacggtaaatgatgaagactacagtaacaaacagggtggccaggaggccaaggcaggcaaacaccacagctgcaatgggttcagggtcaccccatcgaagatactgtactgggatcaagtcacaacctgcagagacacaaacacatattgtaaaggagggagagatgttgacttgggtcacatatccctaagttacaagcagctgtttatgaccatttcagtttgttccccatctacctttctaatttcagaatctcctgctacttattgtttcatgtattcattcagaaaacgttaatgatgatattactgaacatgtacatggtctgtgataggaactattctaggttctgaaacaaaataatgcagaacatgtttcctgctctcataaaaaaaaatcagtggccttttaaacaactgtaactgtgataagggtcatgaagaggtataacatgggttctaagcagtctcttgaagcagcaaaggcctcctacaataggaatgagcaaataaatgtgttggtttgatggagttggggatttcatgggcttggcaaacttacagttaaagtacattaactgtaaggaagagaggcatgaagggaagccactgtatgacagtgtaacaagtggcctaagatgaggctgggaggtagggaggaaggggatcttgcaggttagagaatcctagatcagtaggaagttattctaaggatctttgtagagcaatgacaagctcagatttgtgtgtgcgtgtgtgttttaaacatttctttggtttctgtgtgggttttggatgagataaaggtgtgcacacatttaagacttattttagagccatatagagtgtttgaatggatgtgggagtgtgtgaaaagtgaaaaagatatgaaatatgaccaacactagtaaagaagagttggaattttcagagaatcttgtggtctagatgttttagaagattctgttaaaaaaaggaggaagttcatttttataagaaaactgaccccaaaggcaaacaattggcaggcaagggaagtgcaccactctcaaaatcgttccttattctttatttatgatatggagtttttaaattattccttgattatatagcagaaaaatagtgacagaatatagcatcatttggattatctgtcttttacaattttttaggacagtggttctcaaagttggctacacactagaatcaccaagactatatatatacatatttacacacatatataaaatcctgagacctgggtgtcccattggttgagcttctgacttaatttgtctgagtgtgacatgggcatcaggattttttaacaatactgcaagtgcttctaatgtgcaaccaaagttgagaaccattgttctaggaggatcattcctgtcagttagacttgaaagaaaatggacttgagatagcttcactgagtaagtaggaaaggaggcaagtaatctggagcattgggcatttgaggaatgtagcagaaatgactaattgcatgtcaatatctattctccccttcattctcagcaatagacctctaatttcatttgggatggtaaaggcattagttacaatactacatttttcatcaaccattgctgtgaaatgtggcataggaataggtttcagccaataacatgtacacagaggattcctgaaaggaaaatgactcatggtagaaagtaacctttttcccttctttactttcttcttctgctgcctggcacataaacatgatggctacagctccagcagttgttttggacttcaaggtaacttgaaggacagaaaatgtgttctgggtttggaagagaaaaatagagggggctccactccctgagaaccatggaccccccactacctgtggactatgcatatccacatcttctttgtttaagctcctttcatttatttattttcttgatatatgcagggaaaacaaatcctcattgataaggagtaaagttttcctattaacttgtcctatcccatgatcaagggtgttgcagtcagtggctttgaatatcaatggttactgggaggtaggggaggcaacaacaagtaatgacagcaaggaagcatgtagttctttcaaaatatgcctaagggtagcttcgttgtagaaagggaagggaagaagggaagggaagaaacaaaggaaagagaaggggaaggggaaagggaagggaagggaattattcttccccttatttctgccctgctgctgttttgctttaagatctcacatttcagatagtactattagtactataattaaagtcataatggatttaataggagttatgagctagcctgggattctcagcacactttgtaaaatgtttctatgggaaaatgtattcttactctaaataattgtgcatttaatattgaaacaaagggctttaaattttaaaaaattgtggatagctcagactaaatataactaaatacaaaacagttgtgttatatgacctcattaagtataaaaatacatatctcattgctaattaatatacctatatctgtatttctagtcatctacgttcccatgtgcttcctatatagttggaattcaacctctgatactttagtatgccatagagtttaggcttatatttacaaatttgctccttggagaggctgttttaccaaaaaaagtattaataatatatatatatatatatatattttttttttttttttttttttttttgagacatagtcgccctttgtcacccaggctagagtgcagtggtgtgatcttggctcactgcaacctctgcctcccgagttcaagcgattcttgtgcctcagccgcctgagctgggattacaggcactcccggctaatttttttgtatatttagtagagacgggatttcaccatgttggccaggctggtcgaactccttgccctgagtgatccaccttcctcggcctctcaaagtgctgggattacaggcatgagccactgtacctatcccattcctatatttattattttatattagttcatttatagcaatgatttgacaataaaatttattaaatatatagaggtctgtttctactgctaggtcatgtgctgctaacgtccatagcaatttacttatataggaaacgttatgtttgtatatagggcaggaatcttttcattacctaaaagaatgagctggaaaaagtaattaaacacttaattttaccccagtttttcctactgttctgctaaatcttaattgttttcatcttaatgtaattaagtttaatttctaaatactttgcatagaataacatttactactatttttatcagatatatttttgaactcttcatgttcagcttattaacatctgtgtgaaactaaagaaaactcattagatatatgtgttaaaaatgtacatgaggcttgtctctaatgtgatgtaattattttcccaaatctttcaggatttatatattaaatgaatgcttcttttatttaatgtaaaccatttagaaagtcttacatttagtttgatgccttcattgcaaaaaatactgttgtaactattctctaagaatagcaaactggactctgattaaagggttataatcactgaatcttataattgaataagatcttagagtttccaaaaaatggatgcgtatcacaatcacttgggaagcctacaaaactgtaactcaggagtctaaactcagaagattttgagtcagtacattgtggtggggcaaaggaatctttattttgaataagcaacttcagttatgctatattagtctttggtgcaatttaaccttagagattatcaagccaaattcttacccatcgtgcaaatgccttatatgataactccaagatgtaatcatcctaaccttacttaaggctttttataaaatatatcatctcaagggcaggactggtggtggtgtggggagatagattgaaaaggcaggaggctgtgatggcaagtgaagactggaaatgaagaaaccagtcagaagactatcacaaggagacagggatgataaagacaaaaactaagtaactgtactagagaaaacaattagttggtaaagacatttcagaactggaattgaaagaaattatgaagaagatagaagaatcaagaagaaaggctttgtagctgatagcaatactgttaactaagatgagggcttaggaagcaaagggtcacatttcatgggaatgatatctagctccagtttgagcatgctgtttgtactgggtctgacctagtgagctttgaaaagctatcagtgtggaagttacagctttaggaatcatctttttatagaagctgaaaataagagacatggaaataaacacaaccaatgaggaaattcttagatgtggatgagagcagagcctagcagtctggtgtaacaccaatactaatgaatgagagagggagagaatatgtcagagaagatgtaacatcagacagaaggaaggaagtgtatcagaagccaaaggaaagtattaattggatggcccaccacagtctcctctaacaatatcagttctgttttactttttaaaattcttacccaaatagcttgcacaaagcttcaagcttcaggttcacagatatctcttctgacattagataattatatgtttttttcccttcactagtattagatttatttcttttgaataagggatattatactttctaacatgaaacaaggtctaccaaatctcagaatcttgaaataatgctaacctcattatgatataaatttaaattctcagtgataactacccttactatgtacacagttgtacaaatatctgtgtagttattgttcctaacttccttattttcttctaatcactgggcattttttccatcaatggttgtattttttatccctgtttcatccttactgtaatggtaagttactggaagtgtatgtagaggttacctaagagtctaaagcgcatataatgtatagttttattatgaatttaatcaatttagcatatgttattatattttaaattaaataatcttgatcatgtcagtgaaattccttcctaacaagcatattgccatttctctggttctcagaaaatgcacagtattatattattttctagaaatgcagatgaaacatggattagaaaactgcggtccattttctaataacatctatttaggtatctattcacttttaatttttcttcccttttatacttgattcgtaagtctgtggttctcttgtataatccatcttttcaaaacttgaactgacatatattgaaaagacaagtttttctttttttaaagagggaaagtgagctgccaaaactatattgtccactttcattctattacttcactaatgtgttccccataagtctaatagcagaatggatgatctactgattttctggacccctaaaaatgatgtgactcctcattcacagctggtactcatgcttagattgttagttttgcagtattaatattcctgtagttactagtttctagactgctgcatttttcaaaccctgttccaagtgtctcttcagggagagatgcctgatgttctgtaaattgggctgaacaagagctccttaccaagctcctacattcctgtatattttggataaaggaagttgctgtttagaatctctgagaataagatgtatgtgctctcagctgctggttaggtcatttcaggtatacaatgagaaggaagatataagatagattataaaaaactgatctattaaaactaatatggggatacagaactgacaaggggctgttgtgggtttcctctttgatatttgagcaacagatctgtccagagcacaaggtgttgactggtgactaacaacatcatgcttgctttccatctatttaactaataagccatctttctgcctttccttctttctttacctctctggatttggatctcatggatgttgaactgggatcacagggtgatacagaatcagaattctgtgtctagtgttcatatccctgatcctttaatattttttctttacttagcctgagctaaagtttttcatcacttccataattcagagaatttgaaatggtgggtgtctgtgtgtgctgtgagacattgaggaaactcatttctctctgtagcacttactgtatttataatctattttgtggtagggggagtttgattgactgtatcattaaggtctgtcttctctacttgactagaagcaccctgatgatagggagtttgtctcttttgcacacaaacgggtcctcagtactgagcacagtgcctcactcatatggttaatatagcattttacaaattaatatattttgtatacaattaaatatagaattctaattctagtgcatggataagtcattctcaaaaaacttttgcgttgcctttagaagtcccaagttacagaactattatgtagtgttttaggcagaagtctaaaatcaattcactacacctgaatttgagtctagtttctggaacccaaagagggcaaaactagataagcagctcaaaaacttacttctgcctagggacgtgacatgtttcatattagaaatattcctcgtgggcaggtgcagtggctcatgcctgtaatcccagcactttgggaggccgaggtgggtggatcacaaggtcaggagttcaagacaagcctggccaatatggtgaaactccatctctactaaaaatacagaaattagccaggcatggtggcaggcacctgtagtcccagctactcaggaggctgaggcaggagaatcgcttgaacccaggagatggaggttgcagtgagccaagattgcaccactgcactccagcctgggtgacagagtgagactccatctcaaagaaaaagaaatattcctcatgctgactagtcatttgggacattttttatgactgattaatctaattttgagtaattcattggatctgggaagtatgtatagaggaaagaatgagacagtaaccagtaaagtcattctttagaaagtgccatccaactatgaaggtcagatagatgtacttttcttaaggaggctgttaattgtaacttttcttttcttttttttttttttttactttagcatagaaaaaaaaaatagaaaagttcccaagttttcttcaaggaaggcatattctacagttgattgatttttaccttagcacgaaacaaaacatggcatgattgctttctccaataaaaagagagtctttatccaaggtgttaagcaagttttattggtaactgcctcaacaggaagctgccatattcctctttatgtcagtatcaaaagaaaaaagagactaacatttattgaatgcctactatatatcatgtgttattccagaaattttatgtaatcatcataataaaaaatgaggtaaatatcattatctctatttttcagagggggcagtatgaagcttaattagatatgttaactttctgggactgagattaaaactctgtggttatctactaacttatttatttattttatctttgctacatcaggggaggcaacttggccagttactcctctgaaagaagtcctgagtctatttagtaggaaacagaatcatgattaattaacaatgtctgcatgggcaaggtggggctagtggtggcataaatatttgatagctttatcttgatataaatccatgcttcctcttgagaaatctcattggttcaaacccttcagcaagattttcgttctgggctatatgtccttagagttgctgccagagacactgattgatcagttgtttttcttgggttcctaaagttttctagcatagaaaatgttctgaatgatcattcatgggacattcccaactttgctacagagtagactcacagccatccatttgtcattggacctagcctattccccatccttcaaggtttattacacatctcgttttagattccttaatagaattccttcacagagctgaaaattcacagctatagtttttatttttgttttttttaattggttatattttataggggaatttgaaattgtgtgcaaagatttattttataattaagacataaagaatgatttaatagtactgcagagtactaaagggaaatgtgatcacagatgcacatttgtaggaaatagctttgaaaaatatgacttccggtcatactgcacatggataagagtggaaaaacacagcatgtgaatttaaataataaagcgtgctgactggaataattccctccctttctacttttctccagtccctttttactagctaacttctccttattcttctactttccagattctccttgatgagtatgacttttctgattccctgaagctgactgacaggttcctctcatgtggtcaaatggctccctgggcctgtacccgtcatagcacttgcattcttactaattgtgtattagtattgtctctttgaaatggtagatttagcaatttgagaggaggagactgtttctttgcttgttgtatttctagtgctagtcatagtacctggcacacaataggcagttaaataagtttaatgaatgaatgaatgattaacaaagaagagggcaagtaaggaataaggaggcatgcccttcattttcagcttgcacacaaatatttcctattaatatgagccttttactctatgtctcaattttttcatatataaaatgaaaataatacagacttatcttatctataattagggttttaatctggagaaacccttgcagaagaattcacagatgagaaattaaagaccaatgacctgaaaaaggtcagtgaagcaatttctcagaaataaatttataaaatgcttaaagttgtttttgtattttattgaaataaaacattaaactcatcattttaaaaccgatagggtatcagtggaattttgcacacataataggagctataatttggattttacgattcatttctatttatccttgctagcttgccagacccttgtcaagatccctttcctgcagttttagtcagactcataaaattgcttattttgcaaataagctgcatactaaaaagcactttcctactgtagctggtcatccatccaaatgttcaataactttctgattttgtgactcagaattttgcaaccactctccaggccccactatattccttctgtgttcccatatacccttgattttttttttcctttgaggcataccaggactattctaagacctgaaattacattacctttcctaaggaaggttgcaaaattgtatgcatattctgccacagattttacctcctttttctctttccaagcctatttgttcctaaattttaagtatcgttaagtattctccagttgagctatgggcatacatttaactattcaaatgctcatgtttattacagaaagaaaatatggggacaaagtgcacacatgtaagaaaaatgtacaaggggaaagattaatgcctcatcccacccattaaagagattgaacattgttcacacagcacagctacagcatttcactcttgagcacctacaccattcataccacttggtccacactatggtgatagaaaggtaattgtttgttcctttaaaataatgtattgaccaaatgctcaggctctgtgactttactctgctagtcattgtattgaacactttattcttattaccttctttaatacctacaaggtcctcatgcgatagggaccattatttcatctattttcagttaaggaaactattttctgttggaactaaagagcatttgaaaggaaccatagaaagagaaacacagacatagagaaaagcagaagaaatgtaaaggaaacagccaaaatgcaaaagtcagatatgcagaggaaaaaactctacagcatagtaatgtatcaagagaattacaatgtctttgggaattattgctgatagttcagatggggaattagcaaaagctttaggagggaaggtgataatacctatctgcctacatctcaaggattagtgtgaggaccatataaaataaattggacagtggcataataattatgaagtgagagaaagtggaaatggggaagtgtatatacaaaacggtgtgactcaacatctgctaaagtgcctgttttattagattatcctttattattctggggaaaagccaggctactttctctctctagcttgtttaggtatgtgttgccccaagtaaatggtattatgttgtcttaaattgtctgtaagtacaagacagcccataatgctttgaatttttcatcacctcaattaatgtgattttttaagaggtgtcaagataggaggaatttatctgcttcatattactcatataatatatcaatgctttgtgaagcattttccaagtaggttagataatgcaatagttagcactgtatcataatgtttcttgttctaaggggaaaatgtgataatttattttgggtaagctacattgaccaaaaactgaaatcaatgaaatcacattattgtcttcagtctggccatgtcagagtggtttttgaccacaatgccattgttttggtcagaccacaaatttatcattgtgaagaagaacatggtgaacatttttcatcgagtggtttctggcaagatgaaaactggtttatgttcttttcagggacctgttttgataagttccactaagagaggggctttcagccctttttttcttctttagtcagtggcgtttacaagtttaaatatactgactttttgactcatcttgtaggaagaaaattattaaaagttaatgaacgttgagaaattggaagagtaagaaggcattttagaatttatcaatgtgtaagccctggaatctcattttaaaagaaccagaacacaacattgttgtttttagtgctaactgaaacaactttatcaagctaactgtttgaaaaaaaaaagacagtgcacaaaatttttcattgcattttagagatcctgttagaaagaatccattgattcacaatcacttccatatttcctgcagcatcatgtcaaggaaaaagcactagttttacagaaagatgaaacagggtctgagccttactctcctgcttactgtgtgatcatgagcatggatattttcaattttcaaactcaattttctgtaaaatggaaatcatgattccaaccttttttaaagtttatttttataattttaatttttatgggtacctagtagggattccaacctttttgagctgtcaggaggattaggtgatagaacacaaacttcctattctgataggtgacaggtactcaatacatggggatttcttacctttcttccatcctgtattcacttctttagtgaatattcattgaatatctactgtgttctagcagcctggtattctcaaatgaggaaaatatacaaaagttactgtattttggcttatatcctagctgaaggatcaacagtatatgatcagtgaaaatacattaacacataaacaatataaaatagtatgaggtgatataagaggtagagaaaagaagaggtagaactggatatgaggggggttagtttgtagtattaaacgggttgctcagggtagacatttgagcaaggacttgaggaaggaaagaatagtggtcatgtggttatctgcagtaaagccttccaggcagataactgctagggaaattaccctgggataagagcctttctgaccttttaatggaagaacaaaaagaccaatgtattgggaggaagaaccagatgaagtgaagggaaaagtaggtcagacacatgacagaagaccaggtcatacaaaacaggaatttgtaagtactttggcttttactttgaatgaaatgggaaatcattgtagatccttatacaatggagtaacatgacctggcttattttgtaaaaagatatctctgcctggaatgttgaggagagactgtaagtaggggcaagggtagaatcaaggagaaaagttaggaggttattttcagaagaaagatgattaatgatgattgttagacacttttactggaggtagtgagaagtggtggaatttgggatatgaaggattagccaatgggatttctttactgactaaaggatgtgcaagacgtcagtagattgactccaaagttattggtcttacctaatgaaagaacgggtttattatcagatgaaatgtaatagtaaggataaagcagcctgggagattaagaaggtaaagacctggatttcagtgatggaagtgtagaatttaagatatctattagatattcaaataaatatgtcaagtaggcaatggaatatttaagtctggagattaggtgagagatctggacaagatactttacatcaaaatgtttattgtgtagatgatatttaatgacatgaatgaaactgggtatgatcaccagtgaagcaagtgtagacagaaaagaggatcaacactgagctctggagcacttcagcacaatagccttcattttatttgaaattcataaatgtaaaaatatcagtggcaatagatgctagatcctttttgggaaggttatttttttatttttattttgccagtgaggaaaatatcaaaagtgtataatgaagtgatcagtgaaactagaaaccttttttatcagggacaatgataagatagaaaaacaaatggcaggtgctgtgtagtattgtcacggcttacggctttctgggatttccaagtcaccattaaacttctgcaatttattcatttagaatcagaagggctatgaagctaatctaaacgaagttaaaagagatgtttataacagtaagcttagttcaacaaataaaaattgtctactctctgccattgattgtgctagacagtcattgacttaaagggatcttactttcaaatgtagaagacatttaataaacacctgttaggccaggcacagtggctcacgcctgtaatcccagcactttgggaggctgaggcggcctgactaacaaggtgaaaccctgtttctactaaaaatacaaaaaattagctggcatggtggcatgcgcctgtagtcacagctactcaggaggctgaggcaggagaattgcttgaacccgggaggcggaggttgcagtgagctgagacagtgatgtgccactgcactccaacctgggcgacagagcaagattccatctcaataaataaataaatttaaataaataaataaataaacacaggttaaaactttccccaaattttcttcttcattcattcttaaatcaatccatctatctctctattcatttttcatcactatattttaaaaactttattaacagtagagtgataatagtattcttgaacagttaatgcatacgaaactttttgtatgctataaaatagctctaataatcttatgaactagttactactgttatctcaattttatggaagagaaagctgacactcacagataaaaatttccgtgctttaagtcgcacaatgagtcactggtggagtgtgaatttgaacatgggcatgtttgactccaaaaccttttgatttaaaccactacactcttagaagaaaataaagatgaattgttgcagattggtattttatgcagcacaaattctcagctgtactttgttacactacatttgccataaattcaacttccttagattgtactggtgagtgtgtaatgtagtgaacttatctagagaaacctaaaaagtgcttagagacctgggaattctattgttaaacaaaagtcactttcttttacagctgatcaccattatgatgtttggtatttaggaaaggatagttcccataatagaggctttgatgaaaaagcgaccgtgaaatggtggtgtacttgctctgaatgttatattggaaaaaatattttgagacacacatacattccttagatatgacatgtatcattccttatggtctttttttctgcctgaaaattcatttctgctttacctggttagcatcttattttcacatacatgaattccctttccacccagaagctacctctgaacttccaagacctggttaatttcctctcatcaacgtttactcccatcctagcactttctttccttccttcattcatttcttcatttcctctcctctcttttattccttcattatacaaacattaaattggttcctacactatggcagggatacttaatgtattgaaattgcctctttatttgcatatgtctctgcctaggctctgcgatacttgggagtaggaagtggggctcgatcaccattgtgtgcccaatactggatctagtgctatgtttggcactagttggaactcaaatatgtgctaatgaataatttcatcctttgtgccaccactgcatttggtgtgtggtttaactattgtatgcattatatgtataatttaatgcaattatttaagtaaggttaggtaccttccatttatatttgtatcatcagaacttagcacagtgttaaaaaaagagtaggaatgtgataaaatcttttgctgaatgaattaatgaatgatagatagccagctgtatagcatatgctcctgttcagattactatctaacctagaaaccaagaagctagatagcagaattctgaaagctattccagtttcaatattaacaagaaatatttattaaaattgtaataataaactaaacttatttctcatcaaaactcatcagaaatttcctctaaagaatcataaacaaataatatttaatagatgccaagaattttccctcctttcctcatctaagtttaattataatagtcaaataacacattttaagcacatttggaataaaaaatatcagagcagcctggagataattaacatgtgaccagcttgaagccgattttttttccttctataatttcctgaaaatatggggctctaaaatgtgattgtggagagagacaggtagtatagcataaaaaccccagaatcatagcacctgggatttcttttccaccagttttgtggtcttgtccatgtatagaatgttcctgagttttgtttcattcaactgtagaataataatctcaaccttaaaggattaaaaaaggtaatgcttaagatagttataataattggaaatgaaaagaaatcttccccatgtttttatttaatgtgcttatttattaaaaggcaaaaaaaaaaaaagtcccaagaaaagtaggacaagctgaggaacacaaattaaatgcacatttgtaaaaagagagcaattccaatgcgggagttataaaacctgccagtggttacacctcttggagctcatcctctgctccctccttgattcttaccaacatctctttgtttaactctgcggcttttttcctcttaagtgaagagacaaatgttccaacctccaaagcaattaggtaactcagggaaccaaaggaacttcctagagaacgtccctattgacattaagctgttgatacatattgccttggatggaataaaatggaagcgttttacagctttggacttacgtaagatacatttcttttatgattgaaaagcaggagataatgctaacttcctgtcataggacttcccacctggttacttcttgaaagacaggctatttttgctctttccttttacttagtttattggaaggttggcagcatctggtaagccccacctgtaagtgtttctgtggctttggactggggacctaaagatctttagagctcttactacttatatctcctcctaaattctttgatacaaaacaaataaaaaattctttctaggacagtttttgcagatatgtggcagggaatggtgtcccagaaaaagtgtcttggcaaatgcttttcagataattctctgaacgtctagctcaaattgttgccttttattactttttctcctttctctctcaaaccagactacatttttctgagaactaattaccttgttctattgattttaattcctaatcaaatctttgttgcttttgattcacattacattatccttacccaaaccactggtagattcacatggatttttgcaaaattttcttacccttatcctctctttataattcccaacttagtcttatattttaaaatcttatcttttagtgttaaatatttaaatagcgcaaatagtatggaatcatttaaattataaaatttttaaatatgcagagaaaagtatatggtatggaacaaataaaatctatattaaaaaatgttaatattttgtcatatgtttcaaattacacacacacacacacacacacacacacacacatgctaaagctataactaaaacctattttgtaactcccatctaactccctttcttctcttactagatgatactgctattctgaaatctgtatccttccttttcatgtttttatacaatatctactcttcacattgtgactatgtaaataatatttataaagcagcccatcatgattgcattttctttcttttcttttcttttctttttgtttttgagatggagtcttgctctgtcacccgagctggagtgcagtggcatgatctccactcactgcaacctctgcctcctaagtttcccaggttcaagcgattctcctgcctcagactcctgagtagctgggattacaggcatgcaccaccgtggctggctaattttttgtatgtttagtagagacaaggttttgccatgttggccaagctggtctcaaactcctgacctcaggtaatccacccaatgtagcctcccaaagtgttgagattacaggcatgagccactgcacctggcacattttctttcatattcaatttttgaatattcctggagataatcaccttgcttaaaactattctctccactagaatgtaaacattataagaacagataattttactggttttgttcatagaaatattttcagcatttagaacattgcctgagatggggttcacaacactctactccaaaatatggcactttggcatattgaattttttaagctgaaggaatttgagaaacagcaagtgcagaaagactttatgtccttctcccacccttcacccctgaagcaggtcataagaccctcatgtgagaggtgcccttcttagacctggagggaaggagcatccctatctcagaggagtctgaaggaacaggccttgctaagtttacctgagtttacttatgccctttgtcctatcttctttctctacaactcttcattttacatcaaacctagcatacgaacagccaggtttaactgcttcttcaggtccttaggaaggttccagtgttacataaaacttatattaaataaatgtgtatgcttttcttttgttaatctatttttagttacaggggccccagccaatgaacctaagatggatagagggaaaatatatatttcctcccctgcaattggaacagtgaaagtgctagatacacatttattgaatgaatgactagatgactgaatgaataaatctttttaaatttcccttaagataaactttaaaatatttaccatagtttaccaggctccccaaaaggtggcctttgctttcttgtctcatttctcccttatactctcagttccatttcagttcctgtgttctgtgtccacaacactcttctctttcattttagtttggccagctcccatcattactccaatttttgcatgcccacaattcattgaagaggcaattttaaatatcacctaagttagcttttactgttatgggctctcacaccattctggccttctctgttgtcaatattcagtatcttattattactttcaatatttggaaaaattatctccatgagggcagggatcctctttatcctatttactgctagcataggtacctgttaattataagacaaaggaataactgcttgctgtcctcaatgaaaataagttgaattgaggacatgggctatgttctgacctcatcctccatttatttctcatttctttcatgtcttcttggttttcataccagattctttatttgtctacctaattctggtgttcctaagaatttatgactgctattgagaatatggctggcttaaacatcattttaatgatttttattgatgaagatacattctcataatatcattcaatcctctgcatacatgtttacacacacacacacacacacatattcacatgtatttatgtgtaaaaaaaggaacctgtaatcctaccacctgtaaacaccttaacgttaggtagccttcatttaggatatttctatgaaaaaaatatatacacatacaaaaagtatatggctaaatatataggtagacattaatgtcagttgattgctactttaagttgttttctgaacaattgtttaattccaggtgggctgagatctcttagccatgctgataatcttataggattgtgttgacataaaatgaaataacatttccaagatgctgcaaacagttcctgtcacatagaaagcattatatatgtactggttgttattatcacaatgaaggcactgacccaaaggtaacttgagctgtcacattataggctgaagtaaggtaactataagccaagtgcatataagaaaggcttgcaatatttcctaaaactggccccaagcctttctgtggcaggctttggaatagctgaagccatcaggatgttcttctagctagcaattccgagtgatgtgttactttgaatcagagtcactgaggtgggcttgcacacagctataggctctttggaaaagtgctgtagattccagttaaaggttaaacttcacataatatcaatgcaaaggcatttctaggtttggcatttttcccctacccagaccacccacacacatacacacactcacatgtatgcacctagccagagacaaatcattttattcttctgtctgaaaacctccactggccccacactgtctatataggataaattccaaactcgttaaaggctttactcacaggctggccttaatacctactttaatcttcatttgtaacactctccatcattttactggaggttgacacgtatttaccgaaagcttactctatgtcaggcattgtattaggtgctgagattacaaatatgtttaagggacagctatgtccatgagagactaacatttcagtaggagtggcagatatgtatacagatcattaaaatttagtttgcaaagtgatttaaaggggaaagcagaatttgttttagaaatacagaaggggaaacttagcagtctaagtatatcaaagaaagcttcatagagaaagtaacacctgaacagagtaagggagggtaagtgggagttactcaagtaaagaaagaggggtaagcacattccaggtggagaagacaatatgtacacagacagggaggaataaaatagcattctgtgtggatgagaattatcagcagtctttgacaacagaatgtaaaatgaaagatggaaagcagtggtgattgaaactagaaagatcataggagggtgggaaagaggacattttgtatgtcatattgaaagcttggaatatatcatacagagttataaaaccagtggtaagttttgagtgatgggattcaggacacactaccctgaagtgtggcaccttggcatttgagaaaacagcagaagcaggaaggtaactctcaccttccccccagcattctcccctgaagcaggtcataaaactctcatttgacaggttctctctctgtacccagaggaagtgaacatctgtatatctctaaaaatgcaaggtcactgacagcaatctgaacaaacacgaatagctgagttctccccagctaactatcattagatcatgcttttttaatccaatcatactcctcaatgacttaccacttctctatcaaacctagcataaaaatacacaagttttcctgtttctttgtgttttcctttccctatgtaaaacttatctttaataaatgtacatgcttttctcttgttagtttgtgttttgttccaaggatttaatccacaaacctaggctgggaagaaacgataattactttctcctacatgagcaaggaaataaaaaagacagatctgtattttggatacattattcagtagcaagatcatcttctcccatcagcaccttcttcaagtaatgtgatgacaccatttcttgtgtgcttggaaaaagtttcagcttgctgtctcctttgttgttttaaagaagtgttagacaaagcattgtttgcaaaatctagggagataatggagtacactttgatttgttattctgtgtgagctatgatctaagttattggctctttccaactttaaaaatttttgttgttaaaagcaccttgcttaggaaattttaaatatttatgtctgcaacaattgtctcaaaataataaactgtgccattcctgtcattaaaaaaagacctgaattcttcctgaaaaaatagcaagatcaaaagtggattaagaggcatgtggcataaatctaggggcaagggaataaattggaaagttactgcaatatttaaatatgagatgatgagaacacctcttctgacactgttctcctacctgcttacccatatacagacattcacatgtgctgttaccccagactgaaatttcttcttagttattatttgctaaatatttatatttataatttaggtcgcagttaatttttacttcttcagagagaaattatatgaccacaaatttaaattacgacctctcggatatttccatgtttttattcctgttctttgacttcatatataatttgtcagtgaggcacacaaatagcccattagcaaacaaagagctgactagccatgtgcatgtgttgttttatgtctctttccccacaagatggtaagatgtatgaggaccaggatataggcaacaagtgacacaggaagcattgctgtttttccacctcaatttctcaagtacctaatattataatggaaatagtaataataaaatatttatctgttgaaataatgaaagtgtgtgttcattctcaatatcatagtcttacagaacatgagacaaaaagttacatctgtatattcattcacaaggtgcttagccatgcaagttagttgacgatgcaagacagttttttattttcacaataatccagtttaaaattagaaaaacatgtaaataaatagtataaagaaaagataggaatactgctcctcacccttcttcaagaaaaccaatcatagtatttttttctttttggcatttttactgtgtgtgtgcacacaggtacactatagatcatctattcaacaaaatttatttaaggctttgtgtttagaactggggaaaacaggatgaataagagcatcagaaagctcacagtctaatggcaaaaataagattcaaatgcgatcaaaaggcacttggatgttttattaaatcagattttttttttaagaaaaggaaaagtctcctgtatacataccaatcaccaaagaaaggtgagctgtcttgaaagacccaggatcatggaatttttaataaccagactttttaaataagtgaatacaactactatgagtaaaatcattcatcctgggagggatggagtctaatactgatgactttatgatcttctagcctctagaagttttgtgctaaatccatctgaattctaaaaccactagacaacctgacataccacatggagggctctctgcctgcaaggcttttttcctctttttcttgcatactcagttcatgggtgccctcctcatgctcctatgtctataaatctatgtcctcttattatattgtaatcatatttttacttttttgcctcctttattaatctgtgaacttcattaagatagaggtagtacttttatttctatatttttattttagtggtaggaaaataagcacatgagtgcatttaataaatgtttattgaagaaaaattggaagacagtatgaaaggaatcatattctgtttatatattgtaaaaattagaaaagactatgaaatatagactggagaacatgatgacatattctttaacatctgttggcacaaagaagcaaaagctaaaacaaaacaaaaaagaaaaaaaataaacaagtaaaatcaagtctttccctgtgccaacaatacttaaaagcatattagttggagactcctgatttcaattaataaaaacaattaacagaagaaaagaactttagatgacattctgcccaattcggtgatatctttttgttcttggatatgtcatgacatatttttctcactggctaaaacttctttctcttcacctaaaatgacacacataactgggaccctatttaggaacttctgggaatgtcctgggcatgagggaagaatgcccagtagacaagctaggaatactgatctaattttggagtgaagacagacatataggcagatctctcccagaggtctgaagatttgaataagtagctcagactttgggaagcttgtgttcccaaggaaattatttgttccataaataagactacccaagatgagtaacgcttggggatgtgacccccctctcccacgtctgcaccatttttcagttaatttatatgtggtgagattgtgatagattacctgtgagatcatcagtgggccaagaccccagttggcatgccttgcatgtgtactcatcaaagacatactcattctccttacaaggtgtacaggtccaacaacagctgacttctccctttcggatcacctaaggcaaatatttgaaatttagatttttttttgcatagataaaaatccaacaattctatattccaatgtgctgttttgcaaagcagaaaggcctttcacatacattattttaaatgttttcagataagcagtacaatttttaatattaatttataattaaagaaaataaggctgagtttaaacaagtccagcgtcataaagttagcttgtggcaggataaagaattaaattaaatgaaagtctttggataattagccttggaaacctgtatttaattaagtacctgtgcttgtgctcatatgtagatacacataactgaattcaccccaggatctgctctgcttctcctttccttaagttaagaacttctgctccctggatttaccttagcttccttccctccattagttgaataattgtgagcaaaaaacattgtatatttcctaatcttctaaaatctgtccatattgataaaaataattaggaatttgtattgggtagaacatagcaaaagattaagattttcctggagatgatctcttgatctctttctacgaaaaatctgattcaacaattcaacccattctttcctattttggtagccttgttttgtttgaaggtagatgaggtcactgagactattatatacctcttaatctatctgacttttttaaggtaatggaaaataattgaaataatttaacagttgaaagagtcacagatgttattctttcgaaatagatgtaccttttcttccccaccattggtgcatgaaaagcctctccggaatagacagcattcattaaatgttcttttaaataattaaaactgtgattaatattcagcaatgaccagagacagtaatgattacactttatatttctagtcttagatgctaactctagtaatgacctttgataataacatcagctagatacctatagccaaatataattgtaagctgacaactgtttgttacatttttgtagtatttcttgtgttgactcttaaaactacaaaaatacaagcagggaataatggcaaaagggcctgaaatagcttttccctaaagtaactaaataagtgaggcaaaattgctccttagacctgattaaagtattcttcataataatatcgactatttccaggctctttagtacttgtcacatactgttatcccattaaaacattagaacagctctgtatgaagtagctggtttatttttttcattttcttaggggagaaaactaaggtaaagttagctcacatagcatgttagggtaaataagggatcaaacaatgtatgttggacttcaaatgctcatgcttataaacattgagtcttactggaagatagactgcgtgatattttgaaagacgcaggggaaagagcactggcttgggaatcaagtagcaccagggttctagtcttatttatagccactaagtagttgtgcagccttgagtagtcctccagctaatgctcagtttcttttaactggacctgttgcttttaagataataatatctaccttataggatttccttaggattaaataaaacaacacagtgatttgtaaagtgtagaacactctaataatgttacctatttcattaataatatgcacataaatgtccatatacagaaatgaagaatttcattttcaaggtataccacacttggcaaaactatccttgaacaattattagattttgtaatgcaaacaggcatattgcaaagctgaaggagtgtctttcagaacttagcagggattagcaaataaaagcagttgcatttccccccactagaaataccttgatttcttatggttcagttttcattggtttgtgaatttcaggtgtttattaaaataaattcatgcccttttccaagaagaattccaacattacaatctctttttgaatcaatagtgataacttaatatgttttcctctgataatttagaaattgttttatgttttcatattttatgttctgtttcacatctattttgaacacgaggtagtgacaattctctttcatggcaatttaacattctggaagtagtggtgctttcttttttatttattttattttttgagacagagtcttgcattgttgcttaggctgggagtgcagtggcgccatcttggctcacggcagccttgacctccccagcccaagagagcctcccacctcagcttcctgaataactgggactacagatgtgtgccaccatgcccaattatttttgttccttattttttttgaagagatggggtctcactaaattgcctaggctgatcttgaactcctgagctcaagggattctcccacctcggcctcccaaaatgttgaaattatactcatgagccactgcacccacccagcggtgctttctttatgaataacaatatataacatatctgaaactttactagactaaatcctttcatggaaactaagtttacaaactctggaaaatgccatgagatgttgatatcatgaatgaaatcgctgttaaaccatattaagaaaatcttctaaattgtacatttaatagagtaaaaatgacatctggttaggaaaatggagtttgggatttttaaaaaaggactaagcaaatattattacaaaatgaccagtattaaaaatatgataataggctgggtgcagtggctcatgcctgtaatcccagcactttggaaggctgaggtgggcggatcacgaggtcagcagatcgagaccatcctggccaacatggtgaaaccccgcctctactaaaaatacaaaaacattagccaggtgtggtggcaggtgcctgtaatcccagctactctggaggccgagacaggagaatcacctgaacccgggaggcggaggttgcagtgagccgagatcgcgccactgcactccagcctggagacagagcaagactccgtctcaaaaaaaaaaacaaaaaattctgcatgtggaagttacattttccctttcttccttccctccctccctccttcgctccctccctccttctctctctctctctctctctctttctctctttttctctttctttctttttgacgtagtctcactctgtcgcccaggctggagtgcagtggcgccatctcggctcactgcaagctcctcctcccgggttcacgccattctccagcctcagcctcccaagtagctgggactacaggcgcctgccaacttgcctggctaatttttttgtatttttagtagagacggggttttaccatgttagccagatggtctcgatctcctgaccttgtgatccgcccgcctaggcctctcaaagtgctgggattacaggcgtgagccaccccgcccggccctagaagttacgttttcaaaatgtattgctgtgaagggtcaaaaataaacaaaaattatgtggtaatttacactgtgtaatctttctacaggaagcactggaaattatgaatatggatattcttggtgtaataattcatgtaaataattgtacatgaatttaaacccctcacaatgaagagtttaactgcaagataattggccaagatgaaaacctcttttgtcttgatataacaagtgttagcaaacttttttttgtacaaaggaccaaattgtaaatatttaggctttgggccatacagtctctattgcaactcagcaactcagctatccaactctgccactgtagcaggaaagtagccatggagactatataaacaaatgagcgtggctgtattttaataaaactttatttacaaagacaggtagtaggtcagatttagtctgtgggccatagtttaccagctgttgctgtataccataataagacatacagaaaatttcagatatctaatattttgagccatttagcagacattaattaatttatttttatcttcatttaccttatctttcttctttctggtcttatgctttccaaatcttcagacctaccctttgagggccttactatcagtattaaaatatttcagtttcagtcttaatcacagatgaaaaaacacatgaaatgccttctaaacagagtgaaggtaaggttgattgaaaacaccaagtccaatggctctaggaatacactgcctgaaatgtggtgtggtagtgcttcaagaactgtttgattagcaaataaattattttgatatcatttttccttacggcattgcataccaatagctgccctaactccctttttattatatctttgtcttctcttccttcattgaattttcatttcctgtaagtgtggccacatcttctttagcctaagagtaattttttaatgtcctcaaattaccaaattatccattacatgcttttttatcacatacttctttttcttatactctttatttttttcaattgacacataataattgtacatatttatgggttacatagtgatgttttgatacacatataacgatcagatcagggtaattagcatagccatcatctcaaatatttattatttcttcatgttaggaatgttcagtatcctccttctagctatttgaaactatagattacttttaactgtattcatcctacagtgctaaagaacactagaatttattcctcctatctagctgtgattttgcttcctttaacaaagctcttcctatccctctcttcctccttcccttcctaccctctagtatgctctgttctaatttttacttctgtgagatcaacattttttatcttgcacatataagtgagaacacgtgatgtttaattttctgtccttggcttatttcacttcacattctgttctccagttctgtctacgttgctgtgaatgacaggatttcattctttgttatggtttaatagtattctattatgtagataaactacattttccttatccattcatcttgatactcaattgccattacattctattcaatctggcaggcccagatgaagggtgaaccctcaattttcatgcctttccctcattgttcctcttctttgacctttctcttccactgactaccatcttatgtgacagtgtgctctctagttgtctatctctctgtacctgttgctgctcagcctctaccttttcttccttttttgtactttgaaagcagaaattctccaaggtatattcttggtccgtatttattttttatttacacttttaggttctgcaattttatttattttaatagcttcaactttaactctattcaatcaattcctaaatctgtattcttagctttatttttcattgctctagactaagctttaatcactggatggctattttaaaaccaacatgcccacaaactaaccaatcgctttttctctaaagccatccccatttttctattcctggaaatgcaaccttttagttactaacacttagaatttcagttgattgtgttgacttctttatcttccacaactcggcatcaaattggttgtcagcctgattgaatctacaaacgttttctccaaatgtgtcttctggccccttttcattctgtttcttccctaattcaaggccttgttaccactatcacagcatccttctaacttgtctcttctttcttgtttcataaatttgtttattcatcttccttaccacagctcaacttatgccagcatcttggtcaaaattattctctgactccagtttaataaaaattaagttcaatgtatttagtatgatgttcaaaactctccacaaatctgggttcaacttatttcaactttctcttttataataaccatttagagcattgcactctagattattcacttgtttctggacagtcttcaattgaccacttttgtcccttttcttttactgttctttctatatgaatgttctctccctgaaatcatattcattttctatggtccattgtttgacattttattcagtagaaatatctctatcccttttgtacaaacttatatagtcctcttcttttctttcttaacaaaatcatcacattttacatgatattgcttatctgtgtccatgatattttctcacatagactgtaagtcttctgacaataaagcgtgtctcatttatttttgcctaatcaatattaactattatattaataaacatttgatgaatatttattaaataaattagaattagtgtcttttctaactgtaaactttattcccaggaagtcatgtctttaaaggcttgtatgagcagaaacggtgtgggcaaacatgactcatcaactggttcaatcaaaccaactaataagactattgtgagttgcacatgggatttcacaaggaatgagtgagaatttctgacattagaagcttacaatataaaaagtaaaataagtgtctaaaatttttaaaaatagccaatgatagttaacactgttgaatttacaacaaaaatgaaagaaacatagattccattttaccttgatctggcctttctcacatggttcactgcacacagatctgatgatgttgcttttcttggaccatacttcatcatcatccatttttaattctccattgtcccaacttccaacgttgatataatcaaagtaatcttttcccatttccttgaaattcattatttcataccttaggaataagaatatgataattatgcagcttaagatgtaaatactcagctttgaaaaggcaatatattttattcccaaaaatgtgtctattgtcatataagtagcactggaattttccatgacagtacacttagaataacaaaaaaaatctgtctattttactttctctgcagagaccatttttgtactttcaagcttacacctgaaatagaaagtaatcccatgtgagaaggtgacttgaccccagcaggatgaaagacagtttcgaaataacttcaagaagtttaaacgagtactgttaggcttctacaaaagatagaaaggtttttgtctgtattcaagtaaaatgataaaacttacatttactaaccaagtgagaaatttggtaaatctttcatcttattttcagctttaggggatatagggataatttacagagggcctcattttacctttcttactttgcccattatcaatggctaaattcattgtacaaagatagttttgagagtgatgtttaaaaaagtttgaaaatagcttctaaagcacctcatgcaatgtaaacatcctggaagagagtagttccttgtgagttctcagcctttgctagctattgttttttgagtatgtggatagaaatgtaaaaagagaaaatcaatgtgctaacttacaagccttttcttataagtaagctcatttctagagaagaatctctgaaataattttccaatttgaggatattggataagcaatatcaccattatctcagtttctacaggtatgtctcaggtacacactgtgttcacataatattttatactgtttaccccctcaggacttatagtactgacagatagacatataaatgcctcctccaacttccaatgctcagcatgtgtagctatctggaaactgatatgaatggaaaatgttctcgcttttggattcaagtgatgagattactatacacaaaccaatgttctgtacagaaatactgagaacaaaactggcatcaatctattgaaacttatgttataaaatgatgccattctgttttcactcccagtcacattttttactgtagtttttttttttcttcagaatattacctcattcttgttttgttggttgttcagtaacttgataattttcctgcagtcagtaacaatttggtgtaactgtctaaattctacttctaaatcaaaaataccaatttataggatactttccttccctctcggtcacaattatcctttggcctctgtgcatgcaatgagttgagatattagagcacagagcactgaggtaaaaagaactcacgtattatgtcattggctacttcaaatatatgagctttaagtattcaaagggtgactttctatgagcaaataacctttgaagattctaggatgggagaaagagaaatgtcagtgtcagacttgtttctttgctgctgataatttgaagaaatatgtgggtgtcattccttactcaaaaatgagctgtcaactctgtttctagcaattcttaagtctgaaaagtttagttcacactgttaattttacagataatggactgaagctcagtgaggttaattagtacagattacagagtatgtaagcatcagagctaggacctaaaccaagcctttagatttcaagtctgcagttccttcttccttattagactgctccaaatcctgggtactgctccaaatcctgggtagagctaagagatcatattttccttgcttaaatattgtaaaaatttgaaccaatttatattgtaaggcttttatctctatatccatgcctctttgttttatgtatgacaaatagtaaaaagtaaagagatccagtttttgaaaaataaacatgaaaactctatagattggaaaatcacatttgacagggaacttgttttaaggaaagttaaaccttaatttcagttgaactcaataaacttgttataattacattagagacaatgaatcctctctttggaattaggctttagatttctagtcattgtttcttaatacaaggcaaacacaaagatattatcactcacagcttaagctgtgaaaatagaacattgctttaaaaatcttgttttagtacactaaaaaagagaaatagataatatgtctccacaaaagaatattctcccgttgacttgtgaattggtatgagcccttttaattttcagagatagaatatagcttttattctccaacaaaaggaaaataaagtgagtgtttaaaacatactcttacgtaacttttagttaagaatcaaaagacataatggcttcttgcaatctttagccatgattcaatctagaagactgtattttgttttccaataaaataacagaaggtcaggcacggtggctcacacctgtaatcccagcactttgggaggctgaggcgggcagatcatgaggtcaggagatcgagaccatcctggctaacatggtgaaaccccgtctctactaaaaataaaaaaaattagccgggcgtggtggcaggcgcctgtagtcccagctacttgggaggctgaggcaggagaatggcgtgaacccgggagacggagcttgcagtgagcctagatcgcgccactgcactccagcctgggtgacagagtgagactgtctcaaaacaaaacaaaacaagaaaacagtaattcagtgtgctctttgtttttgatggctttagtaaagatccaacttgcacatattcagtgtcagaagcaaagattagtgtgtcattccaatcacaagacactttaatataaatctccagcccagtttcttttttctccttcccatctccttcctcccatttatctcctcctccttctcttcttcctcaatcctcctcctccttcctcctcctcctcttcctccttcttcctcctgctccttctccctctcccccaccccttccccctctccctccccttccctcaccctcccctggcctttctttttcattgcacctcttggtttctatatttctctgcttctgaaatgtttttctcagcacagtgtgtttgtatatgtaatttatcttctttaatacctgtcccttccttccccttactctctaactcctcatgtctgctcttccttaaccagccaaaatttaaacctagaatattctaaataattttaaaaataaattttatatattgctcaaaatcaaaataaacaaaatatgttacaataacaacaacaaaaagttctattaaagcatttaaggtaaactagagaaagtcaggtttcaattgtacagaaataaggaactttctaaatggctagaactctgaaaattagagaagattgtcttcagatgataatgagggatttattcaaggggctgaaacagggttgttgttagagaaagtgaaaaatcatttggagaagactgaagagtattacttttatgtgggtcctaaggctctttcaatctataattccgatgctaaggtgcttttgttaaaaattcttaaatgtgtgctaaattatctgtgggttggcataataagccctggtccatacaacaaagcaattacaatgatctgtgcctttggggttggacaatcacagagtaatgagagatcacagagttagttagaccaaaaatgtgaatggcacctaataatgcaacacttttatactatatgttaatacattgaaccatttcaaatgtaatataagaaaaaaaaagaaggtaaatttttacttgatgattgtgcctgagatttgcgtatgtccttgccctgttatttaattgactatgcaaccttggacatgtctctttctttctatgacacagattttttaccaggacaatctggacattgaagcagaacatctgtttctatgagcagagacatatatcaagaatccgcatgcacacaaagtcgttatctgccatttctactattctagcctcgtattttctatttaccgcatctgtttgtgctcctctgttctttctttcctgccctattttgggccttttcttttctttctttctctctttctctcattctctttctctctcttttgttctttcttatctctctattggcttttaaatgctcctctttgtattaaaatttttgtggttgctcaagagattacaatatgcatttttattctacttaatattgagtcacttaatgtaaaatataagaaatttggctttgtgcaatttcaaattctttttcatttttgccgttgttttcaaatacttcgcacccatgtacttacaaaccccacaatataatgttttagttttttgctttaattagttagttgtactcagtctaacattgggtgtccacgtttcctctgcctattatggtcaattccgggtggcagccacgcatcttaaactttaattctcaatggagtccctaaacccgagattagcaaacttttgctgtgaggggatgtatggtaaatattttaggctttgagatggtttctattcacctctgccattgtggtgtacaagcagctatagcacctaaataaatcaatgtgactgggttccaaaaaacctttcttataaaaacaagcagcagactccatgtggtctgcagatcatagtttgatgactgatgactggtgatctagtctgttaatggtaaaatagtaaaggtccatatttcttatcggtaattgtgaaatctttagagctctgaaatttttttttcttttttttgtaactcacttggcagcaaaacatgacattacctgaactttatctagggatgaaatgtgactggaactaaatgaggctatttatagtcttgtttatcacaatgtgaatattcgtatgttttgctgcagaaatattaatgtgtttattagggagtgctattacatattatgttaggggcattatatgattgtttaggcttttgtaaattcaaaaattctgggttctgtaacacctggcaccatggttttcattagagcattgggtactgatagtagactaatcagatgagagatttaaaaacaatgattaaaacgtgctaacagtctgcaagtgtgtgccagagtgagttgccatctctctcagcttcctctgtttaggatcctccacttttaactctggaattgtagaggattccttaatcaccccaggatcctttgctttctcactcagctgggaatgcctttgatctggcagaatgcttttgctccacaaaaataacaacctaatgtctacaaataagttttctcagaatatagtgtctttaaaattttgatcctggttgattaattgtcaggctgttgtataatgttagaagttgaagcccaggagacagagttaaaattttgactctatcatttactagactgtgtttttgggcaagtcattgaacttttgtaagctttggttttctttagctggaaaaaagaatggtaacattacttacctcataggattaaaaagtagaacacttggcttagtctttggctcagaacacacactcaatatatgctagttataattttttttgtaaaagtaactggattatttggagaaacaaaaggtggtaaatcaccttttcctgagtctgcttcatgcccttagaggccaactctgataatttattcatgggttaatgttatactcaaacctagtagtgcaaggatagactcaaagcaatcctgaattcccagaagttgtttgcaagattttaagtatgttgttcttgaaagaatagctatacattttgtctgagtcttgaagggatgattgttccaaaaaaagattaagaaacccttacaacatatttggatgattatgaataaggtagcgatgttctgccagatccatcaaggtttcccattggaatagagctggaccttctgaggcatctcctccctccctggtttgcggaatggtttgggtacctgatataaaaactcttgaattggtggagctacagtcatcagattctatcagcaagtcctaagctgatgtcagaactctagagatgcacatgggaataataaattcctgtgcaggtatctgagcccaggccttgacctgagcctaaagactgagctcattggtcagcctgcccttaaaagatttacaactgtgaagttttgtttggccctgagaaaatgcttgtatttttttccttcatggatatacgtaagagccaaaaagtagaaaacaacatgtgaaaattcagcttattttggcaaacagcctagttatagcaatattcttcaagtctctggaatagaagaaaaaaaacctgggttttcacttggctgtatgacctgaaactagctatcacttataagtctggcatgtgaaatagtaacagctgcatttgggataagctccagctcatcttagaatgtagaagtgtgataaaccaaggttgctgacagaatgtgtgggcacatgtggtgtgaattgttggggattcatgaaaccttttggcagggtcaactacaaacagagtgtatagacagttttccaagcacagttgttaagtatgagctattgctagaagggcactgagagaccaaaggaccctattgttttgatacaaggctgagtgaagactcagccctgctacaactcaaaatatcatttcaatggcattattccttatagattaaaagtgtctataagtcttaaatgactatgtagagtcatttaagaatttggagtagaagacaaatgtgaattatggtaagttctgggtacttagtgatttctctggggactgacctatacttatgagtttatgttcctcaagttcctctacaaataataaaaggtaaaatttcagagaaaaaaaacaatttagtccttaacaaggaagaaagtgatccagctggagaataataaaataaaatgtgacttataattcacttgctgtacgtacagcaaacaacagaacagaacctcagccctatttctggattaccagaaatcaaattgttcctatttcagaatagttctattatgcaagaaaatatctgaatatggggaataacatgacaagcatgtacagagaaaccacagagatggtttttatttatctatgatcatgtgagtttcctgcctcttagtttaggtctctgaaatgtgatgattcgcaaagcacattttggacatcagcacaaatgcttttttcctggccacaggaaatggggcttcttctctctatctttgctcatttgggatgtcagggaaggggaaacattaccaggaaacctagattaaccacaaaggagagaaagagacatttcaggatcaagagttggctgttattcagtctctactctgcagaggagaattgtaacacaataccttcctggagagtctccattctcatcgaataggatcgtatctccagaaaccccagtaaaattggttttcatcagggactccaaaagtttccgtccatcaattggcttcatggcatcacagagtcctgcatagcctgggcagagggacatctgcatgttgtggagcccataggccatcgaatagatggcgttgatcacaaatcccattttggaatcctgaacatgatgtgttttcagagtcagagaacctgttgggaaacaaattaagcatagctttgaggtacaaatctactctcgcgacattcctgggtactgaataatgggttacctgtaattagagaatgcactggagcaattttatcagagttagaaccatgggtaacactgagaaacagtaccaacataatgggcctgatagttatcttctgtattcaggtttttcttccaaaactctgaaaaaagttctgaatcaccaacagtagcaagatccactttcttccaaaaccaaactctaagtatgaatgcaggatagaactgtatttctgtaccataaaatgtatcttaaggacagattcatttcattagtatgagctgtgataatatacctttttggttcagaaatcctcaacaaacctccagtttctaaactattatgttctcttacctggcgatactagatattccaccatctgatataaatttacctatttagatttatcacccagtacgtctaatctcaaagcatatgctctctataaactggcctatttgaaagttataaaatataacatttaaactcctttaattcattaattaattcagtaaacatttattagagtcagaatatacacaaagctgtgtaatttatcatctagagaaaaaaagatgatttgaacatggagcttgtacataagaaacttgtccaataacagagataaattatgtaaatacagtgaaaggtagaatataataaatctgtaaaacatgtggaggtaaaatctatagaggcccaaaggagtgagaaatatcccttccaatagaaggttcttgggaactaaggaactaaaggaactaaaatttgttattgatgattgatttgacaagtatggacttagtgcctgttatttctaactgctcagaacttgctccgagtgagggacatcatgctgaacaagaaagaagtgattcttgctctcatttacttagagtctaagggcagatgagcatctatctaagcaggcaattataatgtgttttgataagtactgagacaggactgaatagtgaatcagacctggaagctctctgaagctgagcattaagctaagtatcaatcagatgaagggagagaaagagtggtccaagcatttttgaagaataacagataagatagagcatgctatgtttgggagactttaaggaaatcaatgaccagcacagagagtaggaggtaggagaaaagagagagctgaaatggtagaggaaggcagagatgcttaagccatgttaagattgctgccttttggctaggagcggtggctcacgcctgtaatcccaacactttaggaggctgaggcgagtggatcacctgaggtcaagagtttaagaacagcctggccaacaaggtgaaaccctgtctctactaaaaacgcaaaattagctgggtgtggtggcaggtgcctctaatcccagctactcaggaggctgaggcaggagaatccctttaacctgggaggttgcagtgagccaagatggcgccattgcactccagcctgggcaacaagagggaaagtcagtcagcctcaaaacaaacaaaacaaacaaccaaaaaagattactgcattttatgataagagctttgggatccattgaagtgttgaggctagggagggacatgatcagatttctgttttagaaaagaccaatctggctacattgtggagaaaggtttaaagggctgtaggagtaggactgtcagggaaactcattaagagggaatgcagtgatcccaatgacagaagaaaatgttcctgcctgtggtagaggccatgattatggcaaaggtgtctaggaagtgaaatctatttccaggcctggtgattatagaatgaatagggttaagacatataggaagagtgtggttaaaaaaaaaataggtgaaagaaagagctgaggtaaagccagagcttatcattttggaagaaatgttttctttaagaaaggtgtttttttttttttttttcaacaacaacaaacaacaacaactctccaaaggtagtatgttgttttatggcttcccaaattgtagaggcttatcatctccatcttgattgctggcccaaatactgacacctttaatttccccagtagagagtctccctagagaaactggcgtagtgcattgtgacataatataagatgggaaatcctgcttccatctcaggactagacagtggtcccaggctacactctaggcaaatcttacaatttccttccccacacagactggattcatatttccacattttacctcacactgctggaaattccattattctagttgccaagtcaaacacttttgaatcacttttgactcctctttttccttcataccttcacaactcttatttgatttatcttcaaaatttatctggaattagactacttagcactaatctacttctaccagactcagtatatatcctctcctgtctagattacagcaatagtcttctaactggttgcctgctttctccttttgcccatcttccctgcactccagcctgtttttagcacaatagccttaactagaagtcagatcatgacaatcctctgatcaaacttcccagtgacttttttctcattactaaaagtaaaagccaaagtccttgcaatggccttcaaagacatacaggagcgtgcctcatggtatttcaccccttattcctttgactcaatctcttaatactcttctcgtaaattattccgccctagacacactgactttctcccacatcttcaaacatgctaggcatgcccctgcctctgagcccttgtaattgctgtgtcttctgcctagaatgttctgcccacaagatttgtgcaggacaattctccagatggccttggactgaccaggtttttctccctttcttgcttgtagttctcaacagtaactgtatgatggtctgataatgtaacttactgagatagagactggctagaagagcctaggctctgtttcagtctcaccagaacagcatgtccttcaatgatttagcacagtaagtcatgtgaccccaggatataacacccagggcaggctgctttccagggtcccttatctgctatgcaagtgggttacatgcaattgagactccatccaccctaggcagatttctgagccttgggggagcagctcacaatgagtcctaggcttctgatgttttttgctgcctatctgtaagtaataaacccatttcccataacttgcatatgagtatgttctgtcacacaagttggtaaccagtgcatggtgagcttgcttcacaagttgcagggcatgtttccttcccaatttatgactttactcaggcataatcctctctgtgagaccttctctggatatcctgtctaaattgcatctctacctccccccaccaacactccctatcttcttttgtgacattattttcactttaccaacacctaacatattttataaatttatcttattatcttgcttattggctgtctcaaacaccactcactaaaatataagctctatgaaaacagggattttttttttttttttttttttgagacagagtctcactctgtggtccaggctggagtgcagtggcgcgatattggctcactgcaagctccatctcctgggttcacactgttctcctgtctcagcctcccgagtagctgggactacaggaacctgccaccatgcccgggtacatttttttgtatttttagtagagacggggtttcaccatgttagccaggatggtctcgatctcctgacctcgtgattggcccccacttggcctcccaaagtgctgggattacaggcgtgagccaccgtgccgagcccggatattttcttttttgttttctactcagtgcctagaacaatttctggcacacagttggccaccaataaatatttggtgaatgaattaaattaacaaactgtcttctctagactacccttctattttactttttctccctaatcctacactaatactagtcctaaccattttcttcctcttacttttatttaggctcaggggtatatgtgcaggtttgttacatgggtaaattgtgttgctgaggattggtgtataaatgatcctgtcaccaagatagtgaccatagttcctgataggtagccttccaaaccatagctccctaccacccttcctcttcaagcaatctccagtgtctgttatttccatatttatgtccatgtgtattcaatgtttagcgcccacttataaatgagaacatgtagtttttggttttctattcctgcattagttcactcaggataatggttttgggcttgatctatgttgcagcaaaggacatgattttgtttggctgtttagtatttcatggtgtatatgtaccatggtgcatggtaccatgcatgcatatgtaccatgtctttaaccagtccaccactgatgggcatcttggttgattacatgtatttgctattgtgaacagcactgtgatgaacatataaagggatgtgtctttttcgtagaatgagtgcttttctcttgggtatacactcagtagtgggattcatgtctgttcatattatttgcccattttaaatggggttgttttttgcctgctgatttggttaagttctttacacattctggatattagacatttgttggatacatagtttagaaatattttccccaattctgtaggttgtctgtttactctgctgatagtttcccttgctgtgcagaagccctttgcttaattaggttctatgcgtcaatttttgtttttgttgcaattgctttggggaatttagtcataaattctttgctaaggctaatgttcagaatggtatttcttaggatttcttctagggtttttatagttttagctcttacatttaagtctttaatccattttgagttaatttttgcatatagtgaatggtaggagtccaatttcaatcttctgcatacagctagccagtgatcccagcaccatttattggataggaagtcctttccccactgtttgttattactgactttgttgaagatcagttgagtgtaaatgtgtggctttgtttctgggttctatattctgtttcactggcctatgtgtttgtttttctaccagtaccatgctgtttgggttgctgtagcctggtagtatagtttgaagttgggtagtgtgatgcctctggctttgttctttttgcttgatttgagatctttttgattctgtataaattttaggatgcacatttctaattctgtgaaaaatgaaattggtagtttggtagaaatagcaatgtatctgtaaattactttgagtgatatggccattttaacaatattgattcttcctgaccatgggcatagaatgttcttccaattgtttgtgtcatctctgatttctttcagcagtgttctgtaattcttacagagatttttcacttccttggtaaactgtattcctagttattccttattattatttttggctattgtaaatgagattgtgttcttgattttgctctgagcttggacattattggtttataaaaatgctactgatatttgtacattgattttgtatcctgaaactttaccgaagttgtttatcagttctagaagccttctggtgcaatctatggggttttcttggtatagattcatatcgtctgcaaaaagaagtagcttgacttcctctcttcctatttgggtgccctttatttctgtctcttgcctgattgctctggctaggacttccagcactacattgaatacaaatgaagatagtggatattcttgtcttgttccaattctcagaaggaatgcttccagcttttgcctgttcagtatgatgttggctgtggatttgtcatagatggctcttattattttgatgtatgttcctttgttgcctaacttgttcagagtttttaacatgaagggatattgaattttatggaaggctttttctgcatctattgagatgatcacttggtttttgttacttctgttgatgtggtaaatcacatttattgatttgcgtatgttaaaccaaccatgaatcccaggaataaggcctacttgatggtggttaattaacattttcatgtgcttctgaattctgtttgctagtattttttgaggatttttgcatctatgttcatcagggatatgagcctgttgttttcttttattgttgtgtctctgccaggctttgatatcaggatgatgctggctttgtagaatgagttagggaggagtaccttctccttgtatttttggaataattttaataggactgatactagctcttctttgaacatctggtagaatttggctttgattctattgggcccaggacattttttggctggtaggctttttatttctgattcaatttcacaatttgttatttatctgttcagaatttttatttcttcctggttcaattttgagaggctgggtgttttcagaaatttacctatttctcctaggttttcttgtttgtgtgcacagtgatgctgacaatagtctctgaggatattttgtatgtccgtggggtcagttgtaatgtccctttgtcatttctaattgtgtttatttggatcttctctttctttctttattaacctagctagcagcctatcaatattgtttaatctttcaaaaaaccaacttttgttttcattgatgttttgtatggattttcacatctcaatttcaatcatttcagttctgattttgattatttcttatcttctgctagctttgatgttgtttggcttttgtttttctagttcttcttcctttcctgggtgtgatgttaggttgttaatttgagatgattccaactttttgatgtaggcatttagtgctataaactttcctcctaatactgctttagctatgtcccacagattttggtatgttatgcctttgttttcattagtttcaaagaatttatttatttatttatttattatttttttttattatactttaagttttagggtacatgtgcacattgtgcaggttagttacatatgtatacatgtgccatgctggtgcactgcacccactaactcgtcatctagcattaggtatatctcccgatgctatccctcccccctccccccatcccaccacagtccccagagtgtgatattccccttcctgtgtccatgtgatctctttgttcaattcccacctatgagtgagaatatgtggtgtttggttttttgttcctgcgatagtttactgagaatgatgatttccaatttcatccatgtccctacaaaggacatgaacccatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagccctttgggtatatacccagtaatgggatggctgggtcaaatggtatttctagttctagatccctgaggagtagccacactgacttccacaatggttgaactagtttacactcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcatttcttcatgtgttttttggctgcataaatgtcttcttttgagaagtgtctgttcatgtccttcgcccacttttaaaaatatggaacgcttcacaaatttgcgtgtcatccttgcgcaggggccatgctaatcttctctgtatcgttccaattttagtatatgtgctgccaaagcaagcactcaaagaattttttgatttctgctttaatttcatttttttatcccaaagtcattcaggagcacattgtttaatttccatgtaactgtacggttttgatagattttcttagtaatgatttttaatttgtattgtgctgtggtctgagggtgtgttgggtatgatgtcaatttctttgaatttgcttggacttgctttattcctgagcacgtgctcatcttagaattatgtgccatgtgcagacgagaagaatgtatattctgttgtttttggatggattgttctgtagatgtgtaattagctccaattggtcaagtcttgagtttaagtccagaatatcttcattagttttatgccctgatgatacgtctgacattgtcagtcaggtgttgaagttccccaagattattgtgtagcttcctaaatctcttcatagatctctagaaacctgttttatgaatctgggtgctccaatgttggatacatatacatttaggatagttgagtcttcttgtttgtattgtaacttttaccattatacaatgctcttctttgtcttttaaaaaattatcgttggtttataagaaaagctacccctgcagttttttgttttccatttgcctgatagatctttctccatgtctttagttttagactgtgggtgctgttacttgtgagataggtctcctgaagttagcagacagttgggtcttgcttctttatccaacttgccattttatgccttttaagtggggacattagcccatttacactcaggatataaattgatatgtgagaatttgatcctgttattgtgctattagctgctaaccatttttaaaggatccaagaacacttccttcatgaagaccaccatgattgcagatattaaaattaagttgcactttgaactctggatcattttctctagacctctctctgacactctatataccttattatagaattgtgggaatacttcaggggagcagagtttgaaacatccatttcccaggtcagtcttataacctacctttccctatttaacatgctaagtaaagaagaggttactcacacgatccagaagattgggtattcagtgacaatctctgaggccacacttatgtgctttaccttgaccctaagccatgttctgcaactctgcctcccaaccactatcagagttcagcagtacatgtttttctggctgttataaaaggtgggtttgagtctcattcttttatttttctctcttttgaacagggtatggagatctatgtttgaatcctgttatgtgtcttcctggctctgtggcttggacaggttacttcaattacttaacattcagtttaatcatctgctaaatgatgacccttcttttacaaggataatatgagaattaaatgttatagaaaagtcataggtacatcacacagagcctggcacaagatgcttcctaagtagtaactgtgtcaaaatgtaaatcataataacctttagtcactatatatttctggtcaagactttagagtataaaagtaagtgaaaggtctcacctgatgggatgcccattagactctcaggcagtcactatttagcttttttttctgattttgatttatgcctggtccacaatagacagcaactggtgcaaaggcaattttgagcctttttaatttgtaaattaaatcacagtgtgtagggcatgcttactacactgtttattgcattgaatggggacaatattgacaatttgcatttgcttggcacttttcaacataattttgcatgtatctgatatgtgcctaagcactacaagatagacctgcacagcagaaactatccacactgtatatataaagaaactaagctgtagacaagtgaagtcgattttccgtggtcactcaggcggtaaaaatcaaaagtagacagaaacttgtaatgtcatgactagttttcttgttacactatattgctattcattggaaagaagaaatccctgtatcacctttttaaaaattattctaaataagagataaacttagggaaaacaaatggcaacgatattgaatttttcctacacagttccatgtgtctgttctcttagataatgcctgctagcactgcccaagacctgggcccaggtatgtacagaaggggccgatcaaaacaagatcttaaaagctgacggatgtacatgtttgttcacagttcattaaatcttttgttattattgagcatctgggaacaactggcctatttgagcagcattaggatcttgtagaagtgcctggtgactatttttcctaatcacccagagacccaagtgattgcaaactcctccccctcaaaatgataataataaaaataataataattggaaaaccaacaaaataccagaagagaacaaatagaagtttaacttttgtaatttcttattaagtcattttgatgcttatgtattttacagaaagacatcatgatttgtttcagcattcatgaggcatcaggacttcaagtcatagaaatccaagtttaaattctgcctgtgccatttcacctactttccagccttcttcctccaccagagaaggaagcacatggctgacctttcaccttcttcaggtagctgagacagctccattgaaatgtgtgctaacaaaatcaggactttacaaaatgctttaatctcataaaacccaatcagctaggggctatttccactatagattaagaaactaaaaaaaaaaaaaaaaaaatcaaagttactgtgaatagctggcaagcttagctttttttttaaattggggccagatgtggttggtatccacatttataagagacatttgttaatacgttagtctcaatattatagatgtggtgaatatattggtaaattggggaattttcttgcctcttatctctccaggtttaggtccccatctatcttcactccctccataactccacacatggctgaagggggtgaatatgcaagatgacatcgcactttgtgtagagaatgcctctcaactattaagagcagcagagcagagcatataagagcacagattctggaagtagacagaaggttataatcacagttctgccattttcttgctgttcattgttactagcaagttagttaacctttctgtgcctgaaaaaaaatggttttaaaaatagtatctagcagactgagatgatacttaaacaagttaatactaacaaagcatttgataaaataaattgatttatggtacctggtccctgacccaagttttgttaataataatatgatttcttcacattcaaaatataaagatctgggagaagtttgttgccagaggcattagcaagtgcaaatatgcctaatatgttctttgaggaataaaagaaatgctgaaacataacaaggggaagagaaataggatatgaggcaagagagatgggggttggataagatagggctttggagtgtttttttttttttttttttttttttaccagagaaacattacaatctgattttcattaaaaattttttactttgctgcatggaaaatagaacaacagtggaaaaagggggaaacacaggaaatactgtgacagaatgctgagagattatggtagcttagtccggggtaggattctgaatatattttgaaagcatagagaatagaatgtactaatggataggatgtggagtgttaggaaaaatgaagaatgaaggatgagtccaagtattcagttaagtaagtagacggattagagtgtcattaattgagaagtgagaaatcactaatacataattatgtttctgttctgttttcctataatactagtactgatttttatcatatattaaacattcaatacaaaaattgcctgtttacataactatctctaacctggatctaaggctcagttttgctgtcttgtaacattggcggtgatctgtcactgatttccaggacactgtgggctccctagagacaaggattctgtgttcctcacagatgtagcccttgtatctagcatagcacctgacacacaattggctctattaatatatgttaagcacatgaatgaggccaaaggtatgacagggtgcctcaaggagtgtgatcaaataacaggtctcattctcagattgtcaagtcagtttaccagacagaaagcattcctttgtagaacagcacttgtttaaacaaaactaaacatagcaatgccaatttacagcaggatctgttaggtgggccagacaaccccattaagcaatcttgtgtatttttaccatctaataaaactacatgggaaaaattttggtccaatcaagatggagtaagcacactctgattctcccactgaatacagctaaaaatcctggacagagctggagaagctagttgagaactctgaaaaataagtagtaataagtgaattggggaaaaataacagaactcaaaacatcactgaatcatgcatgagtttcttggacctttttccccaatatcttcagatttagactcaaaagcagccaaatcgtggaactgtgcaccagatgtaagcagaaaaagctccaacagaagtttatttccagtctgaggaaaagaaaatgacaccctacaaatcagagagcatggagaaaattctatttttgtttttccttttcttctagctaagcccccaggtaaccctggcaaggtgatgatagtaagcggtgggtgcaaaggcaacagtgtctgggtggatgcttataactctaaggatggaaacccttctctgtgaccaaaggaactgtatcccaacagtgtgcgggggaaaattctctgttggtttgttcctttctctagcctttccccacttggttcccatggcagggtgatctcagggacagaaagtgagaggcagaggtgaaaactaaagtctcagatttctagccagaagaccaggaggtgggtgggagaggctggaacctggagtgggacagggagacagtagggcagtgaggtggggagtgctaagaaagtagtcctatagcattgagtatgaactcttagtttccccctaagttgtacaggcattgatttgactctggtcagcataccaacttttgagaactcaactatgggatggaacaatgcccagggctaaagactgaccactcaatgaggcatatgtttgataaactttgatagcactgcaaaggctttgaaaactgacagttggaggcgcagcctaagaaggtaagtgggaacttacagactaaactaaccaggttgtttgcctatacttaaaaaaaaatcagtattctccattagatttaaacagcacccaagattgcataacattatatttgaaacgtccagaatatggcaactgtatacaattatttggaagtgatgtaaagagcccagacacttttactaatcttcttgcttcatttttaaactcagactgttgataccatctttctttaaatgatttagtagaattcactgagttatattcaattcttttttcttgctgctttggccctagagagaaactctggctcattaaataatttattagttgactcattcagagattaagtcattgattaaaaagacatttattgagtacttactgcatgtcagacactgtgctggatgctgctgacagaaacataagtaagatgaatctgtgtcctcaaaaaaaaaaaaacgattcaacatataagtatgggctcagtggtagaagcttgtggggaccaaaggagtttcatcttcttaggcaaactttaaagtcttaagtgcgcataataaaatggttcgttttattcaaagttcttttcttatccagtaaatggtaggcatgttaattagttggcatgatagtgcaccaaagaacaggacttcattcagtagtatttactttgttcaacgattattttttagggtctgctatgagccaggattaacctagccatgaggttctgtactaagccgacttgacttgccaggtgctctctggctggatctgcctcacagcagcatgtagagaggaaatggaagcaggaaagggctgcttttccttctttttttctttattcaaaactacatccttgagttagaccacttaacattcactcctaattttcatattgtttaaacaaatcagaagcctccaaaaggattagcagaaactacaactctccaatctgtgattataatttaactttacagccgctcaaaacatgttctttaattcatcagggaaactggaactttgaagtagctgttaaacaaaggaaaatcagactgtcttaacagtgcagaatcaaagaatgtctgagatgcaagagatttcagagagcatctactttacaagctgaagaaaggaagcccttgggctgaatttggcctttagatatgttttatttggcctaaatgccattttatggaaatctcacattaatatcaagctttgtggattctcttgataattcagaagatgtgacaacactggctccatattctcacatggcaaatgctctggaccctgtctcatccaagattgtgaccttctaattttgtccaataaactaattttaaagataaggaaaataagaccaagaggacttccctaaagtcatacctctagttagtagcagctagcctcagaatacttgcctcctaatttcttgggtagtgttattttcattatgtgaggctaaggaaccactgtttaagaatgatttggcaaattaactcatgaccatacaataataaaacaagcagcagtttatttttaaaaaatctggagttaaatctttgtgttagttcttattctaggtactaaaatactttcagattgtcctcactgtttcttctgtacccattagtaaggaaaggatagtaaaaggaaggaagatataagggaagggatccaagtattttcttggaagatgattatacatctggaaaacaccactggataacatactataacattgcaatgaaaaaaaaaactgcagtgaatcaaattctccctactgtcatttattttgtgaatctactcattctttatgcatatggcaaatggatttcagttatgcacagtggatgataccatattttttctgctgtgacagaagggcagaacatccctccctccaagccagaattaatcttttgccattatatgctcccacagaaatgtgtttatatctctattacaacacacaatactttctgtcatgcattagaattatctatgtgcttgtctatgcccaccacagagtaggaactccctgaaggctaacatttgtcatgtttatcttggatcttccatagtttctaacaccatggcttagactaggcaatccatttcttcattttgcatttgctaaatgcctattctgtgcaaaagcctctaaacatatcatgggattcagagattacttcagagtagaaaatcagcactatgtggatcagacacacattgatcttgtttatcattgtatttccagcacccagaacactgctcgacattgtcaggaatataccagtggatcatacttatgatggttgaaggtggaatagacttactgtatggaatctaacataaagtgggcccaacagagaaatgaatgttgtaatgaaggtgcaggtagctttttgggaacatagatcaagtttaataaaacaaatgactagctattgatttagggcttgggcggtgactggtgttgtagggaagaaaacaaatagtctatgaaaagggtggagtaactgatgacatcacataaatcattcatcctatgcctaacactatactgcctattctttgtcaggcagcatggcaatactggaaacccagagctgtatccacatgcctgtagagacaccagttcataatatttgcagtgtctccagtttattttgtgcctgaaatacaggcagttgacctctgaatgctcatattgaaatgcaaatgaacacagcagctgcagaaagaagaggcttcttcagggagcttcaaaaattcaacagggattgcacacttctccgtgcagaacatcaaattttaaatttaaatgattcaccatgaacagccagttggcagccctctgatggatatattattttagataccatatctctcattcacattacagtattttgcagaacttccatatggtgtgtaaatgaaagaattccacagggacatgagggctaatggttatgatattatttaaaagattgtgtggcaaaaaccatagcattagagtcttcttactatactaagatcaaactcctagaccagacttttcccacttggccctgtctgtttatcttcatcgccaccattcttttcaatgagttatattttaactgtgttttataatgtttcctgaagatgtggctttctcatttttgtccaattagcttcttatcatacgttaaaacacaatctagtggtcactctacgatgaatccttgatagcctttcccaggtagaattgaaaatgattcttttttcagggctccctcactttgaaaaggagaaaaataatactttcttttagagttgtgagaattagagataatacatatggaagttatgaccccacaacaggtaccaaataattagaaacttgctaattgttattgtacatctagtacaatttacatacacaagatcactattagtatatttacataattaacactttccatctttgaaaatttgagaattactgtgcttatttattcacacagtgttctagagtttatgcttctgacaataagagatgcaaaaaatttaagttcgttcaagattttatttctaattaaaaataatgagcatgctaaatgaagattccatctcttataataagcactgtaattgaaatgaagtagaaaattgcaaaaacgaattacattgcagtatgtaaacctacaaagaattgaaccagaaaatgcagagttcacatattgcacacatgagagattaatcatcatctctaatacaagagatttgattagggtagaaagtagatctatataaaatgattaatattgaatcatttttatcaaaaagtatttatgaagctccctcttctgagtgtagtggctattgtaccaatggtgcaaattttgtaggacatagatattcctttaaaatcacaacactattttcaaccatggcaataattattttctataagccattttattctgaaatatttcaaaggtagccattaaagaagagataggagaggaaagtagcaccacaggtgctacattctagatgctttacacacttatgacctcatgtagccctcacagcaaacacataagctaagcatcattttctgcccttgcttagatgagatccaagagttagaataaaatgctaaatgacataaagctaaaacatacttggggagaatttcaaacccagttcaatctgactctttcaactatgctatctgcagtatacctaaaacgaacattttctaaattattatcatgtttagaaagaagtaacaaagataagaaactgcttaaatacactatccaccttaccactatgaatacacatttatttcattataacccagacttcaattcctttgatttatgggatcacccagctcagcacatagctcaggagctgcatgctggagggagctacgaggaaggggtgggggcggcagacacctgccttctgacatctgatcttttaatcaaaacatgatatatatgcatgtatttatacaacgagtatgtattgagcagcaactgtgtgccagggtgttctagttaacagagatttcagtaaatatttgttaagaatctagtgtgtcctaaaatccgtaaaattgcagtagaggaattagtctcatgcgtatgcatatggtttagcttatttggagtcatataacctaggtttgaaactattttgccacttactagttgtgtaatcccgggcaagttatttactctgtctaaacattattggatttttgttaaaaggacactaatagtaattatgtcataaaatttgatgggagcataaaatgagattgtatagggaaagtgtgggtaagaatagagcctagcaagcaactgcttgttaagtgttaattatgataatgatgatggtaataagatcacttattttttattttttatttttttgagacagagtttcactcttgtcgcccagtatggagtgcaatggcacaatctcagcttactgcaacctctgcctcccaggttcaagcgattctcctgcctcagccttccgagtagctgggattatagctgcccaccaccatgcccggctaattttttgtatttttagtatttttttgtatttttgtattttgtaattttttgtattttttgtatatttagtagagactatgttggacagtctggtcttgaactcctgacctcaggtgacccgcccgcctcagcctcccaaagtgctggcattacaggtgtgagccaccgtgcccggccagagaccacttatattgtcctcaattatcaaattaagctatagaaatcttcatgattgggctgcatagaatacaaattgcttttctaattttgatggaccccttattttacctagattatggaaaactattattctttcatttgggaaattgaagtagcttttattctcctgtattccttttacttgactgccaagcaatgggaatgtaacccaggctcagtaaattggcagctgtattccaggaatctggagaaagctaagtacagcaaaagaatgatcagtatttatttgcaatcaagttcacgatagggtgcaaatgtagtcatactctggccaaattgctaaaagcagagtttcctgctgcctggaatcctttggacctgggccaactttccaaacttggtcttctagctactagtacatccaggtggtgggggtgggcaatattctttaaattaatactatttacttcatttatttatcctaaaaaagtcaaactaaaattggtttttagtgattgcaacaaaatctctgtcatgagtcaaaatgttgtttggaaaagcaacctacagtcaactggatacatatttactaattatttaagttccaattcaactattgattttcataataattagtggcttggctctattcagtgtttgatgggcttgtatgaaggcctatagtccaagagaattacattattcaactttatatcaaagtagaaccatggaccaaaagttttcctgagccaaattattaaagaaaatgcaaacatcaaattcagttcactactggcttctcctgatctggaatagcataggccttgcaccctggaacctgatttcacaagggagaataccttcccattatctgtgactatttgaatctagtaattctgtgtagagaaagaatcaccagatgaattttcttccttttcttgtctgctgaataaacttaattaaatattgcctgagaggataagagaaaacccggggccatgccttatggacgtactcatgtatgtactccaaagagaatgataaatatgggaggaaggaacaatgacaagagggaaactgaaacaagaaactaaaaatttcaggctgggtatggttgcttatgcctctaatcccagtgctttgggggaccaagacgggaggatctcttgagcccagcagtttgaggttgcagtgagctatgatggcaccactgcactccagcctgggcgacagagcaagaccctgtctgtaaagaataaaaatttaaaaattcaggcatcaagggaacccttattgcagaaaatttgctatgtgcttcttagacaatcaattaaaacatatgttttgctttctaaatttttccatgtgatgttcaataatacctattcaggatttttaaaaaatccccctttgaagttatttactatgtttcagacttaattttcctctgtgctagagacagaggtaagattttgatacaactaagatggtgttattgctaggggatctaggaatacagaattctataaaactatagccactgttctgcatgaggtttacttatgtgatacagtcttaccaaacaatgactgtacctcatatgtgaaattaaaatgccttattattcaaaacatggtcatttggaatgaaataaacctaaattttacatcaaggggacctattcctcagcctcagatgcacatcttacaatagtaagatttggcagctctacagggaacaggttaaagaactcaagggtgccgaagttccagagagccaggatttctacctcactcagagaacagggaacaaaatggccaggcttgcctccagataagaatgtgccccacttcaacttatttccatagcaagagtgtatgaggaaagagagaaaaggctatacccgtgtccctgactttgaatccatagtacctctgcactctatcacaggtggcccagtaagtatcctggaatctagccaaattattatacaaagagtaattttttctaaggaaaaatccttagaaaagaagtatttggtggattttcttctccaggggtcacaatttgaccttcatatttaaaaattattaagcactagcatcgtaccggcattatcctatagaattgtgggcgtgaataggccatgcaacttactcttaagatgttgtaacctagagggaatgtttaattggagagaaagggaggggggcaagggctgaagaactacctgttggctactgtgctcactacctgggtgatgggtctaaccataccccaaaccacaacatcatgtaataaacctttgtaacaaatgtgtgcatatagccccaattctaaaataagagttgaaaaagaaatgaaaataaaagcaacaaaaaaatcagacaaacagcaacaacacaaatccaaactcttcctagaaaagaagagataatttgtagctttggtcaaaggagaaagctataatgatttctcccgtgccacagtctaggcaaaacacaaaaattccaggtagaattcagcggcaacaggcagtgagctctaagaaatgtcacacatatagagcaggtcttaagtgactagcttattttttttttaccagattacctcacactaaactttcacagacatacttcttggccagtatttccaaaaattttgtaaattgagagcagcctttacaatttacaccaaatatagagagatttaacaacttgcccaaggttacagagatagaaaatggcagagaagcactactgctacacacagctttgtataatgccatggattacatagctatagtatagataagaggttttagaccataaaacattcttaaacgttgcttttatattttgctagaatttcacagatgtaaaacgtgacaattaaagcagaatatataaaacagtctaatcggaaaccttctggcaataagagtttgcacttagtttataaatgcacaaacctctccactgtgactcatagagatttctgacttgtgtttatttgagtttcatttctccatacaatgtaatttttggttgaattctttcttagatttacattcttttatgtgttcggaagtgttgtgattcttggctctgtgaaattgctaggaaaaaagtgcagaagaaatattcctaatattgttgtaatttattgagttttattaaatgccagagactgtgtgttatggactaaattacgtcccctcaaataccctcaatatgttgaagaaactctaattcctagtgtgatggtatttggagatgaagttttgggaagtaattaggtttagatgagctaatgagggtagcctgttcatgatagggttaatgtccttaagagaagagataccagtgacttgataaagaagatacaaaaaaaatttgattcatgccctgaatttctctccctttctgccaagtgtggacatagcaagaaggaggctgtctgtaggctggaaaatgaggcttcaccagaacccaactatgttcacatcctgatctccggcttccagcctccagcgctgtgaaaaaaaaaatttgtttaagccactgtgtcaatgttattttcttatggcagcccaagctgacttaacactatgttaaatgcttcataggtactattccatgttcttctcataatatctctatctgctaggcatttaatattatcccaaatttacaactgaagaaagtgaagaaagagagtttaagcaatttgtccagtgtcatagagctattaagtggcagagccaggatataaatctagcctgtcaaatgccaaagcttgtacaaaaccactttactgtgatgtcttcagtgtgcataacttttcatttccataaacccaccactcacaaatcaatcaatttaatcacattatcacatttattaatatgagatacatgagtttaccctataatttctttgtggcacatattttaggtctgatggacccagcttttcctgcagttactatctgaaagatgcacattagggatagtttctagccttctattcactcttagtaattttgcaccagggattcttcattaccactgcatgtcattaagatgtcagatatactcctcctaattggctgtacaacagccacatgtgcatatttcaaatttgaaatattttaagcagaactcatcttctgtacctcaatctcacccctttccctatttctctacttgcaaaattttctcaatcacctaaaattgaatcttttaagtcacccttgtcttctccctttccttcagccctgcagaggatcaccaagtttacctcattcttctgtcacctaacaataacttctgtgacaccctcaaattcccagcagcttaataaaataaaggtaatctctccctcacccaacaaattctgaattatactgtcagattaatatttttaaatatggtttttgattacctcgttttcttcaaaattcttcaacaattaagatatagaagaaaattccccaaatcatggtttggcatgcatggttaaaaacatcttttcaaacttgcattcccagccttatttgttacaatctatgacactgagtaggacatgtattttctcaactccattattcagtttgccaaactgtttaagcttgaaatactctgcctccaactccctgtctcacagcccaactaaacttcaggattcaactcaaagactagctatgtcattaatccctaatttccccagatgcatgcattctctacttctctaatgcctagagcccttaagtcacatttcaactattttctacttatcatgtgtaaccttgtattgaaggtattcccagataaattataaaatacctgatggaagagattaaccgctaactattcttggcctcctctcttgtaactcttaaaaccagttcagaatcttgcttaatggatgtaagaagtgataatttgataaagaagatatgaaagaaatttaactcatgccttgaatttgtatcaatacttcattggaaagaaatcatgtgccatttaggttatatttaatatctgctctgatagtcatgaacccttgagctgatcagtaaaatgttttccaagcaacagctcaaatatcctggatctattccaaaataaattgaattggcagggtcagtgggaatcactatggtaacagatggatcctttaactcttgtagtcactttggtgtagattggcatttacatatcatgacaaagccctgctgctgtccatcaggagcaggagaaaggtatatcaagtcagggtaattaacagtagctgctatgacaacagactcaaataaccagtagcttaatacaataaaagtttatttcttgcttatatcacaatctaatgtagattgtgaagtgctcctgagtcttttaagtgactcagagagccaagctctttctaacacatgattttgccatctttggatccctttttttctagtcacatgaatgtaggagggagattgagaccaggatcttttgtgaatttttagaacgcaggcctctaagtagcacacatcactttagctcatattctatcaactaattctagtcaggtactgcaaagtaggtttgtaaatggtgctttcctatgtgctcaggaaaaggaaatggatttgctgaacatctagcctatctttgccataccaaagcttcagcacctgaaggaatttgatatctggatctgatggttattattctggaagaaggaccctgaaaaggcatttgccctgggtctattggtagcggcaaaattcttttaacataaaattccttcaaataaccagaccttctttagtagaattccatggcagggctatgctcagtaatacccaacaactttgcattggtattcattctctagctcaaatatgtcagctatgcgccgtacatatctatagtcagctgcaccttacctatcccactttatttctacctatgtatagtgtcttctctccttgttttaatcttcctaatccatttctgtctgtgaacatggcaggcaaattctgagaccccctccagaggtagagggttttgggaattagaatgccttctttattgatcacggacaaatagaaaacctcttcatgatggactcttctactccagctccacttccctatttcctcaggctattctctctacttggccacttacccataccacactcgcttacccacaggatacccatgctgtctcctccaattgcccttggatactctgacctgaactgatttctcctgtccacagacttccatgacttactctttgactcacacattccagtgatgtttgataatcagacaatctgcttacagctccatggcagtcaatgttatctgctacaaaaaaggccagttcaagtcctgtctttgtctaagtcctctagtggcttcatgtctcaattgagtaaaagccaaagtcagcacagtggcccacacagctttccaagatctcaccttctgtgacctctttgacattatcttctacttgtttccccaacttactttgctccagccactttggtctcccatctgtttccttacctatgacagttcccacacctctccaggctttattcctgtgatttccttctcctgaaatcatcttctcccttaacgacttgggtcacaccttcctcactttctgggctttatacaaagtttctctcttcagtaaggtcaccctccccaacattctaaatcctatctccctgatttatttttcttccagtaattatcaccatctaatatagtatatatttcacttatctattttgttttactctgtctcccctaacaggaatgtatgttccacgaaggcaagaatttttgtctgttttgtttacttctgtaactccagtatctaaaatgcctactgatacatagtagttattcaataagtatttgctgaagggataaatgactcttctagttttaatcttttagtatatcttttattccttagcagaatgtagagaccctgaagttaagtactagatcatatatttgccttgtattccactccagggttgcccaatgttgcaaagggcttaataataatttactaatgtaatacacacacacacacacacacacacacacacacacaaacacacacacacacacatattatgatggagtttcattcttgttgcccaggctggagtgcaatggtgcgatcttggctcactgcaacctctgcctcgcgggtttaagccattctcctgcctcagcctcccaagtgtctagtgttacaggcatgcaccaccatgactggctaattttgtatttttagtagagacggggtttctccatgttggtcaggctggtctcgaactcgtgacctcaggtgatttgcccacctcggcctcccaaagtgctgggattacaggcatgagccactgtgcccagccatttattatattttataagtcaagatctttcacatcatttcttagtgaccatatctttgatagaaggctctcctgtcttcagtaccatgtcacagctgtggggacagcggtttctttatttagtagccatctggactaggtgtcagttctctgtaatttttaaaggtagtgacactggcaattactgaaatgtcaaaacactaggccaaccatgagggctgtggcaaaaaccttcccacatagttgtcatggtgatgtgggcaaactcatatatagcatctgacactcagccataaaattgaaattaaagttagctttttataatatcttagagaatggcacctgttataaaacaggtataccgtaccaaaacacctacatgcatatgaagaataaggttatgaataggcagaggaaacatctgttttttgtttttatattaaatgttatattctagtaatatgctgtaaatcatcattcctagcctagatattattgggatatatatttactaataccacatattgtatttcttttccacaacaacctaaatgcaaatattttctaaagcacaatcgattgtaagtgtaaagttttaatataacatttcttgagatcctttcataggatctttacctatatcatgccattttatccccatcatgactctaaaatataattattgtctgagttgtataaatgaagaaggcagggctaagtaactggcccccggttacagagtgagtgaatggtggagctgaatttaacataagtgatcactccaaagctctcactcctgttcatttcacagcatggcttacctgagtcatctgagagactgggagagaatgaatcactgagcagctcaaaagggataagcttagggattaaaagcaggaggagaagaacatccctttgtaaagtaaatttccatttggttacagacatcaaaatcacaaaagatatgagagataagggacttggttatttgctagaattctttgaagcctgagaaataagtctgaaagaggattattttatgttttatagatatatatgtataaaaggacaaatagatatttgtccttatacatttctgaacaggtttattaaagtactattgacatagaataaactgcacatattgaaactgaacactttgataagttttcacacatgtatactctcatgaaaccacacaaaagtcaagatacttaacatatccatcacctccacgacgttcctcccgcacctttgtaatccatcactccccattcccatccccaggcaaccactgatttgctttctgtcactctagattactttgcattttctaaagtttcatagagattgaatcacacagtatgtactttttttttttttttttttggcaggatctaactccttcatcctggctggagtgcagtggtgcaatcctagctcactgcaggcttaagcgatcctcctgcctcagacccccaagcacctaggactataggtatgcgctgtcacacctggccaatgtttctatttttttgtagagtcggggtctccctatgttacccaggttgatctcgagctcctggcctcaagtgatcctcctgccttggcttttctggctacttagactcataattattttgatttttgctgtgttgttgggtgtattaattggtcattcctttatgtagatgagtaatattccattacatgaatatatcacagtttgtgtattctttcacctgttggtgaatatttaggttttttggcgtttgagctattacaaataacatcattttgaacattattccttaaatacttaggagtagaatggctgcaccacatggtgggtatatgtttaactttttaagaaactatcaaactattttccaaaatggttatagcattttatattctcatcaacagtacgtgagaatatttgttcctcaacattcttcccaacatttgatatgaccaggctttataattttatccatactaataagtgcatagtgttatcttattgtggtataaatttttgttttcctaatgattaatcatattgagcatcttctcctgtacttatctgcaatccttatatcttctttgatgaaatgagtgttcatcaatattttgaacaagcatgttttgaatagtcattttatcaaagaagatgtatggttggcagataggtataggagatgctcaatatcagtaatcattaggaaagtgaacatttataccacaataagataccactatgcacttattgggtcatgtatcctgtaaacacataaaccacaaaaattaaaaatgactaaaagaaatggcttttcattttgctcattttaaaaactgcattgttattattttttaagaatttctcatctaccccaattataggtaaattatatagaaattcttccaatctgtgccttttcttttccattctcattacagagcaagtgtttttaattttgatgaagtccaacacagtcattttttcttctactgatcgtgttttgctgtcgcgtataagaaaccttttctaacataaggtcatgaatgggttttcatgttttcttatagatattttatagttttaggtttcacatttatatctataattttcattttttgagatggattcttgctttgtaactcaggatggagtgcagtggtgcaatcatagcttactacagtgctgaactcttgggctcaagcaatccttctgccttggcctctcgagtagctgggactataggcaggcactactgtgcccaattacctgactaaatttttttattattagtttttgtaaagaggcagggggtagtttcactttgttgcttagactggtcttgaactcctggcctataatgattctcttgacttggccttccaaagtgctgagattataaacacgagccaccgtaactagctaaaattaatttttagttaatttttatatacattcatacatcacttaatgacaaggatatgttctgagaaaggtgctgttaggcaatttcatcactgtttgaacatcttagagggtggttatgcacaacctactaaatacataagctatatgatatagctggtttctcctaagctacaaacctgtacagcatgttactgtactaaatactgtgggcaattatacaaaggtgtaagtatttgtatatctaaatgtagacaaagtacagcagaagtgtgacataaaaggttttaaaatggtatacttctataggatatttacaatgaatagagcttgcaggactggaagttgttctgggcaagtcagtgagtgagggtgagggaatgtgatggcctaggacattactgtatgccactatgactttataaacaatacacccttaggctacactaaatttataaaaaatattatttttctttcttcaaattcaccatagtttactgtaacatttactttataaacttttaatttatttttaactattcaactcttttgtaataacacatagcttaaaacacaagcacattgtatagctgcacaaaatattttcttctttatattcttattccataatcttttcctattttttattttttaaatgtttttgttaaaaaccaagatacctacacacattagcctaggcatgcacagggtgaggatcatcaatatcactgtctcccacctccacatctcatcctaccagaaggtcttcaggggcaataacacacggagctgttatctcctatgataacaatactttctggaacacctcctgaaggacttgcctgaggatgttttacagttgactttttatttcttataagtagaaggagtacactcccaagtaatgataaaaatatataatagtaaatacataaacgttattattttcaaaattatgttgtatacataattgtatgtgccatactttcatgcaattggcagtgcacagggtttatttacatcagcatcaccacacatatgagtaatgtgttgcaccatgacatcactaggcaacaataatttttcagcgccattataatgtgatgagaccattgttgtatatgtggaccatcgtttactgaatcgttatgtagcacatgactctacgttgcaaggtgtagactgaattttggtggggaggaagggcacgtggatataaaaatttttcagtagcatttgttaaaaagcttatcctttggcatttagattatttccacctcttggctattgcagctaatgctgtgatgagcattgggtacagatacctctttgatatactggtttcatttcctttggatatatatccagaaataggattgctgtatcataaggtagttttatttttaatatttttaggaaactccatcctattttccataatggttgtaacaatttacatttctaccaacagtatacagggttcccttttctctacacccttgccaacacgtcatctctttcatctttttgatagtagccattctaacaggtgtgagatgatatctcattgtggttttgatttacatttctctaatggttagcagtgttaagcacttttcatatatctgttggacatttgtatatcttcttttgagaaatgtgtattcaaatccttagtccaggttttagatatgttattatttgtgtttatgtgtgtatgttttaattttgctattgagttgtttgcatttgttttatgttttgaattttatcagatatatggttgcaaatattctcttccattccttaggttgtcttttcactctgttgattgtttcctttgctgtgcatgagctttctagtttgattaaattccttgtctatttttgttttcattgctatgcatttggggtcataccccccaaaaaatcatcgtccaggccactatcaggaagattttccatatgttttcttccagtagttttatgtttctaggtcttatgtttaagcctttaattcacgttgagttgattctcgtctatggtgtgaagtaagggtccaattttatttttccacatgtggatatccagtaaatgatactaatgtattaaaattttagtttctaattatttactgctattatatagaaatacaattcatttttctataattcatatcttctattacaaaaatgtaataaactcactagaacttagtttgtaaacaccactgcttttctagaaagacaattataccatctgttaatagagttttactccattctttaaaatctggacatcacttatttttttcttgacttatttcactgactagaacctatagaattgaaagccaacctcctttcctgaccacagggaaaaatatttttagtagattgaaaaagattctgccaggcacggtggctcacgcttgtaatcccagcactttgggaggccaaggtgggtggatcacttgaggtcaggagtttgagaacagcctggccaacatggtgaaacactgtccctactagaaataccaaaattatctgggcttggtggtatgctcctgtaatcccagatactcaggaggctgaggcaggataattgattgaacctgagaggcttgaacacaggaggggaggttgcagagagctgagattgtgccactgcactacagcctgggtgacagagcgagactgtctcaaaaaaaaaaagagtttctgtctatttttagtttgtgagtcatttcatcaaaaattattataataggttttctcattaaaaaatattatatgttaatacaattccatgaatcaatttttgaatattaagccaaccttacatttcaagataaacaccacttggtaataatgtattataatttttaaatgtgttattagtttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctattttggtaccagtaccgtgctgttttggttaccgtagccttgtaggatagtttgaagtcaggtagcgtgatgcctccagccttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcatgatataaagacttaaacgttagacctaaaaccataaaaaccctagaagaaaacctaggcattaccattcaggacaaaggcatgggcaatgaattcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacagtgaactcaaacaaatttacaaggaaaaaacaaacaaccccatcaaaaagtgggtgaaggacatcaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggagtgtaaactagttcaaccattgtggaagtcagtgtggtgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaacaatgatagactggattaagaaaatgtggcacatatacaccatggaatcctacgcagccataaaaaatgattagttcatgtcctttttagggacatggatgaaattggaaatcatcattctcagtaaactatcgcaagaacaaaaaaccaaacactgcgtattctcactcttaggtgggaattgaacaatgagaacacatggacacaggaaggggaacatcacactctggggactgtggtggggtggggggaggggggagggatagctttaggagatatacctaatgctagatgacgagttaatgggtgcagcacaccagcatggcacatgtatacatatgtaactaacctgtacattgtgcacatgtaccctaaaacttgaagtataataataataaaatttaaaaaaaggtattattagatttgatttaaaaaattttgtttaatatatttacatcagtgttcatgaggtctatatgaggtatattggggtataattgttttgtttgtttgtttgtttgtttgttttgttttccatgagatattttcgtctggttttggtacctgtaattctgtcttcattgattgaattaggaagtatttctacttctttacttttctggtagagtttacatagaattgatgtctgtttttccttaaatgtttggcagcagttcaccagtgaaaccaatctgggcctggagttttctttgtgggaaaatttttaactataaattcagtttaacaaatataggaccattcatattttctctttatcctccagtgaacattggtagaatgttaatttcaatgaatttttttcattttatctaaattaagtcataaagttgctcatagtatttattttctttttcatatctataaaacctgtagtgatgttgcctcacccattcctgatattagtaatttgtattgtttctcttttcttttttttctgatcaatttgatttttcaattttattgatcatttaaaagaaacaggctttaattttattgaattttctctattgtgtttctgtcttctgtatcactgattttcactctggtctattatttactttttctacttactttgtggttaatttgcttttcttttacaaatttcttgaggtggaagctgtggccattggtttgtggtttttttccctaatatttaatgctagaatatgtccttaaaatattgtttgaggtatctgaactacgtgttttttccattctgactccgttaccatatgattgctgggaacagtgttctgttttaagtggttctgtcccgggtcatgcgtgtttgatgaatactccgctgaatgctcaggagggagcctctacacatctccagcattctctcttcacgcagttctctcctctctgattctgtgctctacaaactctagctttgttgacctctctaaactcaattccattttctcactttagaagggtcacatcttttatttcttgtctcttgagaataatgtcttcattgtttgaggtccagtgtcttgcaaacttgttttctgaattttgtctggttttgctgctgttgttatttcaagcaggagagtaaattccatttttattacttcatcttcaaaagaagcagccattttcccatacatcatcatatgtaagcctcatgataatctgcaagttcattttttttttttttgagatggagtctcgcactgtcacccaggctggagtgcagtggcacaatctctcctcactgcaagctccacctcccaggttcatgccattctcctgcctcagcctcccgagtagctgggactacaggtgcctgccaccacgcccagctaattttttgtattcttcaacaagcttatcaggtctcaatttggtgaattttaagtatctttaacataccttgggttcaaattctagtgccttaggagtttgtagaaaattggtctttttaaattaagggctttcttctgggatctcactgagtattttttgacagtggatattcatcattgaaaactgcctgcactaaacacttacttgagtggataattacaatcatttcttaaactctggaatttaaataagaaatgtgtaaaattatttctctcaaaacttccatagctggggctttgatatagctttatgttctatttccttaatgctgactccaacgtggacaaactttcattcctttggcaatgaaacatatcaaaatacaaataattcaagaatgggtattaagccaatagtgtcacatgaaattctaattaattttgtctgatatgaagacacaaatgggcttctgatcgggatattttactacatgcactagtatcatgtgatcaaaatttttcttcaatgtctgttattattgttctagtatagtctttcctaaagtatggtgctaatcagtgttaaataataatgtgagttcagagttctgagagtaaaaacttgaactctactttttctattctctcactcaacaacaatcatcacagaagacttctgtgaccacatgtgtggggttttctccatgaataagcaagcaatcagttctgcagcaaacaccagctgagtgtcctccaattaaattctgatactatctacttggagatggcatcagatcccacaggttaatggagtcctcacaagactaccctccctcttcccaccagtaataagtctgggcctccagaaattgtgaccaaccggcttgaaggtgacattcacatgacctctggttgggttcagttgatttgttacagtggctcacaaaactcatagaaacttacatttaccagttcattataaaagatattacaaagatacacatgaagagatgtatacagtgaggtatagggggaggggtgtggagcttccacgctctccctgggtgcatcatcctcaggaacctccattagttcagctattgggaggctatctgaaccctctctctttgtaatttatagagatgccattaattagacatgactgacaatactgtaaaaatatgattggacaaaaagtgtagattcttcttggcttctgtgttgggggttcttgaattgctataaagaaatacttgagactgggaacttaataagaaaagaagtttaattggctcaccgttctgcaggctgtacaggaagtatagtacaaacatgtgcttctggggaggcctcaggaagcttttactcatggtggaaggtgaagcaggatcacacacatcacatgccagagcaggaccaagagagagagtggaggctgggacaagtgccacactttacaatagctagatcctgtaagaactcactcactgtcatgagaacagcacaaaggggatgctgctaaaccattcattagaaaacttccaccatgatccgatcacctaccaccaagacccacctccaacactggggattacaatttgacatgagatttagagaggacacattaccaaaatatattatgctgcccctggcccctcaaatctcatattctcacattgcaaaacacaatcacttctcaacagtcccccaaagtcttaactcattcctgcatcaacccaatcagcagtcccaagtccaatacctcatctcagacaaggcaagtcacttacacctatgaacctgtaaaatcacataagttatttactcccaagatacaatgggggtttaggcattgggtaaacattcccattccaaaagggagaaatttgccaaaagaaaggggctacaggacccattcaagtttgaaacccagtaggggagttatccagtcttaaagctccaaaataatctctcttgcctccatgtcccacttctagggcatgtgggtgcaaggggtgggctcccacggccttgggcagctctgctcctgtggctttgcaaggttcaacccatatggctactctcacgggttgaagttgagtgcctgtgacttttccaaatgaagggtgaaagttgccagtggatctaccattctggggtctggatgatggtggcccccttctcacagttgcactaggcagttccctggtggggactgtttgtgggggctccaagcccacatttcctatccactcttccctggtagtggttctctgttggggctccaaccctgcaccaggcttctgcttgggcacccagtttgtctcatatagcttctgaaatcgaggtagaggctgtcaggcattcttcactcttgcagtctgcatgcccacaggcttaacaccatgtggaagccaccaaagcttatgacttccattctccaaagtggcagtgcaagatgtatgtgttctcctttgagccacagctagagcttgagtggcctggatgtgggtaacaacattctgaggctgcaaagggcagcagggtcctggaccaggcccacaaaagcattcttccctcctagacctctggacctgtgatggaagcagctgccacaagggtctctgaaatgcctaagcggcctttccctcattatcttggatagcacttggttcccttttagttgggcaaatatctctagcaagtggttgctccacagcctgcttcaatttatcacctgaaaaagatctctttctctgccacacagtcaggctgtaaatttttccaacttttatgttcttcttctcttttaaatataagttccaattttaggtcatttatttgctcccacatctgagcacagacagatagaagcagtgaggctacatcttgaacactttgctgcttagaaatttccttagcaagatactgtaaatcatcactctttagttcaaacttgcacacatctctagggaatgaacaaaatgagccaagctctttgctaagacatgacaaggatgaccttttcactagttcccaataacttcttaatttctatctgagactttatccgcctgaatttcactgtccgtatcactatcatcattttggtcactaacatttaactagtctctaagaagttctaaactttcccttatcttcctgtcttttcctgagctcccccaaatcttttgacctctgcttgttacctggttccaaatgtgcttccacattttcaattatctttatagcaatgtcccactccttgataccaatttcctgtgttaggtcatttttacattgttattaaaaaatacctaagactgggtactttataagaaaaaaatgtttaattggctcgtggttctgcaggctgtgcaggaagcatagcgctggcacctgctgctggggaggtctcaggaagcttttactcattgcagaaggcagagcgagagcaggcacatcatatggccagagcaggagcaaaagacagagtagggtagaggtatggtgccatgctttacaactagatctggtgagaactcattcactattgcaagaacagtctcaaggggatggtgctaaactgttcattagaacatatcccccatgatctaatcacctctcaccagactccacatccaacactggggattccaattcaacatgaggtttgagcagaaacaaatatccaaactatatcagcctttctgtgcagcattccttcctctagaatatggaacaggatcccttctgaaggaagatcttatgatctacaataagattagggaataatccccaaaaatgtaaccatggaatccttttctcacactagattactgttctctccaaatacaatcttgaaaatgttaatgtggtgcaaggatgaggaatctcaaatctgggtgttagctgtagcagttatttaatttaattttatttggctcttaaagtactattccggtattctagctactctctcccaagcaattcttttctttcagtagatttttttttattttccccagtcatattttcagtttgagagatactcaagtgttctgagctatggctaagccattaatgaacatttcaaagggcataaaagatggcagaagacaacattctgatgcataaggaagtatcctctaacaacccacttcaaatactagtgagacatattcatcagagagattgtagacaactctagattgaaacttactttaagagaagaagaaacacttctaagctagtgagactaacctttttgaatataaactctttgaatgtgaaaaacttgcacacattctacaaatattatttgtacttttagtatttttgatttagtaagcacataatggccgtaaacaactatgatttcaataattcttaatttatgattttgtaacggcaacagtttgtacatacacacaagaatatgcaaggcacacttcagtccatgaacaatggtcagttatatgaggattttagacccaggcaaagtatctacagtgacccagagtccctgcatcccacaaattggggactgcggtcctaggtcctctagctttttaacactatgagaaataaagcagcatttatctaacaacatttataaaatgcttgccttatattcaaggcattgggatagggatttggaaaacagagatgataaagatagcgcctctccttgagacatttataatttaatggagaaagatgaatataaaatgtttgcatgctggtctaacaatttgaaaaattctacttatttgttgatgtaatacagcaagaaaaaattctattgactgtagttacttcagcatctgtggatggtatcatttttctttctgcagtaaactactttctgtgtggcaaagtaactttatcccaaagcagttttgggttcaaaaggtgagcatctctgtccaagggtagaatttttgaagaatacaaggaaacaaagaaacagctaaatagctctacacatgaagtggagagaaacttgtgttagtgtgtagaaatactgagaagagaggagggaaagattacagagaaagaaagggagagaattaagcaccacagtggcaaaaagcttgtagaggagtgggagtgtgtacaggagagcactgtggggaaatgctacagggaaagaaatttattttggtcactatattagtgaccaaagggtcacttttataggggagtggttgttaaggtaaacacttagacagtaaagcattaatgtaaagaagttcaaaaaccacaatggtacatgaattgttaagataaacacaccctgataaccaccactgaatcaataaatgacattgctacaacccagagaaatctcattgccaatgtacttttacattgctctgaacccgttcatttaatcttcattttattaacagtagtttggtacacatagagatggttgtgtgagtagttccttgggggaacaaaaaatggggaagtatatctgtgctcagtgtctggattcccttgtagcaaaaagaagacaaaaggtaaatgaggtgaaaagtgagaaaattaaagtcaaagtaagaacagaaaactggagcgattagaaaccatgagagtgtgaattcattggaactgatacatgtcttgaagtggacttttcactgagcaagatttagcatgtacagaaacacaggagcttaactgggcatgcaattttaaaatgaaagatcacaattcatgaaatggtgggaacacagatttcatgggtttaagaaataggagatgaggcataaagaatataaatgaccaatttgaagagttttgactgaggcagagtttggcttccttttgtagacattgtagaaccaaggatgatctttaagaatgggagtaacattgatgagatttgctctttaggtgaagacctttgaaactaatttttagtatcaaatggggaaggaaaaagctgttatcaaaaacattagatagggggattttaatatttaaggtgagggacaataaaaattatactgaaaacagtagaacagagatgtgaattcaggtaacaatgaaaaggagggaacagaagtataaaatggtgtaacaatagaatgaacactattttgtcaccagttggctatgcggatggaagaggtggggactactcactcctacaccttgagatacagcatggatgagtgtatcatttacttcaactggggatataaaaaggaggaacctaaagtttgaggtggtggttatagaagttataatgaagttaattttagatgtttaagtttgagatgcttttaggaaatttaggtgaaaatgtctgtttgttgtcttaagtgacactcctggaaactactggagatgacagggagaaattatagaaaagatacaataaatgaatgtcagcaagtgacagtatggctgtaaaggaaaccatccttaaaaaatagaatagcatagttattaggaaacagttttaacttaattatttgtagcttactttattactgttaaatatactattagagaaaaattatactcttaatacttcttattacttttaatttattattaaattcgacttataatttaagttttccataactgtgccatttaagtaaaacatactgaagtcaggctcactgttaatagtatatatttctggactcaaataataccaagtagttaaaacatttaagggccatagtaatatttagatttaagtttttaaatgcttagaaggaaaacaaaaattaacaaggctacaaacactttagacattgtaagtgacaagctttatttatacaacagcattaggatttcagaagtagcaacaactaagaataaagagtagaggaagaactggtgttaggtaggatggagaaggaagcaaatgaaaattcctttactgcatacttgaaaaggtgaaagaaatgggaaagtcaaaaatcttaaaggcagtgaagatatatagaagcaacaaagacaaaatgaactaacacaaagagaagagcagcaaagaaggagggtgtcatcagcttcttttgttgcctaggatacttgcaggttctgactgcaaaattcagtttgaggatctctcttggttaaaatgaaggaatgttaattttctaaggttgccattacaaaaaaaaaacaccacaaattggttggcttaacacagtagaaatttattttctcccagttctggaggctagaagtctgaaatcaggtgtcagcaatgtcatactccctctgagactctgggtagaattcttcctaacttctggtgatgaccgtcaatccttgatattccctggcttgctcctgcatcaatccaatcactgcctgtgtcatcccatggtgtcctccttgtctccctttctgtctgtatgtctcttcccctctttttataaagacatctatcataccgaattaggggcctaccctactacagtatgacttcatccttattagttatacttgcaatgagcctatttctaaagaagatcatactttgaggttctggcaacagacatgaattgaggaaaaggtagcaagtggtaattcaacccagtataaggcactccttaaaaaaagtataagacactccttagaaaaagaaccagtaatccttttggttattaagatgacgctttataaattccaggagccccaaaagtatggtaaccattttctcccatgattcacttgctgattctgggggctacaagagaggctcaagaatcaattcacgatgcattaaagacttaaacgttagacctaaaaccataaaaaccctagaagaaaacctaggcatcaccattcaggacataggcatgggcaaggacttcatgtccaaaacaccaaaagcaatggcaacaaaagacaaaattgacaaatgggatctaattaaactcaagagcttctgcacagcaaaagaaactaccatcaaagtgaacaggcaacctacaaaatgggagaaaatttttgcaacctattgatctgacaaagggctaatatccagaatctacaatgaactcaaacaaatttacaaggaaaaaacaaacaaccccatcaaaaagtgggtgaaggacatcaacagacacttctcaaaagaagacatttatgcagccaaaaaacacatgaaaaaatgctcatcatcactggccatcagagaaatgcaaatcaaaaccacaatgagatgccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaatacaatttgacccaccatcccattactgggtatatacccaaaggactataaatcttgctgctataaagacacatgcacacgtatgtttattgcggcattattcacaatagcaaagacttggaaccaatccaaatgtccaacaatgatagactggattaagaaaatgtggcacatatacaccatggaatactctgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcactgggagatatacctaatgctagatgacgagttagtgggtgcagtgcaccagcatggcacatgtatacatatgtaactaacctgcacaatgtgcacatgtaccctaaaacttaaagtataataaaaaaaaaaaaagattttcaagagagagattcaaatctctcattgttttgtaatatttgtaagaaaagctcacttgaggaatgtagactcctcacactttagttggccttttcctgaagatataggccaaattttctttctgaatcatagaaaaaagaaaagactacacagagaataagtcatatgtgtgacatggtaaaatggcttaacagcggtgtaattggatagtaggagtggagagagaaatgcagcagaaggaatgtttaagaggaaatttttaaactgatgcaattctttattctacaggcttaaggagctctggaaaccctaagaaagtaatatacaaaggaaataacaccaaagttcattatggtcattaaaacttaatatacataatatataatatatatattataatatataatacatatattaaaatatataatatatattaaatatatatgtaatatttttatatgtgtaatatatgtttattacatatatacatacatgtgtatgtatatattatatatgttatatataatatctatacacatatacacatatatgtatatatagtatatatatcacacacatatgtattacatatatattatatattatatatatgtaatacatatatattatacattacatattacatatatatgtaatacatatattacatattacatatacataatatattaaatattacatatattatgtattatatattatatattgcatatattatgcattatatattatatatgacatttattatgtattatatattatatattacatatatactatatataatttatatattacatatatattatatatatgtaattttaaaattcttgaaattttatttgctaattttatttgctatattgacaccggggaaacacattaagaatgatggctaacttctcaatgaaatcacaaaatctggaagaaaatgaaatgacattttttaagaaaaaaataagaatgaagcaagcaaacaaaagaaaacctgccaatatcaaatgctatactcagtgaaaatatcttttaaaaataaaaggtgaaatgaaaatgttctaagaaaaatatacactaatacaacttcctggcagtatatctgcgtatacaagaaatactaaagaaatttcctcgggctgaaagaattatagatgggagcatggaagtacaagaaggaatgaagaacaatagcctcaataaatataaaactattgatcacctatgataatcataacacagtcctgtggtatacagagtacatataaaagtaaactatatggcaattgcaaaaaaaattctgaaggggtatatagatttaaatatttgcaagcttcttgaatgtgataagaaccaacttaaaatattctatattaaactaaggactcagttggtaatttctgttgaaaactccaaataaattatacaaagagatgaaacaaaaatgttaagagaaaaggaataataaaaattattgattaatacaaaacagcagaaaagacagaggaataaatagctaaataacaaattggacaaaaagaaaacaagtagtaaatgagagatacagtaaggtaataaaaaagccaaacttctgttttgtcaattttacaatttatatagctgacaaaggactcatgtccatactatatgaggaatttttccaatagatattaaaaagataataaactcaaagaaatgttcaaaagtcttgaacagacacaaaagaggataccagctttccaaaaacatgaaaaggagcttaactttgaaatacatcatgaaaaagccaattgaaatcaccgtatgatagaactacacactcacagattgtcaaatacagaagaaaaaaccaggtattaacaagggtgtggaaaaacttaaactctcatacatgatagggaagaaatgttcaattgatattggattacataagaaactagggtcaaaagtagtgggtagtgaatatttgagtaccttttattgcacttcatagtaagacataaatctaataattattttccttgtatctttgaactatatattgactattatataatgcagatttgatggtgatttttaatctgttatatttaatttatttagcatgttggctaaactctagacaaatctgagttcaattttaagttccaatgtttaatagttatatgactggaggaacttattttgtctctctaaatcatgcttttgttatatttaaaatgaggataatattatacatctctcattaagaagaataacagaggcagtacatataaagtgtccatgccaatgtaccaaatgacatctgttgtcagacgagattccaaggggggggatggactaagtggtgctttccatgactgcagtaaagaacagattctgagcagagatcacaccaaggtgctcacatgagagatagagagctacagcagcaaggtcaagggaggattttacagaacggtttccatagaaataatattttcatggaaatcaagtaaagttttcaaggctgtatttaagcaggacttccaggaaataaagagtcagagaaacaaataactattttcaagaggaggcatttcagaccaaaaaacagtgggaaaagaagaaattaataaagaaagagggtgcaggccaactggaaaaattcccttaaatataccggttagtgttgtcactaattcctcataaagaggaactaaagatgaaatcagagctactgcttacctttcagaactccttcaatgaagctacacatagtaataattatacaaacatagaatagaccacagaaggacatatgatccccaaatctcaagagagaaaagaaatctgttgtcttcagaaactagatagaactgttaaaatatgacattagctacaaatttgaaattgtgagccataagtgacagtgctattgtttctcacgtattttgccataaaaaatgaaagcaaaggaaatgcgtaagcatttgaggatttggtcagagttacaaggatctgaagtgggagagaagcaaacatactctcacactatgttgcaatgatttctggatttcattgatgggtgtattatcccacactccagcattcctcccttccccttctacccaaataggaactgatatgagattgctgggttcttgttttatgaagcaattacatttaaaaacaatcacaaaccaccattgactatctccatcatttcccaaaagaacaaactgataccagaaacacaggatgaacatgacctcagagggggaaatctttatgaatagctcactaaattgtttctgtttttatcattttattgctggtatgtgacaacctctttgtggactagaattgggtaatggaccaggatttcaagcccactgccccactgaattctggtgttccagcaccatgggtaaaggcatctataccaccaactaacaaaaacttatcagagcaagtatttactctagtaagattttagataatttattactatttatatcattcaaaaatttgaacaatgtttcatgttcaatttgcattttcctgcaatgcaaatgcatatgggtttcttataacacaatgtaggataagtcagttccaaaaaaaaatcctttgtcaatttttacaaactttaacctttgcaggcacagatatttgatagacagatgatatagatagataaagtatatgctggctctacctggttattagaatcaagattctttttggacatgttacaaataatattaacccaagctcttattttaaacacttagttatcatatcacttataattttcaattgcaatttttgttggcattactatctcccttccaagatagtaaacctttgagggcaggaactagctttctccatcttggtatccttacaactaaagcaaaatttggtacattcttagcatcttataagtatttgttgaatgcttgaatgaatggctctacataggttacgtttcctgaaacatcacaattttatatagcaaatccctggtactattttatggtttattgatggaagtagcaactcgatctgtccttcaacactcatgtattcattctttgtacatatatgaaaccgttactatgtgcttccactgtgctaactactctggataatagaaatgagcagaatgcagtcactgcattcaaggatgtcagaaatagttccattctggagctcatgtgatgtttttagcacaatgccttatggaaatacattcaattttttgaatgatacaaatagaaatgatctaatcacataaaatatcactaaatacttgctctgatatgtttttcctaatgagactaaaacctgtttatcaccataagtggcaatatccactctacttatgtaagagtcctcccttgtaacatattacagccactatccccatgacatggtttacttaaattggaaccttagccttatgcattttaaatgaaataataaatctgcttactattgcaagtcttgttgtatttgctgttctcctgtggaaacccttccagtcggcactgaaaacgatgctgccaaaattcttgaaaccaagggtttcggtggtttgtttctggccggagcttcagataataatcatcaaaccacttgacatcgggagattggagcttgattgtgatgccaccaacagcttctcgctgatatccatctgtcacatcatacctgtcagcccagccatcactgtggggaaataaaaaaaccctcagcttagaacagatatctcctaagcaaatgagtccatttgctttccttttgacaagattagtcattaaatggctacctcaggccccatgatggtcctatattacaccgacatgattattgatatagaagcttgttagaataaaaagtgcaataacaccatggaaattttgggcctaagagtgctaaaaggcactaacctcacttaccttaaactgcagaaaataacctggagattctggcacaattttactggctgcaaaatatagtatatacatggaagctgcataatatcatcattcacatttttaatggacatttaatagccaggtaaagttaactttaaatacattattttctttggctttataataataattataatgatcataaaataagaattaaaaatattctccaacatacctaatattaatttaatcatcctgtgacacaacatttttgatcaaattttacaaatgaataataggtttaaaaaaccgtttgccgattatggttactctattcaatgttgatttcccaagcctcgaactgaaatctttgtagtccatagtccatacactattttctatcccatggaatctctaaaatacattaaaaatgtacatctgaaatcacattttatattagagtgcccaaaagaacttctgaacaatgtgccatcaaaagtggtgaagggatcatactcctcaacataactatcattctatgcactgctcactcaaagttatttaggaattttaagataaaagtttttgaaatcagagggctcataatataatgctagaggagagtataacagaataagaaaaagtaaagtcttctacaatgatttggaaaatacatgaaacattgtattggaaataaaaataaaaggcatgaaaagatgtttgtatacaatttgggtacaccctagggcatctaaggaagaaggaaagtgacttgtccctcttcactgccattggtatatacacagtttgtgctgtatatctgctggaacccagtggtactgtctttccctggaagaagtgcaagtgcttgtaaaggaagtatggggaaagggaaaatttgactaaattacaagtaacctcaaagagagaagagaaggaatatagagagatttaaggggaagaacagactagagcctcctaaatgcaaagcaggaaaaagtgttaggaggtgagctgggagtaggggcagtgggtagtggggagaggacgtgggaagagatttacactaccaatcactgcttacctcggtgatattcaaatatttccatttaacagaatgttaatttatttttactttcctttcaatgcatttttgcccttaacatttttttttctatgcagaaagcatggtccaatattttgcataaaaaatcagtgccgagaaagtattatgtaagtaattaatttaaattatacagaaagcatgcacttttttcagtatgcagtgctgtgccaactttgatataaatattgataattgggagttattccaaatgtcatatattacttattaagatatcataagggcttgagatgacttgagatattagctagggcatcagtgggtggagagaagggaaaaaataaacagaaagaacactgtttttctctaagtcctccatgacaaaaagatattaaaaattacctatagtgaaatttcaaaaacttttgtggcagatcaagacaaaaatatagtaatgtagtatgttttgtcccaatgttgaatttggttacttcacacattatcttccctcaagtttcccattttcagctccagaagattttatttaaagctgacaagttgaaatgaagtgggcttgtttgcctcattttctcctctgttttggagggtttattatatcactgagatgagagtgtgggtctcattggcactcgaggagcagcatgggcgtgttgcaaatgggacaggaagctctgtttgttcaagcagagacccattctccaaggaagtgggaatttaaattgctccttttgttaacattagctcgctcttatgtaacactatgattatgaatattacataagaaatgtaagattataatggctccaatttacccttcacagttcattcattgaatttaacagggattgtaaaaagtttgtcttgataaacttttttgcaggtgatatttccataaaagaaaactgtcaggatgagagtgataatttactgatctctcatcatgtactttctctgttttttttttttttgaggtatatatcttttctgtaagtttaataacttagaaaactatgatgttttattattagccttataagttagagttgtgagtttaaaataatttttgtttcagatgtttccaattaacagcacaatataaatcataaaggagatagtgtgtaaacagaaaatcccaatatctatgtgacaaaacagggtcattctatttaaatttttggataatatctgctatgttaatcccaaaaaagacaacactggctaaattagagggtgctgtattgactttagcttattaaacattaacatttttatataaatatgcttttaagatttgcattaagatgatagggcatctttaagtatgatgcaataaattcagcagtaaaatgaaatgctaagaaaaaacctttctgccacctaatgctttctattactttgatagagtggaccttcaatttaattttttgggtgacacgtattttaccaaagcaagagaaaacaaacggataaagatggggaaggaaactaacatttgctaaaagtctaccacatttaaggcactttactagatttattatttatccatccatccaatttctccctcttctcactggtgggcattttgcccaactcctcataatccattttattcttttccgttgtttggatttacagttgatcatcattatttacagattctgcatttacaaatttagctacttgctgaagtttatttgcaataccagaatcaatattggtggcatttttgcagtcattcatgggcatgcagagagtggtacacatttgagactactgaagttcatgtccccatctgaggttgaaaaaggtgactctgctttcttgtttcagttttcatactacaaacttacagtatctatttagcgccatcttttgcatgttcgtgttttttattggtgatttcagtgtttaacttggcctccaagaataaagctgatgtgttatctagtgtttctaagcacaagatggctgtaatatacatagaaaatacagtcagcccttcataactgtgggttccatattcacagatttcatcaataattaattgaaaatatttggaaaaataataatacaaataaaaaacaagacagtataatgactatttatataacatgtatgttatattagggataataatctagagatggtttaaagtataatggaggatgtgtacaggttacatgtgaaaactaagctacctggtataagagacctgagcatctttagattttggtattggtgggatgagaggaggaagtgtcctggagccaatgctctgcaaatatcaagggactagggataactgtatatagacaatacatatgttaaataagttgcatgaataaagtgctgttgctgcaagttcaatgttagtgagtcaacaatttatattaactaagatgtctttaaacaagaacacacataaaacaaggttatgttttgactagttgatgaacacgttgtgactaaaggctcacagcaacctaagcttgtatttcctccaggagtaatggtcattattcactaatttactgtttgctgcatgtttatagaacattactgtgaatgataagaattggctgtaattacatatagtcttaatctggatgttgttttagtcaggtttgtagcctttctttggctgtggaatcagagtaacttggacatttaaaatagaaaaatcattcttaacttacttagcttggcttaactaaaggaggattctttatacatatgtactggattctcaaaacacctcactagcagatacttagatcctttaaatattccctgcagacatcttaaggacatgctaatctacagagaatttactttcactttcttcccaagattgcattaccaaaaatatactctctttctctacaatctactcttcccctttctcctttcaactctaattcctatgatttctcataaagagaaactcatgaaagcttaatttttctttcttttcaacagacagttcttgtttaaaacaaaattgactcttgaattaccctgctattttttttcctaggtctctataaccttccttcttttcttcaacatttattaaatatctacccatcttagactaaattattttgtcacaatcaatagtcccagtatctcactggtatagaacagaagtttatttcagcctttatattcactgcagatggcctataactctgttctatgtcatcttcattttgagtttgaagtctaaaagaatagtctgtttctgggacataccaatcttgtagagcaggagtccccaaaccccaggtttcagaccagtacctgtccgtgtcctgttcggaacctggctgcacagcaggaggtgagccctgggtgagtgagcattacctcctgagctctgtcacctgttagatctaatgcagaggcattagattctcataggatggtgaatcctatcgtgaactgtacacgtgagggagctaggtcgtgcgcttcttatgagatggaacagtttcatccatgaaaccagtccctggtgccaaaaacgttggggaccgctgttgtagaaggaaaaacagatgataggggaatcatacaatggttcttaagattctgcttaaaagtggcacatgttatttctgctcacgtttcactgactgaacaaatcacatggctaaacctgacctgaatgggacaggcatccatggtttttcccacggagaggagcagtgtatattttgaagaaaatgcaattgacagcatcactgtgtgttgaaattgtattgaaactgagaaaaaacatgagttaaatagggtttagagactctgctccagcagttcacaagtctagtggagggatgagaaaggaggacagatataaataagtaaccacatacaaatgattattatgggcatgtcctaaatgcagtgggagagcagatcaataaataattgaccaacacttcttagggagataagagttgaactaagtttgaaaagtatggataatagagtgataccagcattttgaaatattgttttctatatattgaaaaaaattgttaatcaaggaatagtgaatatggagcattgcagctatgtagggtgcacaggtcagagaagtaatgagagggtgagctgaagagaatcagttgtgagtgttcttttgtgccatcctaaagatttccaactttgtcatacaggtagtggggaaccagtgatggcttttaaagtgggaaatgatacaaagacatgatgagaagtagaggaactctgctaaaagcttacatgacagattagagctgtcggagatgaaggttagggaatcaagttagaaaatatgttgcaatggtcaaggaaaccaatggagaattgaattaagggagtggcagtaagaatgaagagccatatttataaggaatcttaatgtagaacctccaaacttgtggggcatagaaggtaaaggagcatttttaatgattcgtgggaggagaataacaacattgcatgtagctccatgtcctaggctggacagtattggaaaagaacaggttttttgtgaaaaaggaagaaaatgaatatgagttgggatctgtgatgttcagatttatctttatacgatctctcacatttctttttctcctggatttctacatattctctccatatgcaactggcttgaatgttaaaaatgcaagttaacaatgttcgtacctgtggttccagtatgatattaacctactctgttgtattattgtatgtatgtttttgtttgctgtgcaatagctgttggcattcaaaaatatgagagaaaaatggtaattatacatctgtaaagatttataccttacaccattgtatgcttatactaaaagtattttaactttataattatttctatcattcattatattaaatttatgaaatataaagcagaccaatagttatagttataaaataattatgataggacttaacaaccaataggcagaatatcacaatctatttttgctagaatgtgaaacctcctgagtgctatatgctaacaggaatatataaaaataaatcttagacaattacgaagataaaagtctaaggattatggaatgttagggcagcgatgccaaataatttaaaaatctatctcccttaatgaaatctaaatccataaaatgcagacaatataattttttctttcttcatttcctatccatatatgttataagttattgctatggaaaacagaaaaatacatgtagccctgaaaattgcattgagtgatcctttagtaacagtctcaatgttttattcatttcaatttattaattcactaaacatttgaatgcctcctctgtgccagacactggtaggttccaggccatgccctcaaggagtcaacagtccattaggcatgacctgcctgaatgggcattgccagcttccagtccattgggtttttctcacttatccttcaaattaaacattccctttcctttttactcaatctttccataaacagtagaaatcattagatttccagtcactgaattatcatttactgaaaatcacattcctttcttgcctccctaagattattctctgatcacctcaattagtattctggatatttccaagttcttaattcttacatttataatctcttgatttatttatatggaagactaattatatacaatgggcatggattttcactagttgaactctcaaatggcaacatggttatttattaatactacaactccatggagattttaggaaggcatcccatggtgctacctgccataggcaaacaacataagtacattctgtacccaaaggagcaataccaatctaaaaatgttggaatctgaatgaatattcctagaagttagtggtcattaaacttgtgtcaggaaatataactatgtgtggggcatgctagggccacacagttattcttgcccactgaaatcattagttatgcttatcatgatgaaactggtactgctgagacgaacctcacacatcctgttgatcggagacatagaacattgattcttattccttagatatgttaatagtttcacactcctaagcctttgggtgtgctattccctctgcacagagtgccattcttttaacttctcacatgttttctgatttgataaaatgtaattcatcaagcagacagatttagcttgaatgcaacttatcaaaaagctcctctgggcttaatggttccttctgctctgcttctaaaatacagtgacattcattgctttattcactgaacaagtattgtgtaactaatattctaaatatgtggatatagtggtgaacaaggaaggcaagatttctgctctcatagaggtaacatgatgcttttagttttgcaattgtcattgtattaaagatagctacatttatttttgcttccccaaagtagactacaaattttatactttgcacatctttgtatccttaatgcttgttataatgctcagtacataccaaatactcaagaaatgtttaatgtaacttgtttaaaaattaggttttaaaaggaaaacttcaaataacacagatttcttttcagataactacatctactcatttgttaattgagaaaataacactgtcaaatgtgccttataaatgactctgaaaggctgagttgattcccccgtgcagaatggtcctcttgttatctacctgatgttattaaggttaatgaatgtattcattaggctgcatctcagtattttttttttcaaaatctgtttgcaacccacataattattatggaaactgctgttctacccacatgtaatcatcatcctgccaaatctcttactaatagattttaacagatattttgggattttaaaaaattctaatagtgggagtctacggactacttggctgttttcacataatattgctccgtgcaccccaggaggagtaggaagtctcaaatctctacacactagtgaaaagcaaggaaaaatattgagactctattttattttattttatttattttttagatacagtctcagtatgttgcccaggatggattcaaactcctgggctcagcctctggagtagctaggactacaggcctttgcaactgtgcctggctttgaaattttaaattaaggttcttatgaatataccccagccaacactaatgaattaattccaaaaagaatcaaaatttagaattgttcagaaaaagataatgttatcaactgaaaatcaacttatttctgaggtgtataaatctcaatatttctcatttcaaaggattcataaaaagtaagtagaggtagattggaggagtgatatcagaacattcaaaagaagggaaaaagtcaggaacttgaaatttgccacctgtatatcataagataatttccactgtatgactttttctaaagttctgcaggccttagagataattattagccctagtttttacatctgaggaaactggaggattaactagccttataactgaggaaatctgagggattaaataacctactcaaaaccccatgacaaatgtagaggggatataaactcagatcttgctaattctaaaactccagcacatttcatacttcataaacctgctaagtaatgacatacagtaatgacagcagagaactgtgtcttgatgaattttatttaagagacatgtattggaaaacagggatcagattgtatattgaaaatgtgtaggtaagattctaaaatggcatccaagatctctgatctttggggtatacacacctctcttagttattcaatcaaacactcatctagataagtgcttctctggaaggattttaaagatgtattttaggttccaaacaagctgactttaaaatagggatactaccctctataaatctgatctaactaggtgagtcctaaaagggactggtgatttctgatttaaaaaaaagattcaaatgagggggacttgacatgagagagctagaggagaatctccgttgttggctttcctgatggagggagctacagggaaaggaatgcaggtggtctctcagaaatgagtatggcctccagcaaacaaccagcaccagaatggagactcaagcctacacccacagaccaccaaattcagccaaaaacttgaatatatttggaagcagattcttccagaaagcctccaaaaagaaatgcagttcgccaataccctgactacagcctgtctgaccctgagcagagaacccagttgccatacccagactcctgacatccagaaagtatgaaataatacacgcatttttctttaagcttctaattttgttataatttgttacacagcaatatgaagttaatactcacttcccaactctattctgcatttcttcacttggaaggccaatgcctgttaatatttgaagagataaaatcttaggcggtctgacctaattctgggtgtggtcagtatagactgacttacaaagacgtggggattacaggaaataacagatagtaagaaaaacctattagaatagttggaatatccatcctgtcttgattttggtcctaggatggcaggcattatctcctctggtttaatgtcttgtggctccagggatgcttccacgtcatatgcatgctttaaataggagaggctgataaatatctttataaatagattgattacattgtgtgttacccaatcttttgtttctctcatcatattatagccatttggagaaatgcaaaaattgaggctattgtataaaatgtgcaacaatttagtaagcaaaatgatccatttcaacagagaaaacactttgaatgagctattgtatccatagctttatataaccttgtctgttttttcatgaagtttcctttcttaggatgatcttccagttttcatgctataatcccttcttccactgaattggactaattccttctgttaagcttgtaaatttttatcagtgggactagtgcttagagtttcctgttacatgactgtgctgggataacaccttttcaaaaatatttctcctcttcttaattgcctcttttatgaaggccaaacagcctctgagagcacaatcaaggtgattgcacggtgctaagtgcaatattaaatcagtaatttttttattgaacacctaagcaataagacaggcttcaagaggatatcaatgaatataaacctcacctcccagtttgttttatttctttttatatcataacaggtcactagggacttcataatttcaaatctatattttcctcatactttcctcaaacttcctgcattatttaacattactgattcatttagtaaaatctaacaagtaacattgtacttgctaagttctctgcagagtgctgcatatgaggaataaagagaagaaaaattatcattcccttcaaccttagagtcaggtaaatgaaaaaaattacttgaatgataactatgataatgtatgtagtgtttttttcctaccaaacattgtcctaagcaatatatgcttatgcctatattctgctaaatattatatatacagttggccctccatatccctgggttctacatgtgtggaatcaatcaacccagatttaaaaaaaactggaaaaaaaatggatggttgtgtctgtactgaacatgtacagactttttttcccttgtcattattccctaaacaatagagtatggcaactattcacatagcattttcttttcttttttcttttttttaaagatagaatcttaaaaatcttgctgcccaggctggaatgcaatggcatgatcttggctcactgcaacttccgcctcctgggttcaagcaattctcctgcctcagcctcctcagtagcagggactacgggtgtgcaccaccatgcccggctaatttttgtatttttagttgtgacggggtttcaccatgttggccaggctggtctcgaactcctgacctcaggtgatccacctgcctcggcctcccaaagtgctgggattacaggtgtgagccacagtgcccagcctcacatagcattttcattgtattaggtattataagtaatttagggattatttaaagtatataagaatatgtatatactatatgataatgatttgagctattataaaagtgacttgagcaaccacgaattttagaatccactgagggtcttagaatcaatcccccacagatactaaggaaagactatatgtatgaaactgaagtacataattttacatgttcacattccacatgaggcaactgtagcttgcaaagcaagcaaattgcccagggttgcacaatatttaaacccactctatctaaatctagacattaaaactgaactagaacaatgtattaaatgtgatctttaatacaaatctgtgtccaaaggtatatacataaaaatgtagatagaagagataatttaatttatttacacacacacacacacacacacacacacatccctcttggaatttctttcttttttttccttctacctgaatcgtcaaatagagaactgccttaaaccattaaattaatattctgataaaatgtctatttctgtattgttcagtaccctgtcattgttagtaagagtctctctaataacatggaaaagaccaattagaagatgcttaagagaccttgatttctgtacataaacacagaatgggctcatttccattcacatttcactttgaggcaacatgtttttcctggacaaaatatccccacgacactcagaaacctattgtgaacttctcacatttatttaatatagtttccaaataaaacgtataggtatagaggaagagtaaataatcaaaaattacactgggattcagattaagttttagaaataatcattgtacaagaagtgacacaaaattcaaaacctaagttcctgaaaaatttaggtatcatatgctcaataactaatccaagtagacttaaattttaagtcacataatagaaactgaacagctacttccacattttcctgtgatagattaggcaagccctcctctgaagacaactagaaaggctgaatattttttttttaatttgtttaagttgtcagaaagctatctagtcagccagtactgagggggccatgatccaggagaaaaaaaaaaatggactgaagaaagactttccctttgaagtatgtgacaattcattgaagttgaactcattgataagaagctaagaagttgggacagaagcaccaggtgagctttgaacatttttgagttctgggctagtattacatttaaaatcttatcagtgaatatctgggagggaaaagaagcacagatatctgaagcagatattatttcctcccttgaattctttgctaatttgtaggcatttactgaaaatgtcagaagtggctaagagattggacagatgagaagagctttaggcagtcatactgaattgaagaaaaaaagaattgtaattgttcattagtctatttcctgttgtttataagagaatgcccacaactgggtaatttataaagaaaacaggtttattctattttttattcggcaggctaagaagttcaagggcatgcctctagcttctggtgagggcttttgtgctgtatcacaacaaggtggaaaaggaagtggacacatgcaaagaggggaaacttgagaggtgttctgactttataatcactcactcttccaggaactaatccattcccatgagaatcaatcgagtctctcaagagtgagaactcactcaggaggagagaggagcaacaagccattgatgagggatctgccctcataacccaaacatctcccactaggccccacctaacaacatcacaggggggatcaaattccagcctgagttttattgagaacaaacaaaccattgcagatagtaaccactttgagtttttatttgggatcattacaggctatattttagttgtaaagacaaactggaaagtgataggctccaacaaaaatggaaactgcttcagatcctctcactatcaagctagcttaaaatggtcttcctctcttttaactgctataaacaagcaacagcaaattctctctggatgaacatacaaccagatgtagccttagattacctctacaatttttatacatgttgtctatcatttcagtagtaaatggacagacatataaagcattaaagaaaaagaatgaaatgattgaaaaccaggaaaaacagtcaatgaaatcaaccccatcccaatcattagaatcaatagagtgaatttaaatacaaatatgaataatatattcaagagaatagatgaaaagtcagagaagtaagttgaaagcagtaatttttttaaaaaagagaaatttaagaaactaaacatttaaaaatttaagaactcaatggatgtgtcaccttcagcagaataaacacaaccaaaaatgaagtttagaaaacttagaggaatagaatatatccagactgaaacatggaaaaacacaatttttgaatatagaaaagtataaaatatgatgaaaacatctaagtcagataattagttttccagggggagaagaaaaaagagaatagagtagaaatcatatttgaagagataatgatggagtatttccaaaaccaaatgtgcaaccagcatgaaacctaccaaaacacagattaataagtatgatgaatccaagcaaaatgaatatgaagtaattcacactcaggtttatcatagtaaagctgctaaaaatgaaaggcaaagttattgaaagtaaaatgcaggaagtgagaaaaagaagcacattaaaccctccaaaactagaggtcatagaaaaataaaaatttatggagaattgcttaaaaaaagtatagtagaaagaaaaagttaggccaggcgcagtggctcacgcctgtaatcccagcactttgggaggccaatgcaggcagatcacaaggtcaggagttcaagaccaccctggccaatatggtgaaacaccgtctctacttaaaaaacacaaaattagctgtatgtggtggcaggcgcctgtagtcccagctacttgggaggctaagacaggaaaatcgcttgaacctggtaggcggatgctgcagtgagccgagattgagctactgcactccagcatgggcgacagagggagactctatcaaaaaagaaaaaaaaaagaaaaaaaatgttaaagtcaaaattgattctttgaaaagactaataaaactgatgaacatttatgaacacttggcaacaatgaaagaaatgagaaatgcacaagttatacactaaaaagtaattgtaaaagggcagccaaaaagaatattgtgaaatatgttatggaaataaatttgaaaatttagataaaatagaaaaatccctacataagtattaaattatgaaacagaaacaaacataaaacagaataattttatatctcttaaatcagtggaagtttatttaaaacatctgcagaaactcgcacacacacacacacacacaaagacagaataattttatatctcttaaatcagtggaagtttatttaaaacatccccagaaactcgcacacacacacacacacacacacacacacacacacacacacacagagtctggcccaccaacttcactaacaaattattctatacctttagacgagaaataacaccaatactcaacaattttttttcaaaaaaaagcaaagaggaaaacttcattttataagtccagaaaaacagtaatatctaaatattaaagtgatttcaaaataaagacaaaatgtaggccaaactcttataaatatcaatgaaaaatctcaaataacatattaggaaactgtccagcaatgtatagaaatgccaatactcattcaaatttggtataccccaggaatgaaaaattattattgttattattgtggtaaaaacaggtaacaagaggtctgtcttaacaaatttttcactgtacagtacaatattgttaactataagcacaatattgcacagcagatcattagaacttattcgtcttgcagaactgaaactttgtatttcttgaatagcagctccccatttccttcatccccccaacccctggcaaccacaattcagtttatgcttttatcaagttgactgttttagtcatctaagttgaatcatgaagtatttgttttcctgtgattggcagacattatgttatttcacttagcataatgttctcacagtttatccatagcaaagtggtgcaaccactatggaaaacagtatgtagcttcctcaaaatattaaaaattgaattgccatatgatccaataatcctatttctgggtatttattttgaagagatatatacaccctcatgttcattgcagcattgttcacaacaatcaagatgtagatacaccctaaatgttcactagtggatgaatggataaagaaaatgtggtatatacatatataattattttaattttcgaaagctggtcagcttaatttaccacattaacaacataatgccgtcaataaattaaagaaaacgtgacaaattcaacatcattctgataaaatgaccttggcaacctagctaaaaaagataacttccttaatctatgccagagtctttacagtgaagataacacaacagtaaaatgttgaaatatttcttcctgatatccagcataagtaaaagatgtcttcactcactactttttcccaatattttattgaaggttctagcaagtttaataaggaaagaaaagaaataaaaaggagtaaactgtcattagccaagaataatgcaattatttacctagaagatctgaaataatctatagatatactacagatacactattacaaataacaaaggaatttagaaaattggtgcatactagtttggcatacataaatacatttaatttctatatatccaaaacaaatacaaattaaaaatttaaatatattacttaaaaaccacttaatacaaagaaataagcctaaataatatgtgcaagatctattcatgcatgcaagataaattatgggagattttacttgataaagagttatactgtattcataaattggatgaatgaataatgtacagttaattctcttaaagtcgattacagatggattgtaatctcaatcaatattccagtgggttttccttggtggggtttaggtggagacgatatttacaagtaggttctaaaatttatagggaaatgtaaaagttcaaaaatagccatgataaccttaataaagaacaaagtttatttgaaaaatgtagtattagatattaaggttttagaaaattagacataatttgttgaaattatgggaccaatagaacagagtcccacatgcatacagagacttaatttctaacaaaggcaacactgcaaagaagtaggaaaaaatgttctaataaaaaagattctaggtgaatcatatgtctttatgaaaaaagagtcttgatacttaatccacactgtttacaaaaatcaaaattcaagatagattgtagacctaaataggaatgataaaataataaatcttcttgataataataaaaggagatattttcaccatagaataggaaagagttttcaaaaagggcatagacagaactattaaagtcaaaattgttaaaagtatctataatataactaatagcttattttcatcgaaagacaccactaattgaataaaaatgtaggccacaaattaggagaagatcttgtagtgtgtgtgtatgtgtgtgtgtgtgttgtgtatacagatgacagataccaaaatgatagctagataggcaaaaagtctgaaaacgactcatatttaaagtatatgaataatttctataatttaatataaaaatagaaaatcctatagaaaagtaagtggtcaggaagcttgaacacttcacacctcacaaaatatgatttgaaatgaccagtgaatgtttttaaagtggttaactttaatcattaggagaatacaagctaaaaccactacgaatagcactactcacagaccaaaatggcaaaaagttaaaaacgatcgacatagttcagtataaaatggaaagcaactgcaattctcaatcattgattttaagagcataggttggtacaactgcattggaaaactatttggcaatatctcctacaactgaatataagcatacaatataacccagcaattctggccctaagtatgtttctaacagaaatgctattaaatacacaccaaaatgcatacagaagaatgttcactgacagagcaggagcatcgccatcttggacaagcccctcattctaaagttcaccttaataaaaaaccatctaaatccaaagagcatcagcttagtgggtaaggtcagcacgaccataaaccaaaaataacatctccaacaacaagaaacattccaaaatcctccccaagcagagacatgctagaccctagataaccccagtccaggccagaaagatgtctgccccaagataacctccccttctcccagacagattccaactctgccataaacttctccacatacacaaatattccaagcttataataagtttgcttaccctaaaaccaatatatactcttagtctgtaagagaaagtgctcctgaccaggatcgtccaagagcacctctcaggttttgtctaaagtaaacctgtctttaactgccagctgcatttagtgtttgtttcctcttttttcaactcttacattcacagtagcactatttgaaatagtctcattttaataacaaccaaaatgttcatcaccagtagaaaggataatgaattgcagtttatttatataatacagtagtagacagcaatgaaaatgaacaaactaccgttacatgaaggaaaatgaataatataataaacataataccaagttaaagaaaatatacggaaaggagaagattatacatattccacttacataaaattttgaagaaggcaataacccagaatattggaagttaaaacattggttccttttgaagagtgtgttagacttggaatgagcaagctggaacgttgggaccttgctcactggagcactggtaaagttttatttctggatctgattggtgtttaaatgggcttgttaatttcatgcaaattcaatgtactacacatcatggtttctgtgctcttttggttgtacattataatgcgttaaaatatttttatttaaacagaaaacttaaaatttaatttctgattagtcaagaaatttataatgctgacttgtaaaatttcagcagcaaattctgcttaaaggagattcatcattaattcatttcattcttaggagtcttcaaatgctcaggcatctttaagactgtcttggagtccttggccatcactttttcaaaaatccagtgatataatgataaaaccgattatagctaacattaagttatattatccatatttaggcttaaaaattgaaatttgtaattcttagaaaatccttttggaatctgaaaatagtggaccaaattcagtacagtccaagtacatcaacatttattaagtatctactatgttccaagcctaagtcaaatttgatgacaaacatattatatctgtcctaaatcaagcttatactctggtggaagacttgaagaaagaaagacttgaagaaggaaagactacagaaaagtataatttaaatacaattgaataatatgtataacaaagacctatacaaaatgagacacgagaaattgggcccatgtcttgaagaaaagttattttattttttataagttgatatctggtctcaaatctaaagtgtcaaagagctgacaattggtgaaatgtacaaaagtaaggataattttgagaaaactctcttgctgaatacagcagaaatatttttactcaaatgtgataggagcaaacactatggtccaggaaacaaatgttcaaagtaaaatataaaattctaggccatatttatataatacataataattacagcaataatgttataaaaagacattgctaataactggaaaaactgaaaggtactaaaaagtaaaatggacatgattgagacagaataaatcaatcagcaaatacatattaagtgcctgttgtatgtgaagcagtttattatatgctgagggtacagtggtaatcaagacagagaagttactgtatcgagtcttgaagtttttgcaaaattgtcagatataaaaatggagatggcatttgcagcactgcaaatatcatgaacaaaggcaaagaggcatgaatccacatttttttatgtaaggaaaattccagccacttaattttcacagaaatttaaaatgtgaacatgacacagtctaatttatactattttatagatgactcttatttgcgaatggatttaaacgttttccattttcaagtacttattaggaggccatttccataagtcaggtgagaagtgatgatttgaaacaaggaagtgattataggatggaaaataaggaactgaagtaagaaatactgtgtttatgaggacaaagaggcagggttttgtgactaatattctatggagtatgaggaaggaaaacaaatctagaatgacaccgaattttctgatttgagtgattagtaacatttactaaagagaaatacgtttcttggggaagtttagttttaaacatgttaactttgaaacgcttgtgaaacaatcaagtgaatgtcacaaatgcagttacacatataatctgaaatgtagagaagtctggcctgagatatttaattcagatattatcaataaatctatatttggtagaactggtaaagggaatgtgatcacccaatgaggatgctgcatgttatgagcaattgagaaattcatttattataattttttagtctgacaaaatttcttttctagtttgtattgcccccaaatggtttaactgtactggctgttcatacttgaatgtccagttagagcataagtcatatctcagacagaaagagataaaaatctgtttagggagatgtattgagtagaaaacatgaacccaggctacaagagaagcgtagagaaacaggcagtgccaaatggttcatagttcagtatctgtaatttcagatcaggggatgtgacactattttgaaaaaaaaaaaacaaacatactctagagtataattaccaagcatttctgttgtaggttgtgtttggaacaagcagatgtgagggtgaagcttagacctatatagagagaagcactgagaggattcaaacaagtacgagggaagaatcaacacatctcatttgtatgctggatctaagaaatgtcagtgtcagagtaaagtgaagaatcattcagggttgtatttaggtgtgagagggagtgttgggagtcactgacctttgctgcatttgagatggttgactactttctcctggaaaatctcatcccatggcttctatagtaacaaattctcctaacactcctcttgccaccctgttttcttcctctctatcctctaggtgagtctctcatcctacaggccgagtttagatatttcctagagatttgtctttgaaatttttctattgcacttttgtatagtttcccttttggattttatcctatgactccaattaccatttatatctaattacttctacatatctatctttagccttgttattcttcctgtgctctagattaaaatattcaacacctactagacagcttgctccagaggaacctccaataaaactggcctaaaatatcagtactgttcatttcaccagtagaaattattgccctttctgccatatatctctaaaggaatgctaccattgttcctctaattgttcaaacaaggattataggtttggggcagtgtcactctttctcaccaggaatctgctccttccagagacaaagtcatgatgattccattgactcagtgtcttgggaagctatttttttcccttgactgtctcagtgatggctttattttgaaccttattatctctcacttgaattaggtgctactgttctccctttgctgttatgagtgagatttctaaaacacaaatgtaataatattacatctctgcttaaacatttaaatttggctctctttgtctttaaataaagtccaaactccttgaggaggcacgtaagatcctttatcctgtaatttctcagtagtctttcttttcattccccttttctttctgtatgccacattactgtaggtgcctgcaagatatcacattttttattaatcatccctactatggtaccaatgttcacttcatgttcacttagtccagtgctttttgttttcattttcctatattctggctgtttttctaaccccatttcagatgccttttattctaagtcttctgtgatcctacatgtgggaaagagcagttttgtactttaaacactgtgtgcttaattctgccttagcgtgaatgacattgtaattttaattgttatgtgcttctctttttcaagacactatttcattccattgtcctagcacttcactggattcattgcttgtcaataaagaaggtgtctttaatattgagtaaatggacggagtgaggcaattgttagagaagaaagactattataagaagaaagagaaagatatgtcggcaatttaaatgagtaaggatctttggaggttatgctgaggtttaggctcaaggaagatatgagcctgtctgcaagaaaattagagtatttatgtcttcaagaaaattagagtattttggttaacaaaattttgatatagaaaacaacttagaacaacccgaagctatatataagcaaatggcagttattataatgtacgcattcagaggagttgaactgtaaggttatttacaggaataaaagtagtgagagtaagctttaaagaaaagacaagacttaaactgagttttctccccagttagttactctgtttggacttccgtcacgtcatcctaacccaaaaccttggactcgttgtcccatgtttctcacagagtcaaagacgtgtaataggcattctgtaaatgtttgtataatcagcaacaagcaagaattgggagtccaatgtggccatgtagaaagttaaacacaggattgaatatggaagtacagaaataacagatggccatattgagagtctaagcattctcacacgtaagagaatcatagtatttgtagagtgataaacatccaatgctgggaactgcagctctggttccatgaactcttggataaaaaccctaaggctagttataataaagaactcagcaagggggatcattaggaaagtcaaagtattttatcctttagggaagttaccatcattctataaagataatttaatgtcttgcattttattataacactctcaaacaattcagtttataattcagtgttttattcccctgcttgattgattttttaaccatgattgattggagccccactctcagcacttccagagaaactgagtgagttgtaaagttcttcaaaggacattatttattcagtttcacatgcattatttgtaaaggtaacaaatatttattaggcacctattatatgcctatgctatcatttgagatacaatgacaagctgttctttattcacctctacctccaccaccaccccatacacacttgaagttccttgggggcaggaattgtatattgaatatatttatattccagtgcttggcaaatagtaaacattgaataattatttattaaattaatgaatgacaatttaaacattataaatacaatgatttaaatatgcacaagatgctatagaaactataaaatgaagaataattacttactgcctagcacaatatatttcagagagattttcaattgtgttgataaattttggaatgaataagtgtatgagacaccatgaatccctcaattcaaatactccattgttttctagatgctatataatgaaaatacttttaaagtgaaaattatagtcttgataagttaatgcatcttcaaaacttgaagttaattcatttaagtaacacatttttatgtagcacttactgcgtgcaaggcattgcatttaatgcttgtgctcaaatggggacaagaaaaagtcattttgttgaaataactcggtaattcatctgaatttgtagaacagctaattatatgagaaataaaaatataatctcttctgattacctaagtgcttgaaaaagtacttgaaaactgtggaagtatggttagagtaataggatgaaaggttgtatggtaaattaattaagaactctacacttctttgatgggccacctataatttcatatttgtatttatgttaatgtccagtaaagttaattttactatattcatttatgtgactagaagatatatatacaacatgtaataacttttattcagttgtacatttacagcattatctagaagccctgacttttaatataatgggtaatgtttttcttccaatattcactcctgtcctctcctgtagtaaattcatattttaactctagagggtccagacttgtctctgtcaaccagagtaattcttctctttgctttagttattagtttaggtaaccttagtcaagctgtttagcacttagatttctcttagcctactcagaacatttcctgggaattgtgggacacagatattctctttctctcactggacaatagcatatgaggttgtaaggctggtgattgctacagtgattcttctacaagagaaattagcccaagaatgaagttgaaacatggagaattacaaagaaatggagccagaatcctgatcaccctataccttaagcctgaccactttgaactttttaattacataagctaataaatcctctttaatgctgaaaccaatctacaatgaattttccattatttacatcaatgacaaaaatattaaatgttataaggaggtgttaaattgagatgtgattatcaatttctcattaatcattaggctgcatctttccatttgatttgctacattaaacatttaattataagaaagagacatcttattgaatattagaaattggcaagattttagcttgataatgcatattaccacaatacatggaatgctgttactatattcagataattagttaccaacagttgggctccacacatttaaaaatgttgaaattaatagatagtattgaaaattgacttaaattaaaatcacaatatataaagtggaattaagattacaaacgtgatgcatttttattcatttttaatttctgaatttttttttttttagagacagtgtcttactctgtctccccggctggagtacagtagcataatcatagctctctgcagcctcaaactgctggccttaagtgattctcccattgcagtccccagagtagctagaccttcagaggtgtgccaccatgttcagctaattgttaatttttttgtaatgatggggtctttctatgttagccaggctcgtcttgaactcctgggctcaagtaatcctcttgccttggcctcccgaagcactggtattatggatgtgagccatggtccccagccatgttgcattttcaactgctctagtccatcttgaacttcaccttatttgtccattatctggaccacaccatctacataattacttctttcatctgctcaccatcagtactcattttcaacctttcaacataggttagcaattagctcatactttctcctccataattttctcatttattctttcatctcttcaactgcatttatttagcatatcctgtatgccagtcattgaactcaggtacaaaatacccactgaatatagctttgatgccataagagttgagaaaaatgctaataccaaatttaaatgatattttttcattacaaattgatgaccacaatggaaagaaatataatgaagaaactgattttatctactctgaggctacaaagaattccatgaatagtgaacatttaatctcagatccaaagatgagtggtaattaactaggtgaagaaatatgccagtatttattagccaggtaaatcaatatcccaggaagaaaaagtatcccatttgaagctctgtggtaaaaagaagcttgactcatttaaaaaaaaaaagtgaaagaaggccagtacagtgaatgaggaggatagtggcaaaagacaaactccacatcatatggaaatcacaggccattttaaagagtttagttttcatccgaagttcaatgaaaatacatgaaatgtaaataggcaatgagaggatcagatttatattttagaaacaactttctatatatgttacaatatgaaaaattacagaacagaggcaaaagtggaagatgcaattgcaaattaagtttcagttgcactgattcaggagagaggacactgcagtttggatcatggcaatggagatgggaaagagtgaggacatttaagaaatactgaggaatggagctatggaattttcagaagattatatgacttctaaatttcttgcttaaacaaccattaagaaaaagaacacagagaataactagctttgggaacaagattatgagatttattttaagtatagtgacttgatattcaagtagaaacattacatatactactttagaatttcaaatattttacattgaaaatatgaatctgagaatgatgagtcaagcctcttttggttgcagtatatatatagtatgtatattcaatctatctatccctctatcatctattatctatctatcagtctatttggattttattgccttgtattactagaaagttgactcaaagttagcttcacatatgataatatcctggggctcaaatacttttatacttttatgagtccctttaatttagaagctgagaggaagctagattgaatttggcaattctggaaggtgaatagttgaacagcatgtgtcattattctcagcaatatctctgttgctgtcacttagcttcaccatacttgatttatattaattcagtaagacaaaagctttaccacatgctcaacaaatcgattttaaataaggcaccattctatttatgaatacactttctcttaaaccttagtttcaccttcctcattcttcatcttcttaatctgtttaataaaaacaaatagacaaaaacgcctgagagttgaaacaacttcaattattaaaccactaattctcttacaccaaatgtagtctattctctgctgttgtgctggtaatctatgggggttaattctgtgacattctcaacatcaaactaatttttttaatttttgtttatactttaagttctagggtacatgtgcacaacatgcaggtttgttacacatgaatacatgtgccatgtaggtgtgctgcacccaataacttactcgacatttacattaggtatatctcctaatgctatccctccccactccccccaccccacaacaggccctggtgtgtgatgttccccttcctgtgtccaagtgttatcattgttcaattcccacctatgagtgagaacacgtggtgtttggttttttgtccttgcaatagtttgctgagaatgatggtttccagcttcatccatgtccctacaaaggacatgaactcatcattttttatggctgcatagtattccatggtgtatatgcgccacattttcttaatccagtctatcattgttggacattttgtggagaaataggaacacttttacactgttgttgggactgtaaactagttcaaccattgtggaagacagtgtggcgatccctcagggatctagaactagaaataccatttgacccagccatcccattactgggtatatacccaaaggattataaatcatgctgctataaagacacaggcacacgtatgttattgtggcactattcacaatagcaaagacttggaaccaacatcaaactaatatttcacaccttgatttttcatcatgtctacatcccaccttctattacatcacccttattgttttccttctagggctttcctgatggtctaaaaagccctctgaaagaattacataaggaatatggagaaggaggagtaacaatatgagatccaccctgtaattcatcacagcgtcaaatactatgtgagaaagatagctgagaagtacagatgagagacaattacagtaggaagtatgcaatattctgtggtttttgtaagatatcctcatgactcattctatgtctcagagtcaatgtcttcattgtctctacacctcagatttttcccttcaagacacatgtatggacttggtctcagaactcttgtcagtatttcaatttttctcattgaatttcaccatttcaccctttccaggacattcaaatttacacaattctcaaaatctttttttaaaaagaagtcttaatttgctctcatcccctcctgagttatatttctctctttctgtttactttcaaacttgtattaatggagcacattttatacttccattcctttattaattccttgccttctgaaagtcatcttctcttcaaaacttcctacaaaattgctttgttaaatgctaacattcttttttgcaatttactttttgctctttgatttctcttgaaccctttctttttgaaattccttcttctcttagcttttgtatcccagtgctatttgttttggaactactcttctgaattcttatttttccttttcatttctggatcatatttcccctactgtttataaactcaagaggttgagttcttccttttttttttttttttttttttttgagatggagtctcgctctgtcacccagtctggagtgcagtggtgtgatcttggctcactgcaacctcccctcctgggttcaaacgattctcctacctcagcctcccaagtagctgggattacaggtgcccatcaccacatctggttaatttttgtatttttagtagagacgtggtttcaccatgttggccatgctggtcttgatctcctgaccttatgatccacccacctcagcctcccaaagtgctgacattacaggcgtgagtcactgtgcccagccctctttttgttattcatgttgtatactcttttctttttgtgaaagtggaaaaccattttcatggttattccttgtcctactcattaaatgatccaaactgtagccaccgactatactaccacacatttagctatgaaaaatatactgttcacctaggatagcaagattaccaatacttgtagtacaatttaaaaattatggttactgtttgatttaaatccaataaactgattttaagtaactgagagtcagggcctccaatagataacttatttccctatggatttgacaatcatctctattgatattgattctgaaatttattgtatccaggccagacctctctgcttgagctccagactcatctactctctatgtatcagtatatgcctatttaggacaccaggaaggtggctgaactaaggaggcagggcctgtgagatgtaaagcagcatcatgcaactttcttgtgaatagaatataaacatttagcaattacctagccttggggaataatgattttaagtgctgagcttacaattcaaaccagaaaaaagcaaacaatggctataatcaggttatgttgttgaatataaccatgtgtatcagtaatacacaggacagtgagatacctatctacttagctatatgacaactatcaccagaatatcagttactcagcaactgaaacatttttttttttctgtttaaatcttgctttccttcaaggatatattctggcattaattactttttgacagttacccaatcctcccttctctcaataatgaatttatttttcatatatctgcctatgatgctttgtttatatttctgttaatgcagttctctctaatcatagtaagacaggatatattaggtgtttacctgtgcatgctacagctaatttctgatctctatgaattaaagaaatatggactttttccctcctttctcacttcttccctttctcttcaccttcattctttctttttttctttgtatttcccacaatgtctggctcattataggtgctcaatagcttactggtgtttaaacggaatagtttttttttttttaagtaatcagctgacatgttaggcaaccatttcatattaaacattttacatcaatttcattacaactttaagtagttaatttcttaactcataacagaaaacaagatacttccctcccagcttatatcagtattatgttattaataaaatttctatcctatttttccaggcacttttccttctaatagttgctgacaatgagtcatagctacaatgccaccacaggcaggtctcaggggatcattgtccccacaaggcagtgcattaatttcacactgtggttcattaatggtattgtcaatgcccccatggggtatgggtgtttgtgaatccctgatgtttcctgattacttggtttgcactctattccttctccaaaaagtcattcccactatgctgtcaccagcgaaaacactgcctagtggtacatcatgtaaactatgcacatagtcacattctattactttagcattttatattgcacctgttgattttatttataaattgattttccttctgctaggctaaagcatgttaatgattttctgggtataatgtgataagctatgcatggaactttcagatgaatctgtcagttctcattgtcttcaaaactcactaatattccctcagaatattttgaaaagccttatttggaaattagtttaccatataaattaatttatagttggtagtttaaaagtaactctttctgctcttgtgtgaaattcaacatctactttaggtaaatgtaaatttattatataggaaaaaataatttaacagctaaaaatatttgataagtgctaatatgtgtcaagcacatgtccaggtactggcaatatatgataagagataagaagggtgtttacttttatggggcttttgttagagaatttagcagaaaaaacaaatacacacatactcatagatagataatatatttagatagcaatacatgctgaaataaaacagtaaaatgcgatggagtagataataatgctggaggggattgtggcactgcagctagactggtaaggaaattgcattctgagatggcggcatttgaactaagaccaaaaaaattagaagagtcacatggaggtctatgaaaacaatgtcctgggaagaagacacaatgaatgaagaggctttggtgcagaaataagcagtggtatgttctaagaatagaaggaagaacattgcggctggagcataatgtgccaaagggagactagtaagagattactttgaataggtagagaggaacacgatcacatttgatttgtaaatcattttattctaaatatgatatgaaaccattggaatgttttaagcaggggaattatatgattaatctacgcttaaagattattccaggtactctgtggaaaatgtactagagaggatctaaaatgaaattagaggatcaattaggaatctaatatgctaatccaggtaagggatgaagatagcttggaattgagaagtgcaaatgttagcgatatattttgaaggtaaacacaatgtaatttgctgttggattggatgtgcggagttataaatagagaggagcaaagggtgagcttaaggtttttggcttgaagaaggcatggtagaaacataactgaggtggaagtgtctggtgctgaagcaaggtttagaggcatagactccaatatagtttggctctgtgtccccacccaaattgtactcccataattcccacatgttgtgggagagacctggtgggagataatttgaatcatggggcagttcccccgatactgttctagtggtagtgaataagtctcacaagatctgatggttttatcaagggtttctgcttttgtatctgcctcatttttttcttgtggctgccatgtaagaagtgccttttgcctcctgtcatgattctgaggccttgccagccacatggaactgtaagtccaattaaaactctttttcttcccagtttcgggtatgtctttattagcagcatgaaaacagactaattataataaattggtaccaagagtgggatgttactgaaaagatacctgaacatgtggaagcagctttggaactgggtaacaggcaaaagttcgaacagtttggagggctcagaagaagacaagaatatgtaggaaagtttggaacttcctagagacttgctgaatggctttgaccaaaagcctgatagcgatatagacaaataaggtccaggctgaggggttctcagatggagatgaggaacttgttgggaactgaagcaaaggtgactcttgttatgttttagcaaagagactggcagcattttgctcctgccctagagatttgtggaactttgaaattgagagagatgatttagggtatctggcagaagaaatttctaagcagcaaagcattcaaaaggtgacttgggtgctgttaaaagcattcagttttataagggaagcagagtgtaaaggttcaggaaatttgcagcctgacaatgtgatagaaaagaaaaacccattttctaaagagaaattcaagccagctgcagaaatttgcataagtaacaaggagccaaatgttaatccccaagacaatggggaaaatgtctccaaggcatgtcagagatcttcatggcaggccctcccatcacaggcccaggaggcctaggaaaaagtagtttcctgggcctggcccagggtcccagtgctgtgtgcaggctaacgacttggtgtcctgcatcccagccactacagccatgactaaaagtggccaaggtatagcttgggctgtggcttcagagggtgcgacccccaagtcttggcagcttccatgtggtgttgagactgcaggtggacagaagtcaagaattggggtttggaaacctctgtttagatttcagaagatgtatagaaatgcctggatgcccaggcagaagtttgctgcaggattggggtgctcatggagaacctctgctaggacagtgcagaagagaaatttggggttggagcccccacacagaatcctgactggggcaccacctagtggagatgtgagaagaggtcgactgtcctccagaccccagaatggtagatccaccgacagcttgcatcgtctccctgaaaaagcttcagacactcaacactacccgctgaaagcagccaggagggaggctgtaccctgcaaagcaacaggggtggagctgcctaagaccatgggagtccacttcttgcatcagtgtgacctggatgtgagacctggagtcaaaggagatcattttgaacctttaaaatttgactgccctgctggattttggagttgcatcggccctgtaaccactttgttttggacaatttctcccatttggaatggctgtatttacccaatacatgtacccaaattggaaccaggaaataattagcttgattttgattttacaggctcataggtggaagggacttgccttatctcagatgaggctttgaactgtggactttcgggttaatgcttaaatgaattaagactttaggggactgagggaagacacgcttggttttgaaatgtgaaggcataagatttggaggggccaggggcagaatgatatggtttggctctgtgtctccacccaaatctcatcttgaattgtactcccataattcccatgtgttgtgggagggaactagtgggagataatttgaatcaagggggacctttcccccatactgtccttacggtagtgaataagtctcacaaaatctgatggttttatgaggggtttccgcttttgcatcttcctcattttctcttgtggctgccatgtaagaagtgcctttcacctcctgccgtgattctgaggcctccccagtcatgtggaacctccttttcttcccagtctcaggtttgtctttatcagcagcatgaaaacggactaatacagactctcatggcactgaccagattttgcctcctattacagttttaagatttatctatctcctctactaaacccacagagaacagtcacatctgagagttccattcaggctgactagaaatgttatttcctttcccaagccctgactactcccagcatttcatctggcctatatttattcatttggctatttcctccccaaagccttccttcatcctaccccaccatctaaattaggctctggtacaactctagattcacattctctgacagtaggaaaatcattcagaagttcatcataaaaaatatattctggccaggagcagcggctcgcgcctgtaatcccagcactttgagaggctgaggcaggaggatcatgaagtcaggagacagagaccatcctggttaacatggtgaaaccctgtctctactaaaaaaaatacaaaaaattagccgggcatggtggctggtgcctgtagtcccagctactcaggaggctgaggcaggagaatggcatgaacccgggaggcggagcttgcagtgagccgagatcgcttcactgcactccagcctgggcaacagagcgagacttggtctcaaaaacaaacaaacaaacaaaaaatacacacacacacacacacacacacatacatatatatacacacacacacacacatatatattatatatatatatatataatatatatatatatatattctccacatgtgcctacctgatggaggaaaatgaattatacgtgctctgcatctaaacctatttctatatagtttcactaggaaaaatggtaattttcaatactatatatacccccgtatggtgctttatatttacaaaacctctgtcagcaacattatttaattaactcatctgagttctcctgctagttaactatttattagtgttactaaactctatatgagaaaagtaagggtcaagactcttcagacattttaattaagattatgagatagtgatagtactgagaatcaaatttagaactctgttacaattgcaatcttccttccgccctaacacagctttttctgaagtcccaaatatttaattttaaccttgatttaatttttaatcttttgctttccttcactacatgtattcacatacacacattcacaggttttgcatataaatatccatttacattaagaggtcaagaagcttgggcactttggaaaggtcttggacaaagtgaggagagcagtgacaagtgtgattatagtcctgtaaaagtgaagctctataaagatcttccctcagtactggatgtaaatactaaatatttaaactcagaatcagtttaaatagatgtcctgcaggcactaaatagtggataaaatatagtttacattttaacaactagttattatataatctctttcaattttccttaattgtacttaatattaaatcattttattcccactattggggtatcagaggatatttacaactataataagtgcaaatggacaataagaaaactaattttctgatgctttggccctatgaagcccagataagaactgagaaaaatatactgtggatttcagtacaaagctcaatagcatccataaaatattgactaaaagttggaactcttaaattttaataaggcctatttgctttcttaattaaatatagcctaatgaaaagtaattaaggtacatagagagatctggctagaaatttttttactagtcctgagaattttgtttagttatatagacaagttccaaaggaaacaaaatcatccaattatttattcactattgtcaaagacatcaaagatgaacagaatctctcttttatttgctcacaaaattagaaaattatattaattatatatattcatagttgcatagtagggaaataattgtctttggatcagagagacctgggtttgattctagcacctcatcttgttaggcgattagacctggaacagttagttaacctccatgagacatgctttcattagctgcaacatgtgagacaaaagaaccaaatctacatatttattgttatcattaatgttaaaatactaaaagcacccatataaaacggacacgaaatgaaaggggtcattgtaagattaaaaaattaataacgtaatgctcacagaatctagtacagtacctgggaacttgataaatatttgttgaataaataaatactagatactgctaactgtgatactaaataggctactcaatgtttcagtagtttccttcccatttgtaaaaacaaaacatgcctccttatttcattcaacaaatatttaccaaatgcctgctctgtattaggcactgtgttaagctctagctactgggaataagttcaactttcagaaaaattagtaaaacacatccctgaatgaactatttccagacactatgatgggtttggcagcacaaagaacaatatgaccttatagaaagtgttcccagtgtagttttgaggtgtgaagacttcttagagaataactgagatgtataagccatacaaaaatggcagaagaactgaagtgatgaaagtaagttataggtgaaaggaacagtataaatactaagaaagcatggcttattctgggctcgtgtggttttggtgtgaagaacttgtatactgcagataaactggctaattttcttaatttgtcactcatcaacttctttagatgctgatcttagacagtccctaagacactgttgttttccctttcatccggattcagctttagcagatcactttctgatccccagctctgtttttcttctacctgctcagctttaaggtcacgcctatgccttctggtgtctgacgtcagttcatgaccttcactgacttcctacctgtgcactgttcttgccaagaagtcagaggcttggctgtggagcatagcgatacgaataaccagcagacactatctaagactaagccaggggggtataaacaggcctgatctctttattccaaaattaaaagaacattttttttttgttttgtcctttattgaagagatatatttaaagttccttccttatgccagacattgtcataggtactggggaatcaaaataaactgtcctttaggagcttgttctccaactgggtaaataacataaaaccaaatacataacacagcaagggaggcgctgataaaaatctatgaaaatgtctataacacagagatgattcttatctggtagtaaatttttttaaactcagatacataagaatacaactgagcatatataacagaggcatcacagttttattattttctgctttatgattaaatcaactttttttattacagtaatggttttacaatatgagaaacttgctttaccctgaatttcagatatttgattctaacttaattgtccacattttgtttttgaacagaaatccatttgctttttgggagaaaagaaactccatcattatgggaaggcatattataaaccttgaacaaaaaggtaatatcatgaaatagattcattcattaaaataggatattatgcacaactccccagtgatatttttattcatgctgctttattttttaaaaaaaaatgagttctgaaatgaattaattacaatttatttttaaaaatttcctaattcctaaggatcatcataatttggcattgataggtaaataactaaattctgaaaactgctgagagtgcctattttggatttgatgtcacactaggtgtggagatgcctcaaatgaatgacaaggtccctcccctcgaggatttgtcacttcagtcacagacagataaaagctgttctgatgtggtgtgaaaagtgctcttttattataaatcaggttgggttggcagtaagagggggccatacaaggtttcttggccagaggtacaacctgcactgagaattaaaaggaaattctataattgtggaatccacattcaatttcgacttcacctctttattcatctttctgctcagtggttttgtttagctctttagatggaacctaaataggtagagtttggacaagaagcaatttaaaaccagcctatggatcaattttttagtctgatatgtgaagtttgtaaagcacaaagaggctccctgcctttaaggtcttctgtaaataagtttccactgacacttgaagagagggtggaaactaacgttaagcccttcaaattgcagagaatgatgggctgggaagagggctggatgaggagagcagcacaaaaggtggtgtaggaaaggatagtatatttctaataaagttaaatagaggcttaaatcaaacactttttctaccataaccatagttttatttttttcttgatcactggagaaagggtcacatttttacataatttaattattgtatttatccatgtagtcattttcccatatttgtgagaataatgtataaatgtgtcaaaattttggtgtgtggtgtttcaaaaaataatagttactttagccatgtagaataaacttaaagtgaccttcttattaaaagtacaaatcactatgcagccaaagcaattagaaatacggttggatatagcaaagatttcacctacatccatagttttaaccaatatctctttatcattgactgttttatacctcctgatcatacttctcaccttctctttgctatgtctgctctctgccatctgggtattttacagacttcaatctcaacatctactttcattttgtattttctaacactgtgatagatgtgcatccactcatgtatttaagctggaattttagggtttatcctgagttcccacttgtctcttttctatgacttacacgccccaaaaccaggcatttaatcaggattctgttctgttattctatcataaaaatctcttaaacaggagtcttttcctattagacaaggaatacgacaacaatcgacaatctggttctacaataaactttttataatgtaaattttataacatgatcctcccctttgaagcagctccctgtgagcaacaggaaagtccgaaatacttgcttagcatggcctatgggcttcaaaatctggccttagctggtgctcagttctcctaatctgctatacctctctccagagaaatattctgccccagaaacactggaagctgcacaccattttcttttgtttcttgttaatgcctgctaaagtctcaatgttcagctcaaacctcatatcctttatgagattgttctagacccaggatagttagaacctctcttttatcctttcttagctcccttaccttattatagactttatcactaggtactatactaattcattttctgatctgtcattcattgtgggctccttaaaggcagaaacaatgatttgcctatatctgtctttagcaattcctattggattttatacagagtaagtgcccaataaaagcttattgaatgttttaaggcatagatgcattaatggatgaatgagtgagtaaatgaatgaactaggttattattagctacagaatagcttcaaataaagacgaatgctgaatgaacaattccaacccccccacaggcccttatgacatccgaaagtcccatcactgatgttctctgtcacctctagtgagtcacttagtctctcatctgtaaagcttaattagtgcttcagcaataagctcaagctcttaaaatgctaggtgttaaattcattgcttcagaaaaactgtcatgttcatagtcatttggaataaaactgtaagatatgcaacaagactccattttctgttaaaaatgctaggtttcctcatgcctaaaatagacttaatggcagctggctcccagctactcctgaagatgtcacagcttcaaacatgggggtattgccacttctgagactcgaagttccttctcttaatttcagggccaccctccatgcctccatcctggaggcctgcacagggtgggtaatcatagtcaacgtgaggagaaacaaacaggcaattctcctaatgggaacagttaactggctcactgtcagtcagaaggctggcaattttatagcttctccactgtgcctgaatcactgcactgagtggtctactgcagagaggagaaaatggagtttgtatctcctatggttcttaacagactgcagaattaaggaaaatataaatggaaaaaaaaagtttaaagctatacacgaagattacatagcacagaaacaattcaattcaattcaattcaattcaattcaattaaacacatgtgtttttgaggtcctactacctacaaaacactatgttaggtactatgggagaagcacttataaatgggtgagagaaatagttctgagcttctacagtttcatacagagttgtacaattttccactaatataaatgaacatgtataaaggctagtatggaaatacaaagtagtgaggagataggaaagggaaaggtgatttctgactgggggcctgggaaaagcctttcgaggaagcagaacctgggattttgggcagcctctcaaacagtctccctcattcctgtctgattctgaaaatgttgagaaacaaaagatggaggaaaaaaagtattcaccataaataccgatgacactaggctgggagcttagtctaatgtcaaatgggtttgctgaaactgacccctgaaaataggcagacttacccaccgatcacggtactaggagactgggctcacctctccatatggatgggctgcccatgtaagccttagaaccccaggatagctctttctctaaaagaattttcagtccctaaggaaataaggtaaagatgagctgagcctagttactcttctgaaacttacaaaataagtcactcctcctcctctgagaaaagcctagagccacactaattgatctccttctaaggaatgaaatgttaggtgtgggaaaaatacattcctaatgcgtgataggatcttaatggtgagagggaaggaaggacatctcaggctgggtaatagataaatgtgaaatttgtaagcaagtcctgaggagacagaaaaatgtcatgattaagaacactctttttgtagtaaaacagacatggtttaatcttgactcttttttgatctgaataagtcacctaaatgctctggcctggttttctaatctgcaaattggagataatagtacccgtttcatagaactcaataaatagttgcaataatatttaaccaccagcataattgagcatggggatatgctgcataatcagacacttcctttacaaattaattttggaattttaagttttattaaatgatctatttccttttaatttatcagcttggtgagatcaaattcctgtgtattgtgtttttcttgaagtgaactgtaccttttacacaccgttaggtctcctatattgctattttatatcagtacaggaggagagtggtatggattgtggggacaggagagagcagcataggcaggtacaatgaatagcacacaacaaaatgtagaggtgaatgcaaggatgtgacaaagtgtaagtgatgtggtatgaatttaaatgaagactaccaaaggggaatacaggtggaaagaacagcaggcataacttcatttccagctccatccttcttagagaactatttttttttttttaacgagagcatgccaatgagcttgaaaagtgttaaactgaaccaaaaaatgatatctctaattcttcagggtcccagatgcttttaaatgcatgattggacaatcataaaactatcatgaccatataactgaagatgatttaagaatgtactttcttggttatttagagagcaatgttatgggtgtttttcttttattatatagatatgattgcttatgattgcagtatcacattaggttattgattacatggtactctcgggacagattatttctcttgtatatgtatatgctaggatgctaaaggacatctaccacacagataatttttgaagaagatgactacatgaaaaactgagatcttcaaatggaagcatttttaaactcctcagtgaagcatctactctcacatgagctctgaacttaaccatataaaacatggccttgtaccaatttaatgactgatgcaagagagataagttatgcatgtgggtcaaaagctatggaataattgagagggtttattcacagctctctaggtatgacatctgacaaggagagagaaagaaaatagcaaagagcttgcatgtctcttcgtttccatcaaatatattttcagaagcagaccaaaaggagttgtctctgaaatttaataacctctagaaatagttacataacatgtagaaataagtttgttttataatatgcagttcttagatgttgaaaaaaaaagattgcttgatcatttcttaacccagccatcttccaagtatgtacttccattatttatatagtggagctgtcctacttgctttgtaaggcaaaatactgaaattcactaaaaagaacttctcacacaaaggtacatttctactttgtgtgatattacttactgctttgaatggcctcaggtcagtatttttaggaaataactatgacttttttgactaagtcctctagatcccaagtaatttttatctttcccattgccaaagaaacattcatatgagtctaacaagatgacttagattaaattcacttttatatttgaatatttcctggggcttttctataccttccaaatacaatggtcctgaaaggatatttgtaattgagttttcaaggaatcaacacctatttttggtagttgtgttattgaaacgggagtgtagttcccttatccctctcacagggcgtgagacagggtgtggctcgcttcttccatgctctgctgctagaagccctaggggaagcatgcagaagggtaggttgtgtggagcatttatgggctcccaccccatcggcgttgtccagggttgagtgtttgcagcgccagaaacctcagtaggcatgtgttacagtttgctctttcagttttgccctcttcaggcgacttgtgtgaatcagctcaattagaccctctgccttaccacaaagacagaaggctttctgtatcctggattcttgccctagtgtaccagaaaaattgggtcacacttgggcttggaggatagatacaaagttttattagctgtcagtgagatggatggggaggccagaagggggatggagtgggaaggtactcttcccctggagtccgattgcccagcggtagggctctcctcccactgctcctggctgaatttcactgttgatggtctgccagcgtctgctggtttctgtctgtgggtgttctcttctgctcctctccatgtccaactgcttgtgtctgtgcctgctagggtttccggtgttttatgggcacagaatgggggcatggcaggccagagtggtcttgaaaaatgcaacatttgggcacaaaaacaggagtgcctgttatcacttaggtctgtggagcctttgtcagggaccccacccttctctacccagcacttccctgcctccctgcctcccttctgtggttaagaatgacatgtgatttgaacattaaataatcataatgtccaccttggtggggtatgtggtttaagtgaagtggtcatctgtaagataataattgggatttccaagtcagacacacctggattccgacatttgatatttgataatgaagccctgctgggaaaattatgtaacatttctgactctagtttattttttagcagaatgggttttataatgttacctatctcattgaatggttgtaaagattaaatgacatgaagtacgtaaagtgctagcacagtatttggcatgcagtaagccctcaacatgtaatttggtgttattacctttgaataagataaatggaagaaatctttgataacttatcactaaactccaaaaaaagactaaatttcgtgtcaaatgattgtgagattttaaaagaatctttggagaaggtgatgctgtatctctgtgtatgtgattttcctttaaaaattttttctttctaagcctaccagctgcaacttaagcacatatccttttttcaatatttccagattggcacaagagctgatttggcatataatttatgtctcatgtgtatacagtatgtagtgtatataattgctatatatagtattttttataaaatgttcatcatggaattagattctaagtcagcaattctctttcaaacgcagctgcatccaaatgactctttccctggggaaggaaattttttattttcccctaaggtcacacaaagccataaatgtgaagagcagctgacagaaggcagtttttctctgcggcactttttcctgacagtagtgccatgatgacccttgtgtttggttctgtcactaggattgatgcgcttttgtatgggttcccagaggaccatttatgttttgcaattccttccacagattaggatagtgctctgcaagtgctcactcaatactcatttgttaaccaacagtaaaatactacaaatggatacctgtagaagcaatgcaagatcatgttctttatcttccaagtttgtttactacaatgtacaagtgcagccacaaggtacacattataaagatttagtggtttcctagcctcagatccatggactacataaatgccatgtgatatgaaacttacttgaatgaagcagacccacaaaatacatgcacaattgtgactaggaaagtgcttttgtctagacagaggttttataacttttattaatttcctaaaggatgaacaattcaaaaatcagggatcatagcactgacaaaagctctaaagtaatagatttctctttgtatgcaagtgaaatctttaaatatataatcacattttgcctgagaatgctttcatgtttatatcttggcactacttccattcaattgtgctaaccaaaaacccagagagtcatactggacatcttcttgctcatatgtaatccagtatcaagtgctgtcaactttactgactaaattctgttcaaatccatctgcttttctccagctctgctagcacagttaatccatgctatcatcatctttcatcaggaaaacagcaatagactcaaaattctttactgtcattcagactcgtcctctgccaatccattctccacagggtagctagggaaacttttaaaaatgcagatctgattattaactcccctgaataaaaagtggtttcccatttctctcagggtaaagacaaaagtcctgaacatgaccctatatggtcgggccctgcttgtcctgcagattctctttatgccatgctcttgtttggtctctctattccagctagaataaccttctttttattctttatgtgtgtcatgtcctcttctaccaaggcttctcagcatgtattgtttcctctgcctgaaatacttaaaaacattttttctacaaattcactcttagtgcttcttatatgctgcacatattactttagcaaaatcttccatgacttccactattatacaaattcatgaaaccatatgctctgtttcagagaacttgttaccttgctagcacaatgggctcaagaagagagtagttattggctacgtatggattcaatagcatgggatcttattctccagatttgatctagttactgccaccatcaaagggtctgcctagaagtaacagagaccacagctgagtcccctgtgtggcaatatgtttttatttccttgttaataatttgatgaatgtgaatctttccagttagactgcagtctcagtgaagggaagtattcttaatggtcaaattttcaggtcttggcattgctcctggtacagagaagacatccatatgaacagactgaatgaatgaaaaaatggtctccttcattaagcataatatttgtaaaagtagaaattatgaatgtatggtggattgaacaaagtggagaatttacaaccatcttccttgagatcaaatgccctttccatctgctctctagctatatggtctcagattatacaagtggttacaacctatgagtaaggactattgctatttcaaggtacagatggagaaaactgagacttagaaaacgaacaattctgcattagtctcccattccgacaaaacaaaaaacaaaacaaaaaaaaaaaccgagttattctctaagggtcattcttacttacggcctctaagaaatttgggaatgacaatgtgttctatattcacattctttacatgggtcagctgtgaaagtgacttagacttgtaggtagagacagaggctttgaacctaacttttcactacagcattttttaaaaaaagcatatgaatgaaaaactcatcgtggaatcagatcccaagcagggttgagagtttccaaacttctcccatttcctaggccttatctctttcttattatcctttaaaatgtgtgcagtagaagctgtgaggtgccataaagatttctcttcaggaccaaggcagtcattcctttggctgccaggagtgttgattgctgacaactcacagctgagtctctgtctgggcctctccatcatcttcatctaagagcagctaggaagctgccttaccctaggcactcccattccatggggacagcctgcttcgaatgaagggtatatgtacaagtataaaagctgccctcttacttcaaatagagacaactctggagggggcagtagaatttcattataagatgtaaatgtgatacatgtggatcaagcatgagcaagactagtagacactaatttgctgcacgagcagagtgtccaggtctaatgccattcacttaaatattgatttaaatacgttatgtcagcatttctcccagagctgacacctgtggctgcatgagaagtctcctatgactcgatgtcagaggagacaaaaggtaagcttgattcatgaatgagcaagttctgtgtatgtttatagcaaaagagatttgaggatgacactgtgcagttggaggcattctataccatagaccttaggggagtcctgaaagataatggtaacaggaaatcctcccaatggataaaactttagtgaatatctacttcatgagggaagaaaagtggcccaaagtgaataagtatgaattattggacagagttgaatggcttggctgattgattaggaaaggcctgcaaataaaatagataaaaggtaatcaggatcacccagaaagactggggaaaaggtatatatgtgaacctatgggagtggccagggtatgaagatctttgtatttcatgttaaggtttatcagagaccatctagtacacaggaggtatcaaacaaccatttaatattagctatcctctgttatcaggcatcccattgctagcatgatgggctcaagaagagagtagctatgggtgatacatggatctgaaagcatgggatctcattcttcagaattgatatagttactgccactttcaaaactacaacctagaagcaatagagacaacagctgggtccccagtatggcacaactgctcaaggagaccaaccagctatttggtggaatgttgtctgcattgtacttctactttgaaagggcaaataacttattttgactgaaatcaaaagtattttccatgtgaagatttactgttccttttcacagggtctcagctagaaccactatggcagctcatagagtaatctaccaccatggcatcctttataatgttgcacaagacaaagggactcacagaacagccaaggaggtgtgacagtggtgacatgtagatgggacccactggtcctacacatttggcacctaccagaaactgctacacatatacagcaatgggacaggctcttcaaggtacaactgagatactggcttaggtacaatgccctgcacggatggggtgccattttataagatgaaataaacagctttaaccaatacagtgtttctgtgtccctaggaggcagaatacgtttgtgcagcaataagacaattgatatatgagtggtcccacttaaccatcactccaagtgtcccatttgggttttctgtgcttttcatccctacaaatctggattctgtggctccagaggtcctgcttcccaaggagggaatgcttccagcaagggacacagtgagtttcccaataaccttttagatttagctgccactcagccactgtaggcttcttgaatgaagaagtcaacaagcaaggaaagaaaccaccatcttgttagagcagtggggctgcagatccacagtttttaccatgacagggaagagtataatcactggggtgtcttttggtacctccttgccatatcttgacagaaaattgacaagtacagtggtcatggactaagaaggacatggtgatcaggaagtcagacctctcagggatgacattctgggtcacaattagataagcgatcaagacaagcatagtcaagggttcttggaagagtgagggaactttagaatgcaccggagaggataacaatagcaacagctgaggactcaaggtcagcttcagaggtggggcctgtagtttgttccaccaaacttgctttgtatattttccctggaaaagaaaccaaccagaatctttgagcagctatttctagtacagatagttaggtcatgattctgtcttatacattttagggaagtagaagttacagacaaagtcataaatcgatacatggaggttacattggtttggcccaaaaaggtagaacatcttgaagcaggggcttacaggtcataaatgcgttctttaatttgcaattagttacaggagtaaaacttttctaaaaacttggagtgagaataaaggaatgtttaggttaagacaaggaaggctgttaaccaatgtactgggtcagcgtgacctgtagggttacatgacttaactcttgtctggcatacttaggtaatgtttataatttgatatcttattatcaaaaagagtgtcttttgttagtctcatgatctctattctaacattaatgctggccagttgttgtgtctaaagtccaaaaaggaagggataaaatgagtcatatttgacctcccttcctattatggtagggaattcagttttaaggttgtctgctgtcccgttagccaagggggcattaattcagtctgttggttgggggttaggatttcatttttagtttacacactatctagttactatgaagtaactatatctaccatatagcctgtggtagatagatacaaggaatctgccttatctgaggtattccccatccatggcagcaatcttccaatacagaggtacaaaaaggaataaatacctcaaactgggcctaccctgaaaggttatccagctcaagagtttcaaatggtcagtgaaagatctctgttgcaactgcctcacagtgcagcttctctttctgtccagtcctgcttcgctcagctctcacaggtgtcaccaaaattactatccaataaaacccctatatttgttgtgatcccaaaaagaaattcagctactcctaaatgtttggtgtttacttggctttctgggaaggtaacatgtagttgacagtaatatgaaagatattttagggccatttcatatgatcacaatcatatgatccattgaagactcattgataaggtgttatggactgaaatgtgactgcccaaaattcatatgttgaagcccaacctccaggaccttagaatgtaatcatatatggagataagtatataaagaggtgattaagttgaaatgaggctgtttttgtgtggtcataatccaatgtaactgatgtcattataagaggagaaatatacaccaggggcaccatgcacagagggacagccacatgagtaggcagcttgaggtcaaccatctgtaggtcaatgggagaggcctcagaggaaactaaccctgctaaccaacttgatcatagacttctagccttcagaactatggaaaaataaatttatgttgtttaagccattcgatcggtgatattctgttaggtcagcctagcaaactaatacctaagcatgctttaaattgggggatataatatcttgtttgacttaattagcaaatattttctcaacatgggcaatccaaaatgaagaatccagtctaaaatgttgttgtatataaactctaaagcattggtagatgtctgtaacctggagaaagcgctgggtcctctccccagataacccctttctgtcccatgttgtaaaccctctacacctccatggaataatcaagatcactaagacaaatatttaaagaaagaataattctcttttcaatcacaatagttcctatttattttactatactctaaagaataataattgcaatcttttgcaaagaaacttgtcacattgggatagtactggacacctgagggatggtatgtagacatctcatgttaccttaaaacactttgtccccaatctgtgatcacagtgggactatgggtcaaaccaaacctagttcaattaggggtttttagtttgaaacaaaaggttgggcaaatgacaagcaatatgggttgggtctgtgtcctcagccaaatctcaccttgaattgtagttctcataatctccacatgtcatgagagggacccggtgggaggtaattgaatcataggggcggttaccctcacgatattcttgtgataatcagtatctacccctaccaactcctaattgtgtggtttctcacatcctggctttttgctgtcatcagtgtgaagtgggaaggatcaaactataatcattaaaataataatacaataaatgcagtacgacaatacaaggtctaacttttataagcactgacaatatgctaaggtcctaataaattcatgtgcctcaacctcatcaacccttccaatacctggaatatacctatcttagtcagtttgggctgctttgccaaaataccagcgactgggttttttcaacaacaaacattaatttctcatagtactggaggctagggagtccacagttaaggccctagtagcttcagtgtttggtgagggcctgcttcctggtttactgtcctctcactatatcttcagatggcccttttgtggtgcatgcatatggaagaaaagagatgtcttgtctctttctctttctataagggcattaatctcattataaggtcccactttcactacataatctaatcctctttatcttccaaaagcccacctccaaataccatcacattggggcttagggtgtcaatatatgaatttgagggaaacagaaacaataatccatagcagtacctattttaagaaaactaatgctaaaagcagtgaaggaccttgccccaagttaggtggtaagaaacagggcctgattttaaaaccagaacttactctccattgagaccacactcttacacacagagcatcagtaaaagtcatgtctacatagaacaccaaacctaggatgagaaccactgataattcctctgccaaagaaactcaaagccatttctgccagaaaaataagcccagcatataagaggaactgcacattttgaacattattttctcatctctgagactgttcagccagatttaatggaccaaggagaaaaagcagatgagtaactgcttgacccttttgccctctccatgcctgcctttcttccatctatctagaccttaaataaaacatgggactagtctatttgcaaagtgctgtccttggtgctgaggatggaaaatgaacaaattaggcacagccctttgctttcatggaggatttttttttcttcctcttcttcgctctatactttttctgttctctcctaactaccatttccccattcaccctggaaggaagctagtttttcctatgataattagccttgtcttcccttggtctgtgaaatgaatgcatggtctcacttcatattgtttgcataaactctccctctacctcttttcctttattttgtaattttcctttcatctcttattttatctcaccatctctagcatcagcataaacataacatatgattgtatatcaaatgttcaagaggttctaatcttgttacaagtgtgtaagaaactacatatgttataggtaagacagttaacacaataattacccatatcataaaagaagcagaatatctgagactcactttctactctgtccagtgtggggttggatgagatcaatgggggttcttcagcctggaagcacattagaatcacctgacgagcttgaagactcagcagtgcttgagctgcactcccagggacccttactcaattgacaaagtgtgagtactcaggattggtattttgaaaaatctccccaagagattttaatggcagccaggctgcagaaccactggacttgaccattcctttaggtattttctggctttaggattcagtcacctctaaatgtatcttttaaaaacagatgctagaagtatcactgttttgaaggcccacatttcatccccacaccttattttggttaattagcttttgtggtgaggatgcactatagcatggtgaaggtgaaggttttgacatggagttaggtggtgctgcataaaatgtttcctgagtagagcagggttttttgtttgtttttttttctcctaccttgctgccattcatcatcgactgcaacatcttttctctctgctttctgctaatctcatatatattccatcttccacacacttgccaagaatgattaatctctaaaaaatccaatctgatcttatctctcctctatgtttctctccccttcaataattatttcccttaggatcaaatgcaaacttcttgggtatgtcacccaagaatctgtctccatctctcaacttatgacattcaaaatacatatatcaaacttattaaaccaatctattaaagcacttactatgtatcacacactttttagagtgcttaaatgtattaatttactgaagcctcaccacaaccctaagtgttagattatcactattctccattgtaccaatgaagaaactaagactcacagagattcactaacttcccaatggcacacagctagaatttcatagtcttgggattcaaaatctgacattcttttcccaaatcctgtgcttcttgatgagtatgtgttaatacctgccttacataacccatcaaagttcacttgttttccttctattttgaatgtttatcttccatcagatcttcgagtactgatcaatatctgtgatctttgaaggtccagttgtgttaccattcccagaagcagtccctaagccctcacccttcctcactcaagatttagggcttcttctctactatccaggcacattgtttcaacatctgtgttctggcatttattgcactatattgtaattttctattaaagtatctcccttaaagcagagtaaaatccagtctgtgaaatccttgaaggcagcaaatatatcttttatctctgtattactatcctccaccacattgaagagtgaagtccccaatatgaaatgttcttttagtaatattgcgatacaatttatcatctaacccaggaaattttggaaggtgctattaataattttcctgtgatgataggtatgaacctggatggatggtcaccttatttttaaaactgctttctaaggtgatttttctaatgccttatctaccaaatcctcccagaaataatacagaaaatgttctgcctttaagtatttttttattttgtgagtcagattgtacaaattctccaagatatgaatgcttataattcctcaacatctacacctttgcttgtagcttagtgtaagaattagtaattgaatggaatcagtatcttgttaaaggaggtggtacttagttaaaatgacaaatgaatggtgtttttgagggaaagttcttgaagttgacgatcttatatttaagtttattgctgattgacatgtacacatattgcaatgtttgaggatcagtgaagtagaaccttctttctgtgtcttatttctgctggaagtgctccaaggaatgattctgcatcgctctgcacaactcatttctgagtccctccaggagaacacttgtggatgatcagattgatcctggcttagtgattaagagtgtggtattggtacttgagtgtatggggttcactcctcccattagctgtgtgatcttggatggattacttaactgtgcttcagtttctttatctgtaaaatattacagtagctatcacatatagaattttgtgcattaagttaatatctaaaaatacttaggtcagtgcctgggatttggtaggttctatataagtatatcctaattaaataaatggatagtgtcactgtaaacataaaggcattcttctcttttccacccacatgaggggagatagagatgtcttcctatgcataactactccacttctctcatatatgacacctgtccatatatttttctctgcatctggctgagtgtgttggtcatcacttcaagtttctatgccacagggcctccagcagataatataattttgaggtttaaatcatctagaaataatttaaagtagacaggaggatgtgtgtaggttatatgcaaatggtacaccattttatatgaggggcttgagcatctgtggattttggtatctgtaggaatcctggaaccattcctctgtagataccaagggatgactgtggccagctaatgaaaagtgttactttccatctaatatataagttctttaggattatttggagagaaaggacatttagcagtacaagatttgaaaattctttgcgcctttaactaatctcatattatatcattaaaaccatatgcttttattgactgaagagcattaagtagtgatagatcaaagaaagatcaggtagcctacaaacttataattactctgttaccatcactggaaggcatttctgattttccagattatggtctttcttttatcaccttcatggattttaccttatttgagaaccacctgcactacaattttcctcagttttctttatattccatatttgaaaacttaaatatgtttaaagaaaacactatgtcactactataaatgtaggagcaaaattgccatttagcttatcataaatagaagatagcctaaaaataaatatgatgacaagaaaagagtgattaagcagatactcctgcttgccaacatgttgagtcccaggttcgctccccttttattgcaaaaatactttagcacatttttgtaagtaaatgtgtcccagcaccaaagggagactgtcttctagagttgatctaaaaggctgaatgaaacagggaataattttttcagcatgagattcagtggtatttagtgctttttcttttcataaatctcttgtagacatctcacattttgggaaatattgagaggaataggaaagaagcaaagcaacataatataaagactaaagactttgaggtatgagtattgttttcgaattgtgtctctgtcacttaacatgtagtttgatcttacaaagtattttccttttctgagattgtttccatctccaaacattgaagaccacatctacagcagggatttagtgacaatcacattagacaatgtatgtaaaagttcctcccacactaagcctcaaacattcagggtttagtaaataatttactttttctaaatttatttaaaatttatataggaaaattagctttttctatatccagctcccaagattttaggagtagtaaagacttgctttcctaattctatattggatcatatctgaatactctagagataccacctggttcatcacccataatatctcttttgctaattggaaaaaaattcctaggagcctaatacgaaccagacattgtggtaggaactaagttacagaagtgagtgattaaacacttgtcggcaaaaggtctaatggcagaaggaagtaaacagaaaattataataccatatttaatcagttctggttagcccatttttttttcatattttcacatttatgtgaaatgtgccttatatttgatgccatcttgtaaagatgaaaatggtaagtactattttggagagaagtccctggacttctggtgctcttggcagggcaggagaaagtagccctcagaaaaagcactccaaaggaggagttgcttagtgatatggaccaagggaggaggaaattggcaagaaagggagtggcatgtgcaaagacatagccatgtaagggatcatgttcagggcccatgaagcattctgtgcagcagcagcatgaggggagaatgaggggatggaccatgaggctaaaaggtgagttataggtcagatcatggagagccagggtaagggatctggacttttttctgaagaataagaaatcctttaagcaaggatctgggatgacttgatttgcaatatccatagatttcactgggtcactggcatggaagaaagtaggcaactacactgaggagcaaaatgaggaagagacttatcagaaatcaaaatccaacccacctctctgaagtgaactaatcaaggaaatgctctggagaggaggtcacctcagtgtcatcctgaggggtcagagcaggagccagcatgctctagacatgaatctgtggcactgggtggctgggctgtttgcctggactcaccctaagtcaacagaggctgtatttccatcaccatttccgggcaagcttgtgcttctggcatcatctccatgtgccctgggggcaaatttagctgagttttgaatgtgtgaatgccccattatatctgagtgtctgaaaatctctctcttcacaaacatgcactgaacaaacagaatctgttctcaataggaaacaactgtgccactggagttggcaggaggaagttggaaagaaagcaagtcacagctctgctgcctaccaagctgcctcttccagcttcctgttgaaggcccctttggttctctctccacaaaccagagggaaaatgctgggtattcgcattcacaacttcaattgtttcaaattaaactcccccaggagccgaattacctgagctaatgtatctcattattgtgcctcagtgcaatctaagaggtttcagataagatttcctgaagatagccattattccttcatctgttcaaaaataaggcacttgcaaaattgcaatcatgttcaccacagaaagtgttgctttgtttggtttcataaaagtagtgggtagaaagaacatattgacaacaaaatagaaaaagaaaggtctagaaaaaaatagtctccaccacatccgttaaatattttattgaagccccttgtatttttagggcctgacagaaaacctttgttgagcagcatgcagaacagtgttgcctgggcctgcctcgctagggagagcccaagaggcatgaattcaagcagacctgggattaaatcatggtactgtcacttactaattaagtttttctttttaagcaagtcacttaagttactcagaactcagctttccactcccacagaatatgtgttaggaaaatataatatgctactataaactgctccataataataggactctaaaggataaaaattgttcaagaaaaatttgaagaaggcagtctctggcttttaattctgcgaattaacttgaaaaatattgagatctattatatgtggcaggtaggtttgttgagtgtgtgtgtgcatgcatgcgtgtttgttggggtgaggggagcagtgagattgagaaggtgcattgcaggtagaagaaacaggatacgtaaaatctctacaaaaagaaggtgcatccaagtttgaggatttaaaaaggctcatgtgacagtaatgctgaaaaatgaattagaaaaattagactatacagggtgagttgggaccaggaatgctcatcatttagtgctttataaaactggtatttatctcattccctggagggaatagatgggacactcaggttaaaacaatttagggaaatttgaggaagataaataaagggactgtttataaaggtgtcagcaaggtgcaatgaaatcactagtgatagtgcaccattggggcctacttaccagacctaaaacaaagggataatgggagggagcaatggccttgaagagacccagggatacgaaagtttgaatgaagaagggctctgacagcagagtttgtgaaaggaacacagacagccctacaggaaggaaactcaacaaagccataaatattctgacctcacttgccttcctctgtctatcctcttgctggtaccttccactgactgaattctaccgcagccaaaggcaaaagagcctactgatgccatgatccacttgtgtcagctcccaaggcactagccagggcaaggaaaaagggagagtgggtctggaggaacaaatgaaagggacattctttctaaaggaatatgtctaatcaaatggcaaagagaagcttctagcctcaaaatcctttgccttctagcacccatggttctcatgctgacaggtacttctccactctgattgcttgagttgatggcctgtactaagcacttgttggctaagtaaccataaacaagtcatatcatctctcagtttcttcatctataaaatatgaataacaatagtaattttgattgggattattgaaaggataaatgcaataatacattgaaaacatgtaaaacagtgtctgacaaatagtaggcactacaaaaatgcttcctctcctgactcagattattgacatttcaaagaataaggaacaaaagtttagagacttttccaaaaacatcatataactagccaatgtgagaactcagagagagagacagagagagagagaaagagattccacttcaaaatagcaagtctaataatggtaatctacactctccctgaccactctcctacactgtgaattcctttaaggcaagcattatgtctcgttcattttgcatctcaggaacccattacgcacaagagttttttctcagacagtgtttgatgaatgagtatataaagcacagtgacagaaggtatagaagtaattactggaggacagaggagaactttccttgcaagtcgaaaatccttctctcttgtcttgtataactaattctataaataacaagatataacttggctttttcaacaaggtactgagattcagtaatatattgtaaaaaattaacatattgtatgattactctgaggtccattatttttgttgaatatttgaatcaccatttctgaagtagccccgtctccaggacatcccatatatgtcctacaagcagagatgatctatatcttgtaggagcatgttagagccaacattctctgcagtctagggtgtttgttatggtttggtagagaaatgatgtcttatttaacatatgtttttagtggtctcattggagttttatttatttcatcttgcactgaaagtatgacgacagcctggggcttctctgtgaaattgagtctgaaagtgtattaccaaggtgatcatcttaacatcttacttgcatggaaataaggtaggattcttaaattatagtagaggcaactcagtcatcttagggttaaaatggtcttataatgaatactgttcgtagtttgatgcccataaaaccacacagaaaatagactaggagtcaggagacacgggccatgtcattgatagtcagacagttgtttcctaaacattgaatagttgtcagtttggcttcatgtgaattcagagtaataacttgccttgccaccatctcagcaatgacattagaatcagatgcaattttatctgtgaacatgctgtgaataatataaagaataatgtaaagccaaagttattattcttctgtttactgtatttgacaaatatacattctttttcctatgtggtatctttgatattcagtgaggtttgtttcttccgtttggtcaaggcctggggctatgacaagtgtaggtaggctccagtttacaaaaaggaataactgccttctattcccttctagatttgggtagatattagtaggtttatggcaaaattttggaatattcacagcttgcaattgtataccagaaagcatactgctatattgtgcctcttagtcacagtgaacatttagtttaaaaaaacaaatatttattaatcacttattaaaagtcaggtgctgcattagctaaggggtctctaaataaaattaataaaatttgctgtttcctagggatgttcatggcttattacggtgcagtgcagatatagagtaagaactttgggtagataacctgatgtctctccatacctccatttccatcatgtgtaaaatatggataattatatctaccacttaatgtttctatgaagatgaaacaagtttggtcattataaagctttaatacattgtatgtcatgtaataggtgctgaactaatgctgacgagttgtttattattaggaaggacacacaaagaaacagatctctctatatctgctacatagtgacagacagaaatgatgctgttatatgaagaatatttacccatcttcttttactctcccagggtggaggcatgttttcttgtacactcaaatattagaatgtcacagacatgaatatgatgttgcagaaatcatagaaagaaaaacaacattttttctccagtgggaaatacatgtgtttctgttggtccctgccagcatatacaggtactctctgatgaagggacattttaggagacttaaattcatttgggggcctaaatgattaaaatgctacaaaagaaaaaaatattccaattatctctaggaatttcccaaaattttgattgttcttcatgaaattaagaagaaattgaaagcaaatttctttcaattgctttcaattgaaagcaaaatatatttcaaggactatgcagaaacaagattgacactttgtaaaattttaagatttatgaatcttatgggctataattaacttatcaagaatctttttgagttcaaataggtggatgtttttctgtgcaaagaacatagattttagctttcatatctttcaattctaatttgatatatactttaggattttgttttgttgtttcagttaaccagtgacaaagtggcatagagaataacttttggagaaacttagaaggtggggaagtcacaacaggctacagtaggctgtggttttctttctaaaggatacaggccatgtactgggtttttagggcccattaaggcagtggtaggtgaaaggggaggggtaggaaggtttctcagtgagcagtaaaggcatccctgatgtcaggcatgcataaaggtggtgggtagagggatcagcagacaggccagctgcaaaatgtgacatctacatccatctttgggaaagcattgtgttcattcatggtaaaaatgggggaaaattattgtggtagagacattgttaaaaaagtgatggaaacctaaagcatatatcatagtttacatgtataaccatatagtattacaaatctggacagtcctccaaatccctataatctcttctttgagatgtagttgcagtttgattatttcctagatggtaatgaatttgcctctgctgcttgcaagtgcatttacagtcacttcataaagcccttaaacacacttgtgaaggagcttcatgctcatcagaattagtctggactcatgtttcctgtgatgcatattgacttcatctgtagtacagctgcatctacaactctgtgaagatgcaaactgctagttcttcctgaggacaagtcaacgtgaaaaatcccaaatgagactgtaagttccactagcactgcatgaaaaatcagagcctagatacaggccaaagacctgttttggaccctaacctctgactgagttttcttcagaattagaatatattttcaaaagggacatagaattattttcacaaagatattttggggtctgtacatcacttgatgaaaatgaaagatggggaagggaattaacatttattgaacgactgcaaatatacaaggcttgtatgtatatttcgccttcataaaaatcctctgaaatagacataattatgccttgtaaataaaagcattactagggcagtggttgttgtcagtgcttaaaatagtacctgttacatactataatagatgctcaattagtatttgtgaaaaagagtaattgaattgaatcttgtagctgaagaaatagtagtaaagaaaagttaagtacttttcttaggaacgacctgcagagagactttgggctaaggcatggtgcatgtgggaagtgagaaaactcagattgggatgcaggtctatctgactgcaagacatatgattcttcaactatattttaatatccctccctgatggcattttttcatgaaaaaaaaaactatataattctcaataaggtggatgttactgatttctaagttatctatgaagcaggcagagctgctgacctccctggattattctacaacgaaatcctcccctcctgatcagtagaatagagatagattttacacgaatctttgtcagctgcctcaaatccttttttaggaacaaggatgagaaaacataatcacacaaataagtaatgctgacggtgtactgtgatttcattttcatttcaacaggtatttactgtgtgccaactatgttttcctgctttgggtatgcagtattagaaaaggaagatatagtggagaaaagatacaattcctgcctgaatttgctcagttttattttcggtggaaagaagaatccaatcagtgcttttaaaacctggttgtatataagaataacccatggtgtttgctgaaagaaccgaattagactatctgggtttgggtctgggaatttctatttttatcaagagccccagatcattctgatgcacagccacatttaggaaacactgaattagatgcaagctagaatcccttccagcttttgaattctatgactttctatcattacagaactttctcacaaaaatagggagaaaaaagaaatgtatgtttctgccaacagagcattaaggcaaaaaaaggatgagagtttgtaaggcagagattttgttctgtaaggtcaagggcagcttgggccagcaccagcccaaattctaaatggttcaggccagatgtagattccctaggtacttgataggaaagagcatggattatgttggaggggtagtgaaaagtacaaaagagtaggccaggaaggtttaaatgagtgcatttagcatagtgtattgcacatagtgaactgtcagtgaatttttgcttaagcgatgattattattagggtggtgggtgggtgattaggctgagcattgagataggaaagcacccacatttgatcagcagttagaaaggagattgaattggccccaatgaggaatacccaaaggaggttttaaataagacaaatgaagctgcattccctcggcattctatgtagtgtgtgggtgatttgtattgactgcttaatgctttcagagtgctagtcaacaatgttaagatacaaatataataaaagaaatcaggagaggcttagtatttcttgagcacccacactgtaccaaatactgtaaagtggcttgcatgttaaaccatttaatgcttaaatttacccactgaggcaggtgacattagtctcattttccagtagggaaactgagactcagttatatttaacccatggttatgtgaaagccatggtctaaacttcaggctgagttgagaagtacttaccattctcttttaactgtcacttagaaaaatcaccatgatggtttttattctagcatatgccttagtgaccataaattcactcattttttctaaggcccagaatgccccactgttttatttggtttgctttgcactttagttcaggtgtggctaactcaagggacttaaactaattatgaagaataagccagccctgttgcttgtacttccaatggcttttctcttagtaagatagtaaattatcatgtatgtctataccttattagcaaagctaaggaatgcaactgttttccttctttagaaaaaagaaactcagtacaaaatcaccttctctagacaaagccacttaaataggaatcagttctcttcattacagataatcaatataatggccattgagaattacatgctttaaaaaaagccatttattagtctttgtgtaggctagggttgttttataaacactaaaacataggcaaacagttgttaatgttttattatagataaatgacatttgttaatcgtgttaatgatcatagtggctaacattatttattgaatggttattgtatctaagcattaggcttttgaaatgctttccatattttatttgaatttcataaaaaccctatatactagatctcttttgatctccattttactgatgaagaaattaaattttacaaagattgaattcctttaaataccctgctagtaaatttaatgcaaggcctaatttggtttaactcttcagcccatcttttgaaacacatcactgaattagctctaagtaaataaatcttttcatatagcaaaatatcgttctacaactatgtaattatgtttctgaataatatttaaaggcatgagaaaatgtccatagcacaagagtaagggtgtatgacacatatcaaggaaatgtatatatacatttaggaaaatacttcaaggaaatacattgaaacattcacatttttcactaaatggttgaattatatgtgtactcttgtgttctgctcaaaacatctctgttttcatattttctataataactatttatagttagaaggataattacgtattaataattaaaatagaatctattaatgtagtaggattataaggaaatacatcaaaataatgagaaggttttatttaggcaacagactatgaaaatgcaaaaatataattcttttgcttataattttgacaggctcatcatagaaaatattttaaaaattgaaatggctgagttaccatacaagatcctttgtagtctagcccctggctacctttccagaattaattcttaaaactctctgtaagataaattctacttcctgattttaccatatcacttgaaggtactatactctttcacaagtcaatgcctatatatgtgattccatttgcctgcaatcacaaaactgtaatgtttttgagagcaaaggtcatatcatcttaactctggcatccaattttcctaacacagtacttacaatacagtaagccttttaaaatgtatatttgtagagcaaatacgtgatcttctttcacctgttcctccctctattttcagtttaacaaagtgattagatgatccaggctttagagacagtggaattaaaagagtggtgtataacattcacatttactctatgctttctgtttcaaagttttacagtgcaaatgtattcatatattacttatataatttaaaatcaaaagaggaggaaacatattttattaaaatgttctctacagaaaagttgagatattattattaggcattgtcatcttttaatcctttgttcaaagactgcctcttttctaaagcctccctgaattcctcataggctcagttcacttctctatcttcctagtttccattttgattttgcttctatacctacacattctgcatgaaatttttctataattttctataatgtgagtgaaagcacagagtctaaatcacctttatagactaaaggcttaactcatagtatatattggctaacaactgaacatgcacgtggaatcctttctcaaagaagtcacagattctgtaaaagacttcactgagaaattgacttttgattaaatgtttgttttgtcttctccttgttattctcagtgaagcatgtttggccaccctatctaaaattgcctcatgctatcccttgtcaaacaaacactattccccttccctcttatatttttctccttaacatttattatcatctgacatacttttttttttaactttagtttaagttcaggggtacaagtgcaggtttgttacataaacttgtgtcgtggggatttgttgtatagattatttcatcacccagatattaagcctgatacccattagttatttttactaaccctctacctccttttaccctccaccctctgaaacacccagtgtatgttgttcccttccctgtgtccctgtattctcatcgtttagctcccatttataagtgagaacatgcagtgtttggttttctgttcctgtgtctgctgaggataatggcctccagctccacccatgtccctgcaaaggacacagtctcatccttttttatggctggatataattacatggtgtatatgtatcacattttcttcatccagtctatcatgatgggcatttaggttgattccatgtcttttctattgctaatagggctgcaatgaacacacatgtgcatgtgtctttataacagaataatttacatattttggggtatatacccagtaatgggattgctgcatcaaatggtatttctgtctttaggtctttgaggaattgccacactgagttccacaagggctgaactaataatttacactcccaccaacagtgtataagggttcccttttctcccaaacctcatcaacatctattggctcttgactttaataataaccattctgactggcatgagatggtatctcattgtggttttgatttgcatttctctaatgatcagtgatgttgggcattttatcatataattgttggctgcatgcatgtcttcttttgaaaaatgcctgttcatgtcctttgcccactttttaatagggttgtttgtcttttccttgtacatttgtttaggttccttatagatactgggtattagacctttgtcagatacatagtttgcaaaaatgttctcccattctgtagcttgtctgtttactctgttaatagtgtcttttgttttgtagaaactctttattgcttgactctcttccctaaaatataaaagtcccgtgaagacagaacctggcatttaggaggtatccaattgatagttgttgaacaaatccatgtcacgtacaaaatcacagagatatgcatggaagacaggaaaaatggaaggtctctactatacaccatctaagcccttttttgaatattgttttgacaataaatgagtggctgtgaacttttaagataatacactggaaaaagctttgaggggaaagtgtttatacctatgactgagtgcagatatgttttcccttgcagacaattaagtgaaggtggaagtaagcatcattttattacatataaataatctgctaagaggccactctcagcctctggtacaaggtaacttgagataggagttgcctgcgagccagccttttaccttaaaatcctgttcaggatcctgccattcataccaactgggtgaataaggctatgaagtttcaccccacaaatcatagtcaaaacagttttagctgaaaacactcaatgcagaaaaaaacagctactggccacttttttttctctgtaatagggagacatattcagcttatccaaaatgaacacattttagaaaaagttaaaaataatattggagagcgtccttctgtctaatctccattaaaattgttatgtgccctgtgcaaaagccatttatatggacagactcacacaggtttgcaggaaaatcattactctgtgtgtgtgtgtgtgtgtgtgtgcgtgtgtgtgtgtgtgtgtgtgtgcctgtattgaatttatactgcttggcacaaaaccagtctctatcaagagcaacaaaatccagtaaggttcacaatatctcagatgtgttttttcataatttaaaaataaatacacagtggttaatgtgggatagccatcacgtagcatttctatatgtggcttcaaatcctggctctaccactttaccacttgtgtgattttaagtacattctttaaccttcctgaaatttattctccttaggtgcaaaaatatggtaatcacacaaccttaaaataggattcttagggagattacatgagcgaatacatgtaaaaacatttagcaccacgatggtgatacaaagcacactcaacaatcgttggctataacagtgaatattttcatcatgaaaagagcaactaatttttctcctttctagaaattcaatcttttttggtgggagtgcaaggttgagaaaggtcccgggaagagttcgcatcttgtcattaaagccacccctgcatcattggaatatttgaactaagaatgcactatttcatattttattgattctattaactgaagaatatagcactgcaaactgtacaaaagttagaccactcttcttaatttctaatgtttaccaagtatctggtggttacaaaaacacagtctaatattacagtttatagcattatctttcataagtgactttaatcatacatgcttatactgttaatataaatgttaataattattccaaacaagaataaacatctccagattcatactgttacaaatgcacatccataacttgattttgtgccatttgggtaagtctccatcttgtcactgatggttggaaataagtgaaaaacatcctatctatgaactcactttcagtaatgaagtttttatgcctctcagtaatgaagtttttatgcctccaaggtgaatatagataagaacatcctcttttactgaaatcatcaaatatgtgaaaagaaattgacaaaggaaaagacagcttttgttctccacagtactggatgcaaatgtgaaagactgttcacttttatgaagatatacctcattacttcttaatttctttccagaaaaacagactggggatgtaaggtgtgactaaatgactagtgatatctaattttcacaagctgaacacatggcccgacactgggtatttggtcaattcacatttctaaattaattagcaaagcagtgagaaggaaatatcaaataatggaatattctcttggttcacatttggtcaaaatttcattgcctggctgagaattactaacaattaacacctgtgcatttagcctgcaaccatatttggcattatgtttggttttagcctttactggagggtggaatagcagaattatactgttaaaccactcctctaaaactgtggaaaaatgagttggtatcactgtaaggatgccctgatgacctggtgtgaaatctgcctccaaccatttgtagcttctcagggaatctgctgagctttctgacacaactccaacctgcctcagggcccttgctgtgactgcgttttcaacacttctccaagtgttgagcagagggagaactcggaagtgagaggaattactttatggtaacttttgtacatttcagaagccataacatgcagaaatctcagtgcagctgctctacttcctagatctctcagatttgtccaggagggactggcacaatcaatctttatatactaagacaagggagatacctggacaaaaagctagacatatactattgtttactgtataacaaaatggtctgttttgtttggattttccagcaattcatggctatgctataatttctttaataagtagattttaatttttagcatagttttatgtttataaagataataatgcagaaaacacagatttcccatataccgcctcatccccagtttcccctaatattaacatcttgtattattgtagaatagttgttacaattgatgaatcaatattgatacattattattgactgaagtctatagtttactttagggttcactctgtgttgtacatgctatggcttttgacaaatttataatgacatgtatccaccattatagcctcatacacaataaaatttcaggccctaaaaatcccctgtgccctgcccattcatccttcttctcctgctccctcctcccttgaaacccgtcaaccactaatatttttactgtttccatagtttttctttattcagaatgtcatatattaagaataatacagtatgtagtcttttcagattggctttttttttttctcatagcaatatgctctcaaggctcctccatgatttttcatagcttgatagctcatttcttttcatcactgactactattctattgtatgaatgtgccacagtttataccattcacccactgaaggacatcttggttgcttccaagttttggcaattatgaataaattcatgaatacatatttatgtgtaggtttttgtgtgggcataagttttcagctcaactggcaaaatgcaaaggggcatgattgcttgatagtatggtaagagtatgttttgttatgtaggaaactgtttgttcgtttgtattccaaagtggctatgccatttcgaattcccacaagcaatcaataagacttcctgttgctccatgctttttttcttgcttgtctctcaaacaaatggttgttactatggaagaggtcattaagctacatgagttctacaaaagatgtgggaaacctctgaacactcaagcaactagataacaacttttcactgtggaacattccttccccttatcattgaggttttaaacagcagtgtcaacctttgtgtactcactccatcactcttcatagctcctagcatgatccttatcttagccaggcatcaggaccctctaacctcatgcttactcttgtagcatcacttcaggctctttgttcacttggcagccaggatgccctttttatttatttattccttacttcttaaatcttgtttcattttagattcagggagtacatgtgcatgttgctatatgggcatattatgtactgctggggattgggcttctatttggatatccattacctaaatagtgaacattatactcaataggtactgagaatgcccttttaaaaatgaaaatccaaatttaaactctcttaggagatagttcaaatccttaatataatctatgaggacttacatgtgctcgtagctacctattcctccagatccatctttgaccattttctttcctgcttagtttaactcatctctattggctgccttctcattccacatgagtgttgttactaatctgccactgagcctaagcacataccatccctgatagtggaaaggtatcttctttcctacccaatcttcacctgttaaaatcatattctttcttcaggtctcctctgcactgaccttttctcaggaggccgtcggtccctgccactctgcttacactgtgtcctaaagttacttgcttcccaatactccatatacttactcctaactaactgccctccatggtgttattgcacagttcttaacttgatatttatcttcttctctagatagtatgttttgtgatggtagggttgcatctattttactcactagtttattctttggaccagtaatagtgatggggcattgtaatatattaataagtacttacttactgcatgaatggatggataataacaaacataggtggctggcaagatggccaaatacaaacagctccagtctgcagctcccagtgagatcaatgcaggtgggtgatttctgcatttccagctgaggtaccttgctcttctcactgggactggttagacagtaggtgcagcccatggagggtgagctgaagcagggtggggcatcacttcttccgggaagtacaaggggttggggaactccttcccctagccaagggaggctagggctgtgctgtaagaaacggtggattctggcccagatactatgcttttgacaaagtcttcacaacccgcagaccagagattccctcaggtgcctatgccaccagggttttgggtttcaagcacaaaactgggtggccatttgggcagacagtgagctagctgcagtttttattcatactccagtaatgcctggatgccatgatacagaaccattcactcccctggaaagggggctgaagccagggagccaagtggatcccatcctcatggagcccagcaagctaagatacgctggtttaaaattcttgccaccagcacagcagtctgaagttgacctgggacactcaagtttggtggggggagaggtgtccaccattatcaaggcttgagtaggtggttttcccctcacagtgtaaacaaagccaccaggaagtttgaactgggcagagcccaccacagctcagcaaagctgctgtagccagactgcctctctagattactcctcactggtcagggcatctctgaaagaaaggcagcagccccagtcaggggcttatagatcaaactctcatctccttgggacagagcacctgggcgaaggggtgactgtgggcgcagcttcagcagacttaaatgttcctggctgccagctgtgaatagagcagtggatctcccatcacagcactcaagctctgctaagggacagactgcctcctcaagtgggtccctgacccccatgcctctggactgggagacacctcccatcagggatcgacagacacctcatacaggagagctctagctggcatctggtgggtacccctatgggatgaggcttccagaggaggaaacaggcagcaatttttcctgttctgcagcctttgctggtaatacctaggcaaacagggcctggagtggacctccagcaaactccagcagacctgcagcagaggggcctgactgttagaaggaaaactaacaaacagaaaggaatagcatcaacatcaacaaaaaggatgtccacaaaaaactccatctgaaggtcaccaacatcaaagaccaaaggtagataaatccacgaagatgagaaaaaaacagtgcaaaaaggttgaacattccaagaaccagactgcctcttctcctccaaaggatcacaactccttgccagcaaggaaacaaaactggatggagaatgagtttgatgaactgacagaagtaggcttcagaaagtgagtagtaacaaactcctctgagctaaaggagcatgttctaacccaatgtaaagaagctaagaaccttgaaaaaagatgagaggaattgctgactagaataaccagtttagagaagaacataaatgacctaatggagctgaaaaacacagcacaagaacttcatgaagcatagataagtatcaatagtctaaccaattaagcagaagaaaggatatcagagattgaagatcaacttaatgaaataaagtgtgaagacaagattagagaaaaaagaatgaaaaggaacgaacaaagcctccaagatatatgggactatgtgaaaagaccaaacctgtgtttgattggtgtacctgaaagtgatgaggagaatgaaaccaagttggaaaacactctttaggatattatccaggagaacttctccaacctaggaagacaggccaacattcaaattcagaaaatatacaaaaacaccacaaagataatcctcaggaagagcaatcccaagacacataatcgtcagtttcaccaatgttgaaatgaaggaataaatgttaagagcagccagagagaaaggtcagattacccacaaagggaagcccatcagactaacagtggatctcttggcagaaactctacaagtcagaagatcatgggggccaatattcaacattcttaaagaaaataattgtcaacccagaatttcatatccagccaactaaacttcataagtgaaggagaaataaaatcctttacagacaagcaaatgctgagagatgttgtcatcaccaggcctgccttacaaaagctcctgaagaaagcactaaatatggcaaggaaaaaccagtaccggccactgcaaaaacatgccaaattgtaaagaccatcaatactatgaagaaactgcatcaacgaatgggcaaaataaccagctagcatcataatgacaggattaagttcacacataacaatattagccttaaatgtaaatgggctaaatgcctcaattaaaagacatagtcaggcaaattggataaagagtcaagacccatcagtgtgctgtattcaggagacccatctcatgtgcaaagacgcacataggctcaaaataaagggatggaggaagatctaccaagcaaatggaaaacagaaatcaggggttgcaatcctagtctctgataaaacagactttaaaccaacaaaggtcaaaagagacaaagaagggcattatataatggtaactggatcaatgcaacaagaagagctaactatcctaaatatataagcacccaatacaggagcacccagattcataaagcaagttctaagagaccaacaaagagacttagattcaaacgcaataatagtggaagactttaacactgcactgtcaatattagagagatcgatgagacagaaaattatcaaggatattcaggatttgaactcagctctggaccaagcggacccaatagacatctacagaactctcctccccaaatcaagagaatatacattcttctcagcaccacatcacacttattctaaaattgatcacataattggaagtaaaacacacttcagcaaatgcaaaagaatggaaatcatagcaaacagtctctcagaccacagtgcattagaactcaggattaagaaagtcactcaaaaccacacaactacatggaaactgaacaacctgctcctgaatgactactgagtaaataacaaaattaaggcagaaataaataagttgcttgaaaccaatgagaacaaagacacaacgtaccagaatctctgggacacagctaaagcagtgtttagagggagatttactaaatgcccacaggggaaagcaggaaagatctaaaatcaacacattaacatcacaattaaaagaactagaaaaggaagagcaaacaaattcaacagctagcagaagacaagaaataacttagatcagaggaaaactaaaggagatagagacatgaaaaacccttcaaaaaaatcagcgaatccaggagctggttttttgaaaagattaacaaaatagaccactacccagactaataaaaaagaaaaaaagagaagaatcaaatagactcaatagaaaatgataaaggggatatcaccactaatcccacagaaacacaaactaccatcagagaatactataaacacctctacacaaataaactagaaaatctagaagaaatggataaatttctggacacatactccctcccaagactaaacaaggaagagttcaaatccctgaatagactaataacaagttctgaaattgaggccttaattaatagcctaaccaaaaaaaaagcccaggaccagatggattcacaaccgaattctactagaggtacaccgaggagctggtaccattacttctgaaactattccaaacaatagaaaaagaggggctcctccctaactcattttatgtggccagcatcatcctgataccaaaacctggcagagacacaacaaaaaaagaaaatttcaggccagtatccctgaggaacatcaacatgaaaatcctcaataaaatactggcaaaatgaatccagcagcacatcaaaaagcttatccaccagtatcaagtcggcttcatccctgggatgcaaggctggttcaacatatgcaaatcaataaacacaatccatcacataaacagaaccagtgacaaaaaccacatgattatgtcaatagatgcagaaaaggccttcgataaaattcaacaccccttcatgctaaaaactctcaataaactaggtattgatggaacgtatctcaaaataataagttatttatgacaaactcacagccaatatcacactgaataggcaaaagctggaagcattccctttgaaaaccagtacaagacaaggatgccctctctcaccactcctattcaacatagtattggaagttctggctagggcaatcaggcaagagaaagaaataaaaggtattcaaataggtagagaggaagtaaaattgtctctgtttgcagatgacatgattgtgtctttttagaaaaccccatcatcatagcccaaaatctccttaagctgataagcaacttcagcaaaatctcaggatacaaaatcaatgtgggaaaattcacaagcattcctatacaccatgaacagacaaacagagagccaaataatgagggaactcccattcacagttgctacaaagagaataaaatacctaggaatccaacttagaagggatgtgaaggacctcttcaaggagaactacaaaccactgcccaaaaaaaaaaataagaggacacaaacaaatggaaaaacagtccatgctaatggataggaagaattatattgtgaaaatggccatatttcccaaagtaatttatagatttaatgctatccccatcaggctaccattgactttcttcaaagaattagtaaaacctactttaaaattcatatggaaccataaaagagcccatatagccaagacaatcctaaataaaaagaacaaagctggaaaatcatgctacctgactacaagctatactacaaggctgcagtaaccaaaacgcatggtactggtaccaaaacagataaatagaccaatggaacagaacagaggcctcagaaataacatcacacatctacagccatctgatctttctttgacaaacctgacaaaaacaagcaatggggaaaggatctcctatttaataaatggtgttgggaaaactggctagccatatgtagaaaactaaaactggaccccttccttacaccttatacaaaaattaactcaagatgtgttaaagatttaaatgtaagacctaaaatcataaaagccctacaacataacctaggcaatagcattcaggacataggcatgggcaaggacttcatgactaaaacaccaaaagcaatggcaacaaaagccaaaattgacaaatgggatctaattaaactaaagagcttctgcacagcaaaaggaactatcatcagagtgaacaggcaacctacagaatgggagaaaatttttgcaatctactcatctgacaaagggctaatatccagaatctacaaagaactcaaacaaatttacaaggaaaagacaaccccatcaaaaagtgggtgaaggatatgaacagacacttctcaaaagacatttatgcggccaacaaacatataaaaaaagctcatcatcactggtcattagagaaatgcaaaacaaagccacaatgagataccatctcatgccaattagaatggcgattattaaaaagtcaggaaacatgctggagagggtgtggagaaataggaatgctttcacactgttggtgggaatataaattagttaaaccattgtggaagacagtgtggcaattcctcaaggatctagtgccagaaataccatttaacccagcaatcccattactgggtatatacccaaaggattataaatcattctactgtaaagacacatgcacacatatgtttattgcagcactgttcataatagcaaagacttggaaccaaccgaaatgttcatcaatgatagactagataaaaaaatgtggcacatacacaccatggaatactatgaagccataaaaaaaggatgagttcatgtcctttgcagagacatggatgaagctggaaaccatcattctcagcaaacgaacacacgaacagaaaaccaaacaccacatgttctcacttataagtggaagttgaacaatgagaacacatggacacagggaggggaacaccatacactggggcctgtcagggagtcgggggctaggggagggatagcattaggagaaatacctaatgtagatgatgggttgatgggtgcaacaaaccaccatggcacgtgtatacctatgtaacaaacctgcacgttctacacatgtatcccagaacataaagtataataaaaaaacataaatattaccattctggatagtagttactatgaattaagagcaatttattaatgcactactgcaaacagaaacttctattatccacaaaaaatgccatttttttaatggctccagaaagctgagaaagtcctttatgatacacacttatcatatggacaaggttttcatgacttcattcctgcccacttctccagcttcataattcaccacttctacttatacatgagtctctagtaatgttaaactgcttcctaatacccacaggcatcatgctgttttgtagctccatggcattacttagtattattctactgcttgaaaagcgcactcccattgcctgacaaatcacctttgattctttggatacaccttagacctcacgtctttcaagaagccttctttgaacaccagtgcagaccaattatatctctatgccgtcacatcactctgtgtagtcctacatcatggtgcaaatgttcaacaaatgtttaatggaagaaagtgaatcacttgccaagttcaaccaacatcactggaatattttggtttatcttcctatcactcttgagactaggagtgacattattgatgggattttgttgttgttgttgttgttaactgcaatatccccagtgtattacaatgtgcctggcctggagtagccacctgacctatatttacagaaattaactgaaagatcaaggtaaaccagtattaagatgtgtcagatttgctcaagagtagtttaccaaaacaatcacagcatccattttgttcatcctagataacctaatagtttatttaaaattgaattttctgactttctgaacagctatcagaatttattccttttaggctataaaaagggtgtgttccagctgcaggctgagctgacctaagaccattgaatcaatgctcagtataaatgatgccttgcaaaaatgaccacaaaagtaagatttgtccagagtctcttggattacattctagtgtccttttcactaattgaggtaataattattcatccaatccctctttgaaacatccctgcctaccaccaactttgaccactcctttctctgagccccactacacactgtacatgtctctatcatagcacttagcaaactaaactaaaaccaattgttgaaatgtagtctcctgtttgactgaaaattccctgaatgcaagattactttattaatttctacacttcaagaatctaatccagtggctagcccatggacatatcaattaatgtttttcgaatgaatgaaccaatgaacctatgtccaaaggaattagttgagttgtagtgttattaataaatgtcataaatatataaaacaaaaaattgcaatatttgaaaacaagatataattaaccttgactctggggaaggaactgacgtttgctgaacttctatgatgtgccacacactgtgctgggcacgagggactttgtcaatgttatcttgtcacaccttcacaacaataataaatttgtaaataaaatcgccttatttttcagatgaggacacttgaatttagagaaaaggattataaatttaagataattctgatatcaaagtttcttttcctgctgttcagagaatatgacttaaagtgaaaaatactcagaatgagtgtgaatatatgaagaaagaagataaagagacttctgattaagggttagtggagtgaaaaatactctttaccatgcaaaattttattggctcagattacaaggtctccttccatccacttgactgtcccctgcccacccctctggttagatagaaatcattctgccctagagactgtggatgtcctgtcttggctatagttttccaggactgagtggcagggatagatgccttaaattaagactcttgccaaagaagactttcaaagcaatgatttcttcagtgcattttccgtttgtttatgaatttccttagtacttttattatagcacaatctattgatcttgctaaatgaatttcatagacatgacccaataaatctatttatcaatatttaattataacagcaaatggaaaaattcattttctataggatagaactctaccttgtactataacgtgtagtttctctgagtattgatgcattattctcgtcactagattagaagctttttgaaaatggaaacaaattcagcttagcttagctgcttatccccagcatctaagataatatcttgagtataacagctgccaattaaaaagagtcagtcattgaataacttaaaatatatatcatcctctaatctgtttgggaaggttctggaaatcctgataaaaatatacaggttgagataagaaataatttttcaagtttatatatatacatgaaatatgagactcagtgaaatcaaatacttctcagactatgcattgtgagggatggaacccacgttccggactctgaattatctcttttcaatttaagcatgttggaggctaggagttgtcttaatatggcataccttgaaaacccagcgaattttctatgagattttctgttttcagaaattgcaagctattatttaagctatggtagttttagacacattaacaagtgaaaattaagaagctgaaaatagcagtctttgtggttacatattaagatttctgagagttgacccacaggtctagacattttctctgcttctttatgttatacaatagcagataaacttctcgagaacgtgtaaattttattcttgtaactgtttattgtcctaggggagtgcaaggacattaataaactttagagaaaggcagttggcattcatgaaaacaaaatgcagtagtgagagaaaaatagggaaaaagagggtctatgaccaatcccacccttaccttagaggtttcttgctgattctagatcactagtttcctgctgtctgcttgcttggcatttctaagaccatgaacagtatttaccaaagtatggcgtaagggatgctgggaatatacaagattattttaggtcactattgatgaatatttttatttcaatagtcatgcatttttataattaacttatatttataaaattgctgtttttcacttagaggtggaattcctgcaattcagtagcaaaaaattaaataacctaaacaacagaggagcaaataaacatttctccaaagaaagcacactaatggccaataggtatatgaaaggaccctccatatcacaaattacggagtgatgcaaatcaaaactacaataagatatcatctcacacctgttattattatgttttaaaaagataagtgttggcaaaaatgtggagaaattagaccccttgtacactgttgggaggaatgtaaaatggtacagtagctatgaaaaacagaaataccatataatacaacaatcctacttctggatatatatctaaaagcattgtaaggaagatctcaaagagacccaccctcccatgttttttgcaacattattcactatagccaattatttccaataaatgaatgactgaagttcaggaaacagttacaacataagttgatccaaatatcttctattttaaattttttcttgcaaaatagtaaattctcttggttacagttacttaacatgctgtaactttgtaactttttagattacagaatattttcatcattttctgtctgtcacagatgctagtgacaaaattctgtgtatcatttttcttcaaaatataacacttggtacagtaagtgctaaacaaagacaaccaattatggatttattaagtgtttgttattgacaatgaatatggaaaattggaaatggattccagagatggagtcaacaatatttggtaaccagatggctgtgctagctgaccaaggagagacatcatagatggattctgggtttgctaaattagtattttaattagatagtaacatattaaaataaataagttctctaatctactcataaactaatttcatcttattgagattgcacatttgatttttacaattcaaaataaacctatcttaagatcttaagctagtcctgcttttctaacacttgagttattcattcttaataaaatcatcttatataactcgaagaaatacattgtttagttttatttttttaaatgatgatattcaccacattctcactcctgtctcatgggcttttccttcatttgcccaaagatagctgttactttaacagtgatatgaaatctctcagcttctctggcactttgtggtcagtaaattttgtctaaaaatgtagctttgccaacattcattttgctgaaaaatgaaataaaacgagttttcaggataaacgttttctgtgcccattaccttgttgtttggtttcacactggtaaaactttgtttgtccctgttgctatcatctttgccaactttctctccacatagcaatctgcaataataacttccccaggagtgagcttagtcctcagtctctgagccaaggaaatcctggaagtaggttggggcttccttcccactgactggtaaacaggatctgaaatgggtctgctgccttcacgcctgatatcctgggcaggtaggcagccccagggtgtacctaggaacaatgccacacacttgcattgacatctgtctgtgtattctgtcttcccattaatttatatctggaaaataattcaacatcctttcattttaatctcaaatctgtgaagtcaccatgtcaaaatgtcagaccgttcgggagacattgactgcgttaatactgtccttcacactactgatacactacatgcacagccagccacaggctctttcccaagatcatgaagtggtgtactcgtgtaattgataaccaaattcaaaagatataattattaattatttctatgctggagcaaccatatggcctatgttttcctgtgacatttccttttatgattgttctcccagagttacaacacttctgagcactctcgaagttagacaatcatttgtggtcatttagacaatcatttagataatcatttgtggtcaacctatttatgtccttagaaaaacctgttcaccacttttagtctcagttaaaggtattgaacactatgatttctaatgacaatttcagttttaacatttacaaaatataaggtcagcctcaagtacacagaaatgcaacaaacctaaaaaaaactttcttgaaagtaacggatgcctaatgtttacatgaaattaactttatttttggatacagaaactgacttctgcgggatctttgtgttttaatgtgcaaattgattttatgattatccaacccttactcaggtaaagaagggtaagttctgaaggtcctggaggcttgttttctcccaaatttttgtatctctttgcaagtggctagatgtgtatatcttagtcaactcaaaaacagggcaggttgatgccagcaactgaattttggagcccacctttactaaaaaggctattttctcaaccaacaaatgtctcttattacatagtagagttaatgttccctgatttcctttccaactttgttacaaatatgtgagtgtgaggggcatggggtcctgctttgctggcatttttcatggtgcctccagctggtctactcaggcacatttccctgcaggatgggaattgaaggggattctggataattcactgattctctgccatgtaatcccttgcaggaaaatactgtaatacaccatgacaagattaaagtgccactttcatggtatcagtagccattatactagggacactgaactgtttatcaatatactaaaaatgaggcagctcagtttgacaagaaaagtgttggaaaaggtctgacccctatgctaagtttcccgtgctgtgcctcagcaggcttgtcgcacagcctccaagtctgtcccttcatctaggaaatacatgcagtggatagatcagattaagtgctaaaccagtaagttatctaaacaaattgattatagaatctaggattaggaagaaggaggtcactagaggaagaaggagaaattgaatcacacatactgtgttgagacctaggtgtacctgcaacttaaagctcacactatgaaaagatttcatgtcttcaatgaagatgatacattctcataagttactgcttcttatgctcagacacagatttcattgtggatgtctcctttaacagtataatgctatcagggcacacatctaggtctcaaccttttcacagacagaggtaagagttgaattgtccctgcatgtgtagcctctacagctatgttgaagtcaagaagagtgttttttctctgggaggcttggtgctttaatccagtaggtattcaatgaacacttaaatgttgattaaaagtaatgaaattcaggactgtataacatgtattaaacatcttttatgggctaagtttttacaggtaatttcttgcttcaaaaataagaaaattgaacctcagagagtccataatgcttatgaatggaacaataattactgatttttttgaagcccaagtatagtgatctgtcctctgtactgacatgccagtatggagacaacaacaaaatagttacatgagagtcttgtacagaacattttgtgatattttttcatcatatatttagaaaataaaaaggaagggaaggagcttgtcatgattttaagcaggctcatcttggccatagatttttatcacatctaatcttctttcacatctatctatactacaatatgcatgatccatttaaacagatttaaaagacaaactgaaatttagctttaaaataactttttaaatgtcatcaagttatatttggaaactttatgagagcagttatacaatcctataattatcatgttcatgaacctttccaacaagtatacaattcatgattacaatgtttttgaaagatagatgtgaaaatgaataaactagaataaagacagttgtgaaatttcatctagtgaaaatagatttttaaaattcatgtattcagagagtattttttgaagcaagacagtttgagtctggctaaatgattgaaatcacaagaattttttgaaatgtttctgtattttatgttattttattatttgtactttagcacaattataaaatctatttttattataatatgtggcagaatagagtgaaaaaagattatataaactggtaacttaagaaacacatttcaacatttgtgcaataaataaatatttaataaatgttgtgggaaaatcaatgatcagaaccacagaaaaatgttgtcttcagattacagaattgcacttgaaatgctgcatttcctaaattttgttataattaaatatgtatacacatccaagcctttatttaaaactgtcccatctattgtaggaaaagctgggtaaaaaatgtattaagaggtctctttaattccaccatctgcttctgcaaatgtgaagagctctgagttcatgattcttaatcagtccatttaaacatgaacaactatttcacagttaagaaagcaatgcaaatacctgtggaatacttcttctcttaatgttgaatgtttaaatcacataaagtggtcaatggatatgccctgatccttccttccacctcatctaacacagtcactcttatacatctctgtttaccaatcttgacattatcctgcccaaaaaacttccatggcttcttacggactactgaatgaaatcatgacattttgtcattgctttcaacactttccctaatgaaatctcaatactcatgcccagctagccttctacaaatacccaatgctccagtcctgaacctttcattgaaatcaactgctcttggctcttggtcacgcgtttcttacactctcttcttcgcctatctttacatgctccaattccagatgtcatccaatgtgtggctaaaatgctgccttggtcatgaagtatatttttcactttccattagaatacatttctatatttccaaaatttccataaaattaaaattacgtatttcatagcacatagcattgtttacattgtcattttatatcctttactagactataagcacttgggcttataaatcctatgtttgctttctgtaaccttcgtagagctagaactactattctctccttggcatatggtaaacaagacttacaaaaatctcactaatgcgtaattcttatgcattcttcactcgaattcaccaaatgttgacatattacataaattagtacagtttttcaacaccagggaacaccatttctaaactattaactaatccattgacctttttcaaagtttatcaattgccccactaaagtattctataggcaaaaatcttattcaggatcatatactccatatacttattgtatcatcttacatttattttaatttaggacagattttcagcctttctttgtttttgatgactttgtgaagaataatggctgatatggttaggctttgtgtccctaccaaaatctcgtcttgaattgtaattcccacgtggggagggtggaaagtgtttggattatgggggcgggttgtcccatgttgttctcgtgatcacgagtgaattctcacgagactggatggttttataagtgtttggcaagttcctccttcgctcacacttctcttttctgccaccttgtgaagaaggtacttgcttctacttacatcatgattgtcggtttcctgaggcctccccagccatgtggaactgtgggtcaattaaacctctttcctttataaattacccagtcttgggcaattgttcatagcagtgtgagaatgggctaatacactggctaattgttttacagaatatagcacaatttggtttgttccatattactcctgattatatttaatatgtagattaggcatttatagtaagaacacaacagaagttattttgagacttcttgggacattatataaagaagctcatgacactgatttgtctcattatgttagtgttcaatttgatcacttggctaacattacttttatcgagtttctccagtataagtttactatttttactttgtaatggctaagtacattgtagaatactttcagaatatgaaaatatcctatttctcattacttccacacactaattttagcagttattgattactgaaactattattttggtgtttaccacaggataatttttttccatctttttaactttttctatactcactaattcaaattctgccatggggaataatagctttctattgcctcccttatttctttatatttagttatttacctttcttattattgactcatggatgtttgttcaactaatattttaataagactattaaatatatcttggagcagtacatatatttttagagaatatatgtttaagattcagttgggtactgttctcagtattccacttgtttcaactattaattgtcatagtaaccataagaagttggtagtgttaccatactcatttcaaagataaggaagttgagacacaggagaattaggtaaccttcccacattactccaccagagtgacagagttgagattaggacctcagcaatctggctttagagtccatgctgttaacaaaaataataaatttaatctaataaggcttcgtgagactcaggagtagtttttctctctctcatcattagcacatcttcaaccaaagccagtatgtgcacaaggcatgctcagatctcagcatcatgggaccaggagatggtgaaggaagctaggattaagcagaatttgcttccaagagtaaaggatttggcaggttggaggaagattatctagccacagaggtaagtcctagtaaggatggtggagcaatctgagatataccagaatacggtcccatcatagcccaaatgggatctgttggtggtatcttcctgctatgttcactgctatagtagattaggattgtatactatgtgttcaggatagaagaacagctttacctgtagcaattaattagtcaaatatagaaggcagacaaagagttgggaaactaggcggcaaccacagcttaagaggagttcactggtaggtaattaaatgatatttatgatgaaaataacaaatatcagcgtggctagtcaggaccagctgacactactggtctggaataccatgaagataatcaggcaaactacagagtacagaaatgaagcaaaaattcacttttgcaactggaccagtacagtagggagaatgaaatattgcaacttggttgcaatagggcacctgcttcggtaggtgtagcaacacagtaatctcactcccaggtttaggcctacagtgattagacttcttgctaaacttcatttgatggggctgagacttctgacattcttattgcttctgccaggaaagtctttacagttccaactcaaaaactgtaaatatttgaacctatacatgggattcctttgacatttattcttacattcatgcattcactccttatcaaacacatacaatgtgccatgaaaatgtgcaggggttagaccatgaccaagacataatctatactatagtatattaatctataccatcaagtaatttattttctagtaaggtagttcttcaataatatatgcaagacataatctatactatactaatctatactatcaagtaatttattttctagtgaggtagttctctaataagtactgagcgcacatggaaagcagtagtggctcaaagttctggtggtgtgtgtgggtgggagggttaagagaggatttcctggaggaaatagatccacctgtgaggataatggaggcagagaaaggtagacaagcagcaacaggaacatacacctgtttaataaaagcaaacacatttaaaacaatatggaagtggcccagcaagatatctaccccagtaaaagaaattcatgaaaaccacccccactgccatctgattaccatgttcagctgcggtgaagtggaaggaaggttaggctgtgccacagatatttatagactcttaaatagctgtaaaagcgtggcattgaatgacatttgtgtaacccctttcctaataatagggattagagctgcagaagatctaggtggtcatgtagttcaatctctgatcatttctaattctagaaaggtgtaataataattatttacatttgcataatactttataaagcactttcatagccattatcttatttgctcctcaaaacaattttctgaaataagcaggaataatatcatcaaaattataaaaaacaattttctgaaataagcaggaataatattatcaaaattattattgcctggaaaaggaaacttaagacggtaggaaatttacattaatggctagagatgataacactagggagtggagtcaaatctgggatccaaatttctaacctcttatccaatgttctttccataataccacctgctttaatttgctaaccaagggagagctgatacttagcaactgggagtctcatatcctctcttggtgactctccaggtatttattgttcctttctgtgaagagcctatgaggagagggagaaatcatgttacacagagaaagtccttcaaagtacgacctctctggaacacctatcttagtttctctttggcagtttgtagaaaaggaatgtttttgtccttacctcaggctttctatttgagaatctgtgggtgtaaggaatgcatttttaacaagcccatttgggaatattgatgccatctgggaagtgtaaaagtaattacagaactgcttctacagagtgttggtaggctctaccatctaagaccccctaccccagtcagaatagatgaagcagaaacaagacgaggaggaagctccagtcagctcctcttcatgcagaaatggcatcaaggactagtattagagaggatatagcccccgacaaattctatcaacttctgaaaagatgcatttaaaaacagcgagattgctatgaaaatataccttcaaggagactctcctaggctctccttccaacagaattgccatttagccctgttttatagaaaccccatgtctgttcttgcatgggctattacagcaggacccacagttttaagggaaaagggtgatggaccatctcacttcttctgtaagaatccagtaggcaagtaaatgtgtaaagctctgaggaaaatatcaagagaaaatatctactcaagttgccactacttggcaccaaactgggtacacgatagacttcatgttatgttcaggttttactagtacaagattctagggggaaggggaaagtggtgagcagatgatattttcataacctgagtataatggaactttatctcaatctcagtttccaaacatctaggacatccacacttctcatgccaaataatttgcctcactgctggattaagttcagggtgactggaaatgacagagccaggcctttctcataacgaccctcaatggtgacctcctcatagaaggcattgtatcttttcttctgtggactctcacaggctgaatgggcttgcaggattcagagccagtgagagatatgattacaaagcctcaggataagccttaggccattttaccaggatccaaattatcagtgaaccaaacagcctggctggaggagatttgaggcaaatacaatcacattgcatcgtatcagaaacctaataacaattttccacaagtagtcactaaccaaaaatggcatattgtagccccataagcagcagatacttctaattagctctagatgattgaccacacatacagatttggctatacatgctagaagtaattgcagttaattgtcaatggtaatgaagcttgtattgactagttaggcaaacatcaaaagcaaaattcaaagctgtttcaagaaaatattgaaatgatacaaaggttgctgaacaaggcaactgtccacagatttgtgaagttaatgtaagaagcatactagtaaggttccatcctatatcacaattttaagggcagattaatcatatacctcccatttcctaaggtctaaatttaaaaatctaggaccatagttagataaataactttgcgtcttctttcagtggaaagccaaatgagagcaatttgatttacattaagtattttcaagtgaataatattaatgaaaggccagagggaaaaaatgacaggaaagaaaattataccgaggcctaatagcaatacattacaaacagacagggagacattaacagctagacattctgtgcagcaaaccattatttatgacaaggtcacctttgctttaagtagatattcagcagtcattgcataataggctagtggggacttcagaaatcttaaaacctcgcccctttattttatagcttttgcaactgaagcccaggagtggggaatggaagagaaggaaaggaacaagtatcgagcacctatggtatgaaaatgcacatttctatgcctttcacacaccccacctttcaatccctacatgaaccttgaaaggcaggtgtcactggtctcaagtcatgctttaggaaattaacgcttcacagcagaaatggtagggcgtgtcctactgcaccatgatgccttcctaaaaagaaaataaaggtggctcatttggtgaaccagcactgctctggtattagaatccaatcctgactcaggaatcaacccataacaactctatcagaagtactttcgagaatctaaaaaataatatccaagaaccatttaaaaagtgaaaacatttggcaaacactgagtttaaggttgaggtaagtcctacatactccagaatatgtatctatatgcttactcagaaataaggaagtctagtagagtacattgattaaaaatgatgactgacattgattgaagagagagtgtatgcctgtctgtatactagactattttaattgatactcaattataattgttatattttacacatagcaaataaatataccgtagaattgttaagtgacttcacaagttatatagtcaagaaatggaaaagccagattttaaacccagggttatggtcacccaaagcttttgctttttctctactactcacttctcctaatttttttttctttttatttttctttttttttttttctgagacagaatcttgttctgttctatcacccaggctggagtgcagtggtacaatcacagctcactgcaacctcaacccttcgggctcaatccacccacccacctcagcctcagcctcccaagtagatgggactacaggcacgtgccaccccacctagctaatattgtattttttgtagagacagggtttcaccattgttcccaggctggtcttaaactcctgagatcaagctatccacctgtctcagcctccccaagtgcagggattacaggcatgagccaccatgtccagcctgatactctttactcttcactataacattcttaggctgagcagttcgtttggaccttggccttgtagatcttgtaacttctatcttttattttcttcatattttgtaacttcaaacttttatgtttcttttctgtaccagtcttgtgtctccaaaaagatggaaaacttaagtgtctctctatttaattccaacacccagtgtgagacctcacagattgttggcagagaaaatgtcaatagtgatatctgtgagaggagctgcttttggtaggctgtagtgatagagcctctagcagccaatccacctcagcgtttttattcaatcactttttgctcatgctgagaaattcctgaggcattcaagaagtaggcatttctgaaaagccccatctactacttaagtgaccttgggaatattatttagtccgtctgtgtcttggttccctcatctttaaaacgaacctaagatcacatatctcagaagcttgagtaaaaattagaagaaataattctttgttgagtgactggcatgtaataagcatgcaataaatgttgatcattatagccccctttggttccaacctttgctaatcacccttgaataatccttagattgataacccttggaatccctctgctcctccttgacctctttaacacggcccaacaaacagcttaactcaggtgttgtctctctaggaatagcatcatcattattcttactcccacagctctggcttggttaataatacattttttttgtgtgtttcctctgaaatatatatagacttccacaataacttctacaacactgtaaagtagtttttcccctttaattttcctttttccttctactgggcaataatatgcttgacaacagggatggtgcctaaggtatctttgtttagcctgattctagcctagtaagtgtcacatttgtgctgaattaatcccagatatcatatacaaacaaacaaattattcctatactggagactatagtggacaatttattttcttgaggcagaaatgggattcaatttggcctcaatgattctggagacaaaaaaaaaaaaataagcttaagccaacatctttttccaatatacgagctgatttattttcacctgcattcatcatatactaactgcttattaaatgaaaataaattatctgagtttctgacttcttgctatagccaaagatagagactgttaatatgctagaatagctattttctatatattcacacatcaaagatggttgtaatcagaaaaaaagtagcatgtaagaagttgggaataaagaagtatggctgctgttgccaatatcaaaacttaaaaatttaatggagtcaagaaacctaaccataaaaatccaaaaatcaatgaagcatatcgtttagaccttgtgtttctttctgaaactttcaggtatacagaatatccaatttaaacagaatttttaaaaatgtcatatattattttttactttgaaatgaacaagattcacaaagtaagtatactgtgagtataatattgtcattgcataaagaagacaccccgttatccaattattttaatgagataatattccatttctaacaaacaaccttctgtttctcactaaaaccaaaggctctcaacctggtttcccattttctggtagtgacgagttaaggcttcaaaactgtttccaaaaacacagctcatttttccacaaactctaatgatttattcagatgcatgtggttttcaccatgtcaatgtgaatacagcataacaagctgggtaacacattccttagacttaagcattggagataaacagattatgactgaaactgacctaagacttggagtagatatagaacgaagataaatgcctgaatttagataaacatgaagcttcttacttatgttcctgttaaactaccagatcactagaccccactagaatatttctgaactctaggctgtacgtgtacctctaaattttaaaaagcctctctagatgatagatacacacagtaaagtgtaaggactacaaagtgatttcctaaaaatggaaaggtgtcaagtagttcttccttatctaacatgcaggtagataagaaaaattcactagaatatacatactttacttctcagattttgtggtaagaaaaagtgagtgcagtttgtctaaccggctatccaggaaaaaaaaaaaaagatcacgtaacgaggagtaacacagaataatggactaaaaacatatagaaataccattttaatagttgttcaaccaccttctgcttagaaactgatttgtgttattttttattaaaatcaattattcattgacccagagggccaattagaagcagctgtggtctgcagcactcatggagaggaatataaaagggtgagtgaattcagcaccttcgactgaaatatccaggttcttacattgggattgactaggcaaacaacctgacccacgaagaaggaagaaaagtcagaggtgaagtatgttccactctggagtagcagagagccaaaggaacccccatccccaggcaagggaagcagtaagtgattgtacaaccctgcccaggaaaccacacctctcccatggatctttgcaacccatggatcaaaatatcccctatgaggtgatccccaccggggctttgggtctgataaacagagttgtgtggagtctcagcagagcagccactcaggcacacacagagactgggagttttacatactccagccctgggattcctagcaaggcatgaaagccaaccatagctatacctaggaagggagcttaatccagggagccaagcagtattgttctgcaggccctacttccatgtcacctcacaagttaagaaccactggcttggaatcctaggcagccaacagcagtgggttgaggtcttcctgagatgggtctgagttcccagggggaggggtagccatcatctctgtggttcagttgagtcagctgctccagcctgcaggctgtggagaacataagtggtctggatgagaaagggttcaccgcaatgcagtgtacctgctctaccagaaagcatccagactgcttctctgggcaggtccctgatcccgttcctcctgactgaatgagaccttccaatggaggtctccagccacctcctacaggtgaatgcaggctggcaacaggtcagtacccccccaggaccaagcttccagaaaagacactggatgccatcttgctatttcacagccttcactggtgatacctccaggtatgggaaaaactgaggcaactgggttctggagtggacccccagcaaaccacagcagccctacagtagagtggcctgattgttaaaaacaaccaaaccgaaaacaacaacaataacatcaacagagaaaccccacagaaaccccattcaaaggtcaacaacctcaaaagtcaaaggtagatcagcccacaaagatgagaaagaatcaacacaaaaatgctgaaaactcaaaaagccaaagtacctcttctcctctaaatgactacaacacctctcgagcaaggacccagaactggactgaggctgagatggctgaattgacagaagtaggcttcaaaaggtgggtaataacgaacttcactgaactaaaggagcatgttgtaacctaatgctaagaaggaaaaagtgataaaacaataaaggagctgatagccagaatggccagtttagagagaaacataactgatgtaatggagataaaaaacacaagagaacttcacaacgcactcacaagtatcaatagcaaaatagaccaagtggaggaaagaatctcagaccttgaaaactatctttctgaaatttgacagacagacaagattagataaaaaagaattaaaataaattaacaaaacctctgagaaatatgggattatgtaaaaagactaaacttatgacagattggggtaccaaaaagaggtggggaaagtggaaccaagtaggaagacatacttcatggtatcattcatgagaacttccccaacctagcaaggcaggccaacattcaaattcaggaaatacagagaaacccagtaagatactccacaaaaatatcaagccatagacacataatcattagattctcacaggttgaaatggaagaaaaaatattaaggacagccggagagaaaggccaggtcacttacaaaggaaaacctattagactaacagtggacctctcagcagaaaccctacaagccagaagagattggggccaatattcaacattcttaaaggaaagaaattccaacccagagtttcatatctggacaaactaaactttataagtaaggagaatttttttttgagacaagcaaatgctgagggaattcttcaccatgaggcctgccttgcaagagctcctgaaggaagcactaaatatggaaaggaaaaaccgttgccagctactacaaaaacacactgaagtacacagaccagtgacactatgaaggaaccacacaaacaagtctgaaaaataaccagctagcataatgatgatagaatcaaattcacatatatcaatactaaccttaaatgtaaatgggctaaatgacccaattaaaagacacagaatgaaaagctggacgaagagccaagacccattgtaatgctgtctttaagagacccatctcacatgcaaagacacacacaggatcaaaacaaaaggatggaggaaaagggatagcaagaaaatagaaaacagaaaaaagaagtggttgcaatcctagattctgacaaaacagattttaaccaacaaagatcaaaaatgacaaataagggcattacataatggtaaagtcttcaattcaacaagaagagctaactatcctaaatatatatgcacccaatgcaagagcacctggattcataaagcaagttcttagagacctccaaagagacttagactcccacataataataatgggaaactttaacattccactgacaatattagatcattgggatagaaaattaacaaagatatgcaggatctaaacttagctctggatcaagtggccctgatagatatctacagaattctccacccaaattcaatagaatatacattcttaccaccacacatcactttaaaattgatctcataattgggagtaaaacactcctcagtgaatgcaaaagaacttaaatcataacaaacagtctctcagatcacagcacaaattagaactcaatattaagaaattcactgaaaaccacacacctacatgaaaattgaacaacctcttccagaatgactcttgggtaaataatgaaattaaggcagacatcaaaaagtttgttgaaactaatgagtataaagaggcatctctgggatgctgtaaggcatggttaagagggaaatttatagcactcaatgcccacatcaaaaactagaaagatcacaagttagaaacttcacatctcaactaaaagaactagagaaacaagaggaaagaaacagaactagagaaacaagaggaaacaaaccccaaagatagcagaagccaaaaaaaaaaaaaaaaaaaaaaacaaagaacaaaatcagagtggaaataaaggaaatagagacatgcaaaacccatcaagaaatgaacaaatccaggagctgttcttttgaaaaaattaataaaacagaccactagctagattaaaaagaaggaaaaagagaagaatcaaataaatacaatcagaaaggataaggtgcatattaccacttaccccataggaatttaaacaaccatcagagaatattataaacacctctatgcacataaactagaaaatctagaagaaaccgatacatttctggacacatacaccctctcaagactgaaccggggagaaactgaatccctgaatagactaataatgagttctgaaattgagggagtaataaatagcctaccaaccaacaaaagctcaggaccagacagattcacagctgaattctaccagaggtacaaagaagagctggtactatttctactgaaactattccaaacaattgaaagggagtgactccccgttaagtcattctatgaggccagcatcatcctgacaccaaaacctggcagagatacaacaaaggaaagttcaggccaatatccttgttgaacatgaatgcaaaaatcctcaataaaatactggcagactgaatccagcagcacatcaaaaagcttatccaccataatcgagttcgcttcattctcaggatgcaaggttgtttcaacatatgcaaatcaataaatgtaattcatcacataaacagaactaaagacaaaaaccacacgattatccaaatagatgcagaaaaggcctgtgataaaatccaacatcccttcatattaaaaactctcaataaactaggtattgaaggaacatacctcaaaataataaaagctatatatgacaaatctacagtcaatatcatactgaatgtgcaaaagctggaagcagttccctttaaaactggccacaagacaatgatgccctctctcacacctcctattaaacatagtattgaaagttctggccagggcaatcaggcaagagaaataaataaatggtattcaaataggaagagaaaaagtcaaattatctttgtttgcagatgatgtgatcctatatatagacaaccccatagtctcagcacaaaagtttattaaggtgagaagcaacatcagcaaagtctcaggatataaagtcaaagtgcaaaaattgctagcattcatatataccaacaacaggcgagccagaagccaatcatgaatgaactcccattcacaattgctacaaaaagaataaaatacataggaatacagttaacatgggaagtgaaggacctcttcaaggagaactacaaaacactgctcaaataaatgagagaggacacaaacaaatggagaaacattccatgctcatggataggaataatcaatattgtgaaaatggccatactgcccaaagtaatttatggattcaattatattctcattaaactacctttgccatttttcacagaattagagaaaatattttaaatttcatatgaaaccaaaaaagagcccaaatgggcaagacagtgctaagcaaaaaggacaaagctgaaggcatcatgctaccttacctgacttcaaactgtaatacaagagtacagtaaccaaagcagcatactactggtccaagaacagacacataaaccaatggaacagaagagagaactcagaaataagactgcacacttacaactatctaatctttgacaaacctgacaaaaaacagtaatggtgaaaagatttcttatttaataaatggtgctcaaagaacaggttagctatatccagaaaattgaaactggaccccttccttacaccatatgcaaaaattaattcaagatggattaaagaattaagtgtaaaactcaaaactataaaaaccctagaaaaacatctaggcaataccattcaggacagaggcatgagcaaatatttcatgatgaaatcaccaaaagcaattgcaacaaaagcaaaaattgacaaatagtatttaattaaactaaagagcttcttcagagcaaaataaactatcagactgaacagacaacctacagattgggggaaattttctgcaatctatccatctgacaaaaatcttatatccagattctacaaggaacttaaacaaatttatgagaaaaaacaaccccatcaaaaactgggcaaaggacatgaacagacatttctcaaaagaatacatacatgtggccaataaacatatgaaaaaagctcagtattactgatcattagataaatgtaaatcaaaaccacaatgagataccatctcacaccagtcagtatggtgattattaaaaagtcaaaaaataacagatgatggcgagatcgttggtagaaatgtacattagttcaaccattgtggaagacagtgtggcaattccataaagacctagaggcagaaatatcatttgacccagcaatcccattactaggtacatactcaaaggaatataaaccattatattataaagatacatgcatgcatatattcattgaagcactattcacagtagcaaagacatggaatcaacctaaatccccatcaatgataggctggataaagaaaatgtgttacatagacactgtattagtccattttcacactgatgatataggcattcccgagactgagcaatttacaaaagaaaaaggtttactggcctcacatttccacatggctgaggaggcctcacaattatggcagaagatgaaaggcacgtctcacattgcagcagacaagaaaaaagagcttgagcagggaaactcccgtttttaaaaacatcagatctcatgagacttatgcactatcacaaaaacagcacgggaaagacctgcccccatgattcaattatctcctgctgggtccctcccacaacacgtgggaattatgggaactacaagatgagatttgggtagagacagagaaccaaaccatatcatacaccatggaatactatgtaggcaccaaaaggaataagatcatgtccttttcagggacatggatggatttggaaaccattatcctcagcaaattaatgcaggaacagaaaaccaaacatcacctgttctgacttataaatgggagctgagtgatgagaacactggacacagggaggggagcaacacacactgggtcctgtcagggaatgctggggaggttggtggagggattgctaatggatgcaaggcttattacctaggtgatgggaagatctgtacagcaaaccaccatggcacttgtttacctatataacgaacctgcccatcctgctcctgtactcctgaacttaaaataaaagttgaagaagaaaattaattattcattataatgtaggtatattgactctatcaatcaggtgtggcaggaaaacaacattgaatattctaccagaatggaagggaaccaatactcaaaggtaggcacttgaatatacatctgagattctcaaaggtggtcattacactcccagatgtatccttatcaattcctacattttctataaaaaatttacagttattgggtattacattttttgagaattataagtgcatatgtgagggtctgtatgtatctgtgttcatacatattaactatcatcatcatcatatttttccacctttttatcccctcctaaattcaaagatggggaaactcaaactataacttgccaaagtctgacatcaaattctgcagttatactacagttggggttggtctgttctccaaatcaattgtctctgtgctctgcccaagtgctcctaaagacttcagcttatttttgggtcatcactcataggctgtgcagctctgaacaattttacaacacttctgtaggccttgctctcctcatatgcaaaacagagatatatagtccccactttctctacagaattactgagattcaaatgaaatattatattgaagaacactctgtaatcctgctaaacactagagaaatataatggattaacaatccttataagaaactgaagcaaatgtgtatttagatgtttcaataaggcatttggaaatagaagatatctcatcaaagacaagagcttggggattctcaagagctcaaattgtaactagcttctcccaatagtttcagaaaacagagtctcagagaaggtacaagatgccgtaaattaatatatctgaaatgggaaaaaacataaagtagaacgacttggtcaatattaacatgaacttgaccaaattaattttttcatataaagttatggtttaaagatgagagctaccatatctgtgtaggttaggaagagtttttaatcatatggtaggaaaaaattgaatttctttaagtgaacagtgtcctatcacaatggaaatgtaagtacctagaaaatcagtattttcattttatatttacattgcaataacagatgttagcatgattttgttgcaaactctctatatccacccctgctaagacaaacataattaaaataatttatggaattgtagtatgcctaagcagtttttgagttagagacacagcaaattttttctatgcccaaagatggcctctatgatctttaagtagttctgatatttaccaggacccatttgcctccaaacagagaattaaataattttgaatttagaagctgcccttgagaatattgaatctggcacttttattgtcaaggtgagaattttctaccttagggaatgtgaggatttacacagagtcacacaggaaatggatgccaaaagtaggatactgtgccaggttttctaactacaggtccagtgatgttttccctaaatttcttactaaaacaaaagccaaaaaaatatgactctacaaaaacaaacagaggttgggactgattgtcctcaccatgaacaaggcttatatttacctctttgtatctgctcctagcagccattttctgtctctacattctacccatctagggattggtgatccataaatttttgcctccaatagacatggaaacagccttactttagcattctaacagtctgactgtgtttcgtgttattccagtttcatcttcaataaaattgccatttagaataaagaaatactagtcatgagtggtcataaatggaagagatcatataaatcatgtatttcaatactcaaatttacagatgacagactagaacccagagaaatactccatccaaagatagaaaatcagtagaagagtctacattataattcaagattttagggtctcagatcttttcattttatacatctgtgctgtcatattcagtcagcaagagttcactaggcagttattcacatggcatttgtagttataaaataagagataagacatcagcatgacaagattttataaaaaatataaagtcgaattaatatgtctcatatagtactatatgattttttgagtttctataaaatgtaaatgatgaatacatacaaaaaattatatagcaactatgttatataaactctaaactataaattataaactataactttgttgtataaactataaactataaattatacattgtatattacacattaaaatcagcaaaattgaagataggacaatggaaattattgagtctgaggaacaaaaagtaaaaaggtaggagaagagtaaaaagataagggacctatctgtaggacaatatcaagtaggataacctatgtactgtggcagtcccagaagaataagagaaaggatgacagagaatatgtgaagaacaaatggctgaaaacttcacacatttgatgaaagacatgaatataaatatctaagaagctcaatgaactccaattaaatggaactcaaaaaactcacaccaagatacattaaaatcaaactttttaaagacaaacacaaagagaaaatcttgaaaacaatcagaaataagtggctcatcacatgcaaggggtcctcaaaaataatatgaacagatttttcctccagaaatattcgaggccaggagctggggaaaatatacattcaaagcagtcaaaggaaaaaaaaccgatctgtcaaatgagaattccatatctggcaaaaatgtcctttgaaagttcgggagatacactgcaagcttccctcgggactgcagccaccctccacatcattttgccagtgcacatgtatgcaggtagatttttgcattccctgtcctgctagcacatgtgtgcatgtgcactctgccatgcctctgctgctggtggaatgcactccaccccacttcccctaccctactgccattgcagttggagcctttgtgaacacagagcctgccagcctcacccccaccaatgctgtgctcctgcaacaacactgccattagagtgaaactagtatggatgacggtggaaccacccctgcctgctctgagcagccacagagagagcacacagacttgtgcccaccagtgtctcacccccatcaatgtcccacccccctgctaacaccaccaccagtggaaccacaaacacagtcaccaataagggatgtcctcctccagttacgctgtctcccccactgctacgaatgcaatacagaggcaggaaccttggcacccactagcaccctgctgcagtcaatgagtgtgaaccccaccatgctacctctgccactggcacatgtgaacaagaatggatcctgctgccatagccctacaaaatgctttggcacctcccattgatgtttagggaccagtggtccaagagcaccatggcttccccaaccgcccaccgattgtagttggtttctaaccttgaggagccagagaggaaagtcagactcgcaagtcccctagagtttgagggcacagtccaggagatggaagctgagccttgccccactaaaatctcccagaaataaagccaatcaactgaacccaccttataccacaatcaaatcctcaaataaaaataacaaaaaccaatccaaaggacagaaacttcaaagattgaaggaacaccagcctacaaagatgagaaagaacaagcacaagaactctaagtcagaaaggcagagtgccttctttcctgcaaatcactgcactacctctccagcaaagtgttctcaatcaggctgagatgtctgaaattacagtagtatttgaaattgggtaggaatgaagatcactgagaggcagtagtacactgaagcccaatccaaggaagctaagaatcacagtaaaatgatgcatgagttgacagacaaaatggccagtatagaaaagtatgtaaccaacccaatagacgtggaagacacactacaagaatttcataatgcaattgcaagtactatcaagtaataagcaaaatagaccatactgaagaaagaacctcagagctttaagactggctttctgaaataagacagtcagagaagaatagagaaaaaaaaataaaaaggaacaaacaaaacttcagaaaaatatgagattatgtaaagggaccaaatctaagattcattggtgttctcgaaagcgttggggagaatggaatcaacttggaaagcatatttcaggatatcattcataagaacttttacaacctagccagagaggcaaatgtttatattcaggaaatgcagaaaactccagtaagattcttcacaagaagatcatcccgaagacacataatctcagaatctccaaggttaaactggaagaataaatattagtggcagctggagagaaagctcaggtcacttacaaagggaaatccatcatgctaacagtagacctctcagcagaaaccctacaagccagaagagattgaagccaacattcttacagaaaagaaattcgaacccagaatttcatatctggccaaactaagcttcatacatgaaggagaaataaggttattttcacacaagcaaatactgagggaacctgttaccaccaaacctgccttacaactcccaaagaaagaactaaatatagaacggaaacatcattaccatccactacaaaaacacactgaagtacacagaccagtgacactataaagcaaccaaacaagtctacataataaccagctaacatcatgatgacaagatcaaatccacacatatcaatactcatcttggatgtaaatgggctaaatctcccaattaaagacacagggtagcaagctagattaagaagcaagacccaatgtacggtctcttcaggagacccatctcacaggcaatgacacacaaaggttcaaaattaagggacagagaaaaatctaccaagcaaacagaaaacagaaaaaaagcaggcattgcaatcctaatttcagacaaaacagaatttaaaccaacaaacatcaaaaagaacaaagaagggaattacataatggtaaagggttcaattcaacaagaagagctaactatcctaaatatatatgtactaaatacaagagcaccctgattcataaagcaagttcttagggacctacaaagggacttagattcccacacaataatagtgggagatttcagcacctcactgacagtattagacagctcactgaggcagaaaattaacaaagatatccaggatctaaaatcagcactgaattaaatagacctgacagacatctacagaactctccaccccaaaacaaaggaatatatattctttgattgccacatggtacatattttaaaactgaccacataatcagacataaaacacccctcagcaaatgcaaaagaactgaaattataacaactactctctcagaccacaacaaaatcaaattagaaatcaagactaagaaatgcactcaaaaccatacaattacatggaaattgaataatgtgctcctgaatgactttggggtaaataatgaaattaaggcagaaatcaagaagttctttgaaactaatgggaacaaagatgcaacataccagaatttctgagacaaactaaggcaatgttaaggaaatttatagcactaaatacccacatcaaaaagttagaaagatttcaatttaataacctaacatcaaaactaaaataactagagaatcaacagcaaaccaatcccaaagctagcagaagacaagaaataactaaaatcagagctgaactgaaggaaattaagaaacaaacaaacattcaaaagatcaatgaattggggagttggttttttcagaaatattataaaatagactgctagctagactaataaagagaagatctaaataaataaaattagaaatgacaaaggtgattttaccacggaccccatagaaatacaagtaaccaccagaaaatattgtgaatgcctctatgcacacaaactagaaaatctagaggaaatgggtaaattcttggatacatgtactctgctaagactgaaccgggaataaattgactccctgaacagaccaataacaagctctgaaattgaatcagttataaatagcctaccaaccaaaacaattctcagtgccatatggattcacagccaaattctactagatgtacaaaaaagagctggtatcatttctgctgaaactatttcaaaaaattgaggagggaatcctgcctaactcattctacaaagccaacatcatcttgataccaaaatctcacagagatacaacaaaaaaagaaaacttcaggccaatacccttcatgaacattgatgcaaaaatcctcaacaaaatactagcaaaccaaatccagcagctcatcaaaaagcttatccgtcatgatcaagtaggcgttatctctgggctgcaaggttggttcaagggatgcaaaccaataaacatgatgagccacataaacagaactaaagccaaaaaccacatgattatttcaatagatgcagaaaagtctcaaaaaatgcaatactgcttcatgttaaaaaacccttaataaactagttattgaaggaacataaaacaataagagtcatctatgacaaacccacagccaacaccatactgactgggtaaaagctggaagcatttgctttgaaaatcagcacaagatgaggatgccctctctcaccactcctattcaccatagtattcgaagtcctggccagagaaatcgggcaacagaaagaaataaagggcatccaagtaggaagagaggaagtcaaactatccctgtgtacagattatatgattctatacctagaaaaccccatagtcttggcccaacagctccttaagctgataaacaacttcatcaaaattttaggctacaaaaccaacattaaaatgttcactagtattcctaaacaccaacaaccatcaaaccaagagccaaatcagaaagacattcccattcacaacttctcccttaaaaataaaataactaggaatacagctaaccaggaatgtgaaagatctctacaaggagaattacaaaacactgctcaaagaaatcagagatgacacaaacaaatgaaaaatcattccatgttgatgaataagaagaatcaacatcattaaaatgaccagactgtccaaagtaatttatagattcaatgctattcctatcaaactatcaatgatactcttcacagaactagaaaaaactattttaaaattcatctggaaccaaaaaaaggttccgaatagccaagacaattccaagcaaaaggaacaaagccagagacatcacactacctgacttccagctatactacaggactacagtaaccaaaaaagcatggtactggtacacagacacatagatcaacagaacataatagaggacccagaaataatgccacacttacaaccatctgatctttgagaaagctgaaaaaaagtaatggagaaaggaccctctattcaatgaatggtactgggatagctggctagccatatgcagaagattcaaactgttcccctttctcaagccatatacaaaaatcaactcaagatggattaaatacttaaatgtaaaaccccaaaaaccttggaatacaacctaggtaataccattctggacataggaatgagcaaagattttatgacaaagacaccagaagcaattgcaacaaaatcaaaaactgagaaatgagatctaattaaacttaagagcttctgcacagcaaaagaaactatcaacagagtaaaccaataaccaacagaatgggagaaaatttttgcaaactgtgcatctgacaaaggtctaatatccagcatctataaggaacttaaatctacaagtaaaaagcaaacaaccccattaaaatgtggacaaagtacatgaacacttttcaaaataatacatatttgcagccaacaagcataagaaaaaacattcagtgtcactgatcattagagaagtgcaagtcaaaaccacaatgagataccatctcacaccactcagaatgtattattaaaaagtcaaaaaataaaagatgctggcaaggttccttagaaaaggggaaacttatacactgttgatgggtgtgtaaactagttcaactattgtggaaagcagtgtggtacctcctcaaagagctgaaagcagaagtgtcatttgaccaagcaatttcattacttggtatatattcaaatgaatataaattgttctatcataaagacacatgcacatataagttattcataatagtaaagacatggagtcaacctaaatggccatcagtagtaggtagactggtaaagaaaacatagtacatgtgcaccatggagtactatgcagtcataaaaaagaatgaggtcatgtcttttgcacgaacatgtaatggactggaggtcattatccttagccaactaacacaggaacagaaaaccaaatactgcatgttctcaattacaagtgggagctaactgatgagaacatgtggacacatagaggagaataacagacgtgggagactaccaggggttggagcgggaaaggagggagaggatcaggaaaaataactgatgagtactaggtttaacacctgggtgacaaaataatttgtacaacaaacccccatgacacgagtttacctatatagcaaacctgcacatgtacccctgaacctaaaataaaagtttaaaaagtgagggagatattaagacattctaagacaagtagaagctggaagaattaattagcactaaatcttttatacatgaaataggccttgagggagtctgtagggttaaattaagggacactagataataactcaaagccataagaagacataacaatgtcactgaaggtaaatatgtccacagtcataaaaattactaccattgtaacaatggtttacaatgccacttcttgttttctacatgactaaattacataatcaaacactaaaattattagtttaaagctaggattaactttggttagtaaatccacattttattttcctcataatttataagacaaatgtgtttaaagtattattagcatatgtgtttgggctcacaatgtgtaaaattgtaatggtaaaatcaacagctcaaaggcgtgaggacagagttgttaaaagaacagaatctctatatgttattaaagttattaaagttaaacaggtataaattcaaattacagtgttaaaagtataaggtgttagatgtaatccccatggtaaccacaaataagatagctatagagtatctacaaaaataaaatttgtcacgataaaaaatcagataaacccaaaggaagttattaatgcagaaaatgagggcatatagaaaagaaaaagcaaaatgacagaaatgtcactccttatcatttattgccttaaatgtaaataatttatccaattaaaggacagagattggcagaatgaacaaaacaattgatccaaatctgtgttgtctaccagagacccactgagattcaaaggtacaaatagactgaaagtgaaagaatgaaaaaagatacgccatgcaaatacaaaccaaaagacagaaaatattattatattactgttagaaaaaagagactttaaatttgaaagtgtcacatgagacaagaagggcatcacatattgagaaaatatgttcaatacaacaagaagatataaacatctacatacacaagaacagacaatcaaaatatatgaagcaaaaatgaacagatttaaagagagaatagtcctatcataacggttgcagacttcaacacctcattctcaataatgattacaacaacaagacaaaagataaggaaggaaataaagacaacacaataaaccaactagatgtaacagacatatacagaagaacactctaccaaacaacacaacatagacattgtttttatgtgcatatgggacattttccagaataaaatacacatattttaccacaaattaagtctcaatagatttttttatagatgtcatacaaagttattttctctgactacaaaagagtgaaattagaaatcagtaacaggtgtaaaaatggaaaacttacaaaattgtgggaaataaataaccattcttagacaatacatgaatcaaaaaaacaaatcacaggggaaattggaaaatacttaaagatgaatgaaagtgaaaacacaatataccaaaaattatgggatgcagcaaaagcagtgccaaggaggaaatttatagctataaacacttatattaaaaaattagaaaaattcaaatcagcaacctaactttaagatactagaataaaaacaaactaaacccaaagatagaagaaggaaggaaataatgaagattagagcacatataacttaaatagaaaagtaatagagactagaaagattatagagaaaatcaataaaaccaaacttggttttttcaaaagatcaacaaaattgataacttttaggtagatggacaaacaaaaggggagaagactcaattactaaagttagaaataaaagtggagacatgatgaaaaattctagggaaataaaaaggattataaagagtattatgaataattgtacagtaacaatttgataacctagatgaaatgaacaaattcttacaaacacacaaaacctccaagactaaatcataaagaaatagaatatctgaatagacctgtaagtagtaaggatattgagtctgtaagcaaaatgtctcccaaaaaagaaaaaccctgggaatcaaaaaaatctccctacaaagaaaagccctgggtctgatagcttcatgagtgaattctaccaactgtttaaggaaaaactaacaccaatacttctcaaattttcctaaaattaatatggaatttcaagtgagctcaaatagccaagacaatttgaaaaaaaaaaaaaaaaaaaacaaagtggaaggactcacactttccaatttaaaacttactacaaagccatagtaatcgtaacagtgtggttttagcatctagattaatggaatagaacagagagcctagaaacaatccttcacatatacagtcaaatggtttttgagaagggtgtcaagaccattcttgagaagggaaaatggcagtcttcaacaaatgatgcttggataactggatatccacacacaaaataataaggttgaacccttacctaacaccatatgcaaaaattgactcaagtggatgaaagacctaaatataattcttaaattatacaactcaaagaaaaaaaaacttaatgaaaatgcttcatggcattgtatttgggaatgatttgttggatataacatcaaaggcacaggcacaacaacaaaaaatagacaaatttgacttcaggaatatgttttaaaattgtgtatacaaagacactatcaacagaataaaaaggaaacacacagaatgggagaaaatgtttgcaacttatatatataagggacttatatccagaaaatatagagaagtcctaaaactcaacaacaaaatcactctgattcaaaaaaaggcaaagaacttgaatagagatttacccaaagaaggtatctgaatggtccatacacacatgaaaagatgctcatggataggaagaatcaatattattaaaatggccatattgcccaaagcaattagtagattaaaatgtcattcctatcaaactaccaatgatattcttgacatgactagataaaactattttataatttctatgaagccacaaaggagctcaaatagctaaggcaatcctcagcaagaagtacaaagctggaggcatcacattacctgacttcaaactatactacggggctcccataaccaaaatggcacggtactggtacacaaacagacaaatagacaaatggaatggaatagagagcccagaaataatgtcacacacctacaactatcagatcattgacaaacctagcaaaaagaagcaatggggaatgaactctattcacttaatggtactgggatagctggctagccatatgcagaagattgaaactagaaccctactttacaccacacacaaaaatcaaatcaaaatggatcaaagacttcaatgtaaaatccaaaactataaaaatcctggaagataacctaggcaatcgcattctggacataggaccaggcaaagatttcatgaccaaagataccaaaagcaattgcaacagaaacaaaaattgacaattctagttaaactaaatagcatctacagagcaaaaggaactatcaacagagtaaacagacaacctacagaatggaagaaaatatttgcaaactatgtatctgacaaaggtctaatatccggtatctacaaggaagttaaacaaattcacaagcaaaaaccaaacaaccccattaaaaaatgggcaaaggatgtgaacagatatttttcaaaagacatacatgtgaccaactagtatatgagaatatcctcaacatcactaatcgttagaaaaatgcaaataaaaaactcagtgagatgccatctcaccccagtcagaatggctatttaatttttttctcttgtttgatacagctggagtgcagtgtcataatcacagttcacttcaaccccatcttcagcctcccagtatgctgggattagagacctgagccattgttcctggccgagaatggctattatgtaaaattcaaaaaataaaagatgctggtgaagttgcagagaaaagggaacacatatacactactagtgggagtgtaattcagccattgtgaaaagcggtgtgtcaattcctcaaataactaaaacagaattgctatttgatccagaaatcgcattattaggcatatcctcaaaagaatgtaaattttctaccataaaaacacatgtatgtgtatattcattgcagcactattcacaatagcaaagacgtgaaatcaacctcaatgcccaccaatggtcgactggataaagaaaatgtggtacatgtacaccatggaatactatgcagccatacaaaagaataagataatgtcctttgcatcaacatgtgtgaagctggaggtcattatcctaagcaaagtaatacaggagcagaaaaccaaatactgcatgttctcacttgcaagtgtgagctaaacaacaagaacacatggatactaggaggcgaacaacggacattgggacctacttgagggtggatggtaggaggagggagaggatcagaataaatacctattggatcctatgcttattacctgagtggcaaaataatctgtgcaccaaatccctgtaagacccagtttacctatattaacaaacctgcacatgtaccccagaacctaaaaaaaaattaaagatgcttagcataattaatcattagggacattcaaatcaaaactatgagataccaccttacacccaataggatagcaacactataaaaagaaaaaagtaataacaagtgttggtaagaatgtagggaaattggaaccctcgtatgctgtttatagaagtataaaacagtatagctgctgtggcaaacagtatgatgggtccttaaaaaattagaaatataatttccatatgatccagaaatttcacttctgggtacatacccaaaacgttgaaaacaaggtatcaaagagataatgtttacacccatgttcaaagtgtattatttgccacagttaaaatgtgaaagcaaccccagtgcccactgatggatggacggatggataagaaaacataatatatgcatacaatgaaatattattcaaccttaaaaagaaggaatttctttcatagctataacatggatgactttgaggagataatgttaaatgaagtaatccaatcacagaaaagacaaatgatgtataattccatttatattaggtactttgagtagtcaaaattataaagacagaaagtagaatggtggttaccagacgctggtgggaggagagaatggatagttactgtttaataggtatagaggttcacttttacaagataaaaagagttatggggatagatggtggtaaggtttgcacaacattatgaatttaataccagtgaaccatacacttaacaatgttgaatatgatccatttttgttatatgtatgaaccacctataaaaattgaaaaaaaaaagagataatttaaaaatagccacacctgaaaggtcatcacactggtccttatatgaaagagacaagagagtgaatggggagagagatgggatgacagaagttggcatgatgtgaagaaaaggccacgtgaaggggtgatgaggagttattgaagatggaccaaaggatacagacagcctctggaagctgaaaaaggcaagaaaaaagatttccctctgaaggctccagaaggtgtgtagcccagatgacaccttcactttatacactggacctccagaaatgtaacagaataaaattttgttgttttatgcttcccttcaaacctccatgaataaaatagcctcaccaaggagttgctggcctaagttaactttagaaatgaatggaatctgtaagactaggctaaagaaactgcatgttaagtactgcgctctagtcaataaatttgtttcccatagggatatggggtaacaattctgattctgatatataaatattccttaagcaaggaagcaaatgaatagctcatggtggcagccaggttttccacttctggagtgggaatttgtggattggcatggtgaggagatgagattgatccatatggtaattgtttagacttggagacaacaataagaactcatgttcaacttaatatagatatagatcgttacatgtagagatatttatggacttgtgtatatacacaggtcattatacacacatttatttctttgttttgccaactgttaagtgtctaaaagaaatggcactagagcagtaatgagtatatgcaacacccagatccagatcttgatttctattattattttccaaagaaagtaaccagtgttgcttggagaaatggctggttcaggtgcaggaaatataaaagatgagcctggagcatgttgtggttccattgggtaaggaagccctcacaaagcaacaataacagcaacagcaagaacaaaatacattgatggcagtatgtcaaaaaggcacaagaatcaactgaaagaactcctagtggacaaagattgacaatttgagcagcaaaatagtgctggattttaattctaagattaacatctgcaagtccagactgatgtgaataaaaaatcgaataaattaataagtggaggacaataatcaacgatgcaaaagaattccaaataaattatgtaaatgcttcatcctaaaggagggagagcaaaactctccactgttaagtatgagctgtgcaaagggacttccttctaaagagtaaagtatggaagtggggaggagatagtaaatttacagcagagtaacctggcacacactacttcagtcaggtgatcaaggtcaataccaacagttataaatcatgttgatagtatacaccctggatatgatgtgattaaaatagtactttacctctgtgatctacctctctaaaacccataaccctaatttacccatgagacaaatctcaatttggagacattctaaaaaatgcctgacctatactcatcaaaactttcaaagtaattgaaagcaaataaggtatgaaaaactgttacagccaagaggagcctaaggagtccagataactacatgtaatatggtatactggatgcgaccccagaacagaaaaagggcattagataaaaacaaagggaatcttaataaactatggacttcttaataaatattctcttactaaataattatgtattgatattgtttcattaattttaacaaatatactacactaatgtaatgtgttaataataaactctgtgtatgtcagaggaaagagaggtaatgtaggaattctttgtactatatgctcaattttttagtgaatctaaaacttctcttaaaaatgaagttgattcatagaaaatcaattgaacaaatgttgcttttggttaattgatgatataactaaatagttcctgttttaaccttgtggaaagcagaaattgttggcttggttatatatttgatttattactatgtgatggatggtatgtgtcaccaaaactgaacagaattttatcacatgaaaggagtaacaggaatatgcttccagaaaagaatgtattcttgacagaaattgataggggttacattttgggggcatctaatgatttaaatcttttatgacacatgtattactagaatttgtcagaacgttaatctaagtacaatcatgtgataatgtattcggtttgaaacagaataacaaaggggcatttgtcacttagcgtcagaatggattcctggacagatatgaccatattgccactcagcagtagccaagaaatttaaatgacttttcctcattttttagtcacttaaatcagacatgtatcccttactacatggcaaaccatgtgcttaagaaaaataatacttgataaaatcagaaaacaaacatcttaatatgtagctaatagcatagacagacaaggaaatatttttagagatcacctagccctggcctgtcgagtatggtagcttctagccccttgaatgtggctagcaggaattaagacatgcttgtattagggttctccagaaggatagaactaataggatatatgtatatatgaaaggaagtttattaaggagaatgggcccagacgatcacaaggtaaagtcccacaataggccatatgcaagctgaggaaaaaagaaggcaggaggggctcagtctaagtccaacagcctaaaagtacggaaactgacaatggagccttcattccacggctgaaggcccaagagtccctagcaacccactggtgtaagtgcaggagtccaaaggctgaaaaacctggagtctgatgttcaagggcaagaggaacagatgggagcatgtagcatgggagaaagatgaaagccagaagacagcaagcaagcttctcccaccttcttctgcctgctttgttctaatgggcgctggatggtgcccatccacattgagggtcttcctctccagtccactgactcaaacgttaatctcctctggcaacaccctcacagacatacccagaaacaatacttacagctatctaggcatccttcaatccaatcaaggtaacagctaacattaataatcacaattatgtgagtgtgaaatacactcatggttttgaagacttagtaccaaaagagaaagcaaaatagctcaataatttttatataatcggcatacagaaaagtttcatctccctgaacatctccctccattcccatggcaatcactggtttgttctccctcactatggttttgtctttttgagaatgtcataaacatgaaatcatgtagtttgtaacctttggagactgacttcttttactcagcatactgcccttgagttgcttcatgtatcaacgcttatcaatcttttttttttttaactgagcagtattatgtgtggatattccactgtttattcacccattgaaggacattttgttttgttttacttactgtatcttgaaactcttaacattttattttaaacataaagatatctattgaaacattattattgctcttagtttaaattcaggactaatatgtgattggtaaaaacaaaaatgaaagcaaaaaaatgtaaaagagaagaaacaaaatgtgggttcactcctctgaccctcaaatacacatgaaggcagtaagaagctcttaaccgttttctttgcctcattgcagacttgctttatttcttacattcctttttgaaaactcttttaaatatcaatcatgtactttttttattttttttttactatctggccctttatttatttttattcattttttattttattgtactttaagttctagagtacatgtgcacaatgtgcaggtttgacacataggtatacatgtgccatgttgctttgctgcacccatcaactcatcatttacattaggtagttctcctaatgctatttctcccccagccccccatacccctacaggcctcagtgtgtgatgttccccgcgctgtgtccaagtgatctcactgttcaattcccacctatgagtgagaacatgcggtgtttggttttctgtccgagcgatagtttgctgagaatgatggtttccagcttcatccatgtccctacaaaggacatgaactcatccttttttatggctgcatagtattccatggtgtatatgtgacacattttcttaatccagtctatcattgatggacatttgggttggttccaagtctttgctattgtgaatggtgccgcaataaacatatgtgtgcatgtgtctttatagcagcatgatttataatcctttgggtatatacccagtaatgggattgctgggtcaaatgataactctagttctagatccttgaggaatcaccacactgtcttccacaatggtggaactaatttacactcccaccaacagtgtaaaagcattcctatttctccacatcctctccagcacctgttgtttcctgactttttaatgattgccattctaactggcatgagatggtatctcattgtggttttgatttgcatttctctgatggccagtgatgatgagcattttttcatgtgtctgttggctgcatagatgtcttcttttgagaagtgtctgtctgttcatatcctttgtccactttttgatgtggctgttttttttcttgtaaatttgtttgagttctttgtagattctggatattagcccttcgtcaggtgggtagattgcaaaaattttctcctattctgtaggttgcctgttcactctgatgatagtttcttttgtcatgcagaagctctttagtttaattagatgccatttgtctattttggcttttgttgccattgcttttggtgttttagtcatgaaacccttgcccatgcctatgtcctgaatggtaatgcctaggttttcttctagggtttttatggttttaggtctaacatttatgtctttaatccatcttgaattaatttttgtataaggtgtaaggaagggatccagtttcagctttctacatatggctagccagctttcccagcaccatttattaaatagggaatcctttccccatttcttgtttttatcaggtttgtcaaaaatcagatggttgtagatgtatggtattatttctgaggcctctattctgttccattggtctatacatctgttttggtaccagtaccatgctgttttggttactgtagccttgtaatatactttgaagtcaggtagcatgatgcctctagctttgttctttttgcttagtattatcttggcaatgaaggctcttttttggttccatatgaactttaaagtagtttcttccaattctgtgaagaaagtcattggaagcttgatggggatggcattgaatctataaattactttgggcagtatggcaattttcacaatattgatttttcctatccatgagcatggaaagtttctccatttgttcatgtcctcttttatttcattgagcagtggtttgtagttttccttgaggaggtccttcacatcccttgtaagttggattcctaggcattttattccctttgtagcaactgtgaatgggagttcacacatgatttggctctctgtttgtcttcatggtgtaggggaatgctgtgatttttgcacattgattttgtatcctgagactttgctgaagttgcttatcagcttaaggagattttgggctgagacaatagggttttctaaacatacaatcatgtcatctgcaaacaggaacaatttgacttcctcatttcctaattgaataccctttatttctttctcttgcctgattgccctggccagaacttccaacaccatgctgaataggagtggtgagagagggcatccctgtcttatgtcggttttcaaagggaatgcttacagtttttgctcattcagtatgacattggctgtgggtttgtcataaatagctcttattattttgagatacgttccatcaatacctagtttactgagagtttttagcctgaagggctgttgaattttgatgaaggtcttttctgcatctattgagataatcatgtggtttttgtccttggttctgttcatgtgatggattaggtttattgcgtatgttgaagcagccttgcatctcagggatgaagccaacttgatcgtggtggataagctttttgatgtgctgctggattcagtttgccagtattttattgaggatttttgcattgatgttcatcagggatattggtctaaaattctcttttgttgttgtgtctctgccaggctttggtatcaggatgatgctggcctcataaaatgagttagttagggaggattccctctttttctattgattggaatagtttcagaaggaatggtaccagctcctcattgtagaattcggctgtgaatccttctggtcctggactttttttggttggtaggctattcattattgcctcaatttctgagcctgttattggtctattcagagattcaacttcttcctggtttagtcttgggagcgtgtatgcgtccaggaatttatccatttcttctagattttctagtttatttgcatagaggggtttatagtattctctgatggtagtttgtatttctgtgggatcagtggtgatatcccctttatcattttttattgcatctatttgattcttctcttttctcctttacttgtcttcctagcagtctatcaattttgttgatcttttcaaaaaaccggctcctgcattcattgattttttgaagggtttttttgcgtgtctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacatactgcattaaatgtgtcccagagattctggtatgttgtgtctttgttctcattggtttcaaagaacatctttatttttgccttcatttcgttatttacccagtagtcattcaggagcaagttgttcagtttccatgtagttgagcagttttgagtgagtttattaatcctgagtactaatttgattgcactgtggtctgagagacagtttgttgtgatttctgcttttttacatttgctgaggagtgatttacttccaattatgtggtcaatcttagaataagtgcaatgtgttgctgagaagactgtgtattcagttgatttcgggtagagagttctgtagatgtctattaggtctgcttgtttcagagctgagttcaggtcctggatatccttgttaaccttctgtcttgttgatctgtctaatattgacagtggggtgttaaagtctcccattatcattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctcctttgatctttgtgggtttaaagtctgttttatcatagaataggattgcaacccctgttttttttgctttccatttgtttggtagatcttcctccatccctttattttgagcctgtgtgtgtctttgcatgtgagatgggtctcctgcctacagcacactgatgggtcttgactctatccaatttgacagtctgtatcttttaattggggcatttagaccatttacatttaaggttaatattgttatatgtgaatttggtctggtcattatgatgctagctggtttattttgcccattaattgatgcagtttcttcatagcatcgatggtctttacaatttggcacatttttgcagtggcttgtactggttgtttctttccatgtttagtgcttcctgcgggagctcttgtaacgcaggcctggtggtgacaatatctctcagcatttgcttctctgtagaggattttatttctccttcacttatgaagcttagtttggctggatattaaattccgggttgaaaattcttttctttaagaatgttgaatattggcccccactctcttctggcttgtagggtttctgctgagagatctgctgttagtctgatgggcttccctttgtgggtaacttgacctttctctctgtctgcccttaacactttttccttcatttcaaccttggcaaatctgacaattatgtgtcttggggttgctcttcttgaggagaatatttgtggtgttctctgtatttcttgaatttgaatgttgtcctgccttgctaggttggggaagttctcctggataatatcctgaagagtgttttccaacttggttccattctccccctcactttcaggtacaccaatcaaacgtagatttggtcttttcacatagtcccatagttcttggaggctttgttcatttctttttactccttctctaaccttgtcttctcgctttatttcattaatttgatcttcaatcattgataccgtttcttccacctgattgaatcagctattgaagcttatgcatgcatcacgtagttctcatgccatggtttccagctccatcaggtcatttaaggtcttctctatgctgtttattctagctagccattcatcttatcttttttcaaggtttttagcttccttgcagtgggttcagcatccttctttagcttggagaaatttgttattaccaaccttctgcagcctacttctgtcaaatcgtcaaagtcattctatgtccagctttgttccattgctggcaaggagctgcaatcctttggagaaggggcactctgatttttagaattttcagcttttctgctccagtttctccccatctttgtggttttatctacctttggtctttgatgttggtgacctacagatggggtttggtgtagattacctttttgttgatgttgatgctatttctttgtgtttgttagttttccttctaacagtcaggtccctcagctgcaggtcagttggagtttgctggagtttcactccataccccatttgcctgggtatcaccagtggaggctgcagaacagagaatattgcagaacagcaaatattgctgcctgatccttcctctggaagcttcgtttcagaggagcagccacctatatgaggtacctgtcggcccctacttggagatatctcccagttaggctacacaggggtcagggacccacttaaggaggcagtctgtccattctcagagctcaaatgccatgctaggagaacaccgctctcttcagagctgtcagacagggacgtttaagtctgcagaaattgtctgctgccttttgttcagctatgccctgcccaccgagatggagtctagaggcagtaggccttgttgacctgtgatgggctccgcccatttggagcttccttggccactctgtttacctactcaagcctcatcaatggcgacacccctcccccagccaggctacagcctggcagagtgatctcagactgatgtgctagcagggagcaaggctccatgggcgtgcgacctgcttagccaggcatgggagagaatcaccttgtctgccggttgttaagaccttgggaaaagcacagtattttggcaggagtgtcccgtttttccacatagtctgtcacggcttccctttgctaggaaagggaaatcccccaaccccttgcgcttcccaggtgaggtgatgccccaccctgctttggctcaccctctgtgggctgcacccactgtccaaccagtcccagtgagatcaaccaggcacttcagttggaaatgcagaaatcacccgtcttctgcatcgatcacattaggagatgcagactggagctgttcctatttggccatcttggaatgcccactgctcttcatttttatgttgttattaaaatacttaaaactatgaattggcttatatttgagtcctctcacactatagttttattagacaacattggtctagtctaagttgctttttatgtaaagaaagaacctatggcccagagaacttatgatcagtgccaggtcctgtctttaagtgatctggatatttttaaacaaaaatgtttctctatttaactggggagaagagttttttcaagttatctatcactaagaaaattttcacttaggcttcatgaagttcaaatacattttacataacattttcactgttttctactcaaggaagatcttggcctactgcccttctgggttaaataaaatgagctaccatttattgagtgcttatgccatgtagaccagtgctgcaatttgtataataaatagcttacataatttattattgagtttaattctcacaaaaatcttttatagatgaagaacctgatgctcagagagcaatttgcttaagcaaccacattaatcagaatgtggtaaacatagtatttaaatggggttcttgttctaaagcttgtgttctctccactgttctcaactgcttctgaacacatgaagttatttgtgtaagctgctacagctgtcaataggaaccctgtaaggattatttagcctttcacagctgtttgggattagtaagaagttgatattccttcaattcttcatctggcagaacctagcatggtaatatttgctctaaagaaaataagaatctctcatatttttttcctctggtgcctggaatacatcagactccgctgggtttagaggatcatactgcaacagaagttaaggaggaaggagcaccgtcgagtctagataagtgctcagttttcctgctgtttagcaaacccccaattatctgaaaatttcaataacagaatttttttctgtgctctttcagaaacaagaggaaatgacatcaaagttttctaatttcagaattaaagaaattaatatactcacacacacaccctcatacccacccacgcacagagctatacaggagattcatcacccttggagctgctgctcctcctcctaagttctatattgcagctaaaatttttccttatttggattcttagtcaccgaaaagcaaacaccagaaatcatctgattcaaatgatccattttcacctcgtacatcaacactgttgctaaggtcggtgaattccaactccatgatgtttcttgcatccttcccttgttctttgtcatggcaactgccctagtcactggtcccattcctttttcctggattagtgccccatctccctcttgttcactatgttccagtcattttgtttttctttaatctcctcagaatccagagctatgccctgtgcctggaatgttctccccatgccctctttggctaagtctgactaatttttcagatctcaactcttctgcagaatcccttcctgacctgcacagatgagggaggtcttcttttaataggctctcatggtatcctgttttccttgtggcacttacaatgataacaattaattgtacaatcatatccttaatagctgtcttccctgctggaatgcccttaaatattatgctgggctgctttatactacactgtgctgcttttttctaataaacaatttcctgtattacttccattggggcatctttgaaaatttctaaaatatttataaatgcaacaagtgcttattcatttatttctaactcccattatagatggttgagaacatgagtttatagtcatgacttaacactcctcttcttagcctccctatataaggctgatcaagctgccgttacgttttatgatgttgggagagtaccttagcttgtgggtgagtcaatcttctcaactgaaaaatggggataataatagtactgaacacttcagagctttacagataaaagtaaatcaggtaatattcagatgaaagttaattcagataatatatttgagggtacaaacaaaatgtccatgaaagttggcaagtattaatttacatttcaggggtatctgtatatttatttattcattatttttattaaaaaatgttgtaaagatgggggtctcactatgttgcccaggctggtctcaaacttctggccccctacatcagcctcccaaagtgctggaattacagtcacgagccaccatgccagaccctgtatatttttcctattgaaaaagtgttcagtataacttctcagaagcaaattccaattaccaaggggaacagctctcaagtgtgagacaaatttgcatcctcctttgatctattcatacatttcatttctgtagtcattaaacatggctttttttttccactaagaaatctttaaacttattgaaaataacctcaggctgatcctagtctttcttagtaactgtacatatggcatatagagctggaaaaacacataaattagacaatagagaagcaaccaagctgtgttttatatatatacatatatatgtatatatatatatatatatatgtatatatttggtgtatccttttgtgcagaggcttattttgaagagcatgtgggagaggaagtgtttaagaaaataagaatgaagggaaagagaaaattcaacatctgtaagacgcatgtatgtgattatcataactgggcatgtctgactctaaagagtattaaaatatgctctgagaatcagcagcaaagaactggaaacactacataaatggagatggacctcacaagatacattcaagcatcctaattatacaggtacacatctttcatttgttcaaagatatattcaggacccaaactactgtattcagacctctatgcccatatttatgtctggatgtacacttaaaggaggcaaaggcacggtgcagtactttgctcagaatttccaggcaggctgattgtcctggctatgattccagtcatcataaatacatttgattctcacaaatggttccctggttgcatccagcaggtccatttgtaaggcaagtagttagcttgttctgctgctctgtgactttttgaagagttcctgcattcctgctaagcatgaacaaagcaggaagacattaatgtgctgaccacaatctcctctggccacctcagggaaactagcatcatggattaaatcatttctttgctaaatgacacctgttgaaactgacaagccaacaaagctgagatcccatgctgagcagaagaattacaagcaatggggctgcccacagcattgctgcatgacagtgggtgactgagaatcacattaacacagtagtgaattcacacacttgatttccaagcattcctcacatgctatccttcttgggtgtaaattttgcatttattcattgaaaagtattgtgattcataaaattataatttttattataatttggattctctacagactttgttactgtattgcatggtatttattaatatgtatattattaaatctaatttttttacaaaagcttttaaaacatgaatttctaataagaaaatgacaattcttctagaagtagcagtgataataataacaataataataataattgctgtattagtctgttttcacactgctgataaagatgtacttgagactgggcaatttacaaaagaaataggtgtaatggacttacagttccacgtgtctagggaagcctcacaataatggcagaaagcaaggaggagcaagtcacatcttacatgggtgacagcaggcgaaaagagagcttgtgcagggaaactcccatttttaaaaccatcagatcccataagacttattcactgtcacaagaaaagcatagcaaagacctgcccttgtgattcaatcacctcccacggggtcccttccacaacacatgggaattcatgatgagatttgggtggggacacagtcaaaccatatcaatgggtaacttttactaattgcatatttttttgacataaacttccatatcaccttatatatattggcttatttaagattgtccctgttataaatgaagctttaagtctctgttctttgaaaattggaaagctttaggtttcaccatgttatggaagaaaaattgtctctgtgaatataattcccaaataattaaaatatcaattcacatggtccaaagctgacgggttgttgttctggcaggtttcagaggaaacatcaatagtgataatggctgaactcattcatggaccactcactatatatgccaagccgagtgctaagcccttcacagatattatttacttttatcccggcaacaaatgtattagttaaaaattaatattgtttccttctgacagatgacaattgaagtttggagattaagctatttgctaaggatcaccatgctagattgtggcaaaactagatccagaactaaagtccgcctgacttaaaggctggactctacattactgtgctaactggtggtatttaaatcaattatttcctaaacattttgtttgtgtctacacttttaaaagggagagaaaacattttcccataatcttaggggtttaactatcccctcttacagtaattttgggacatcttcaaatcaaactcaacataaaggacttgtgttcaaatgatttatgaattatagtcagacctgaatctttagaatcctgtaaacaatcaaacactaaattttgggtatcttcctcactgtccatatacattatcattgaacttctgtgaaataatattttatcactctagatgttatttatcacatacaagatggctatttaaaattttacaggcactagcacactaaaaagaaacaaataataatgcaggtaggtaggtgtgtcagagctgtaattggaataaatgcaacgacaagggaaacaatagaagcaaatgtcatagtttgagcagcaaccatattgtatagttaggtctattaaacaataaccatgattttccaagagtttcacttttaattcaaatgttttgttttctccctctctctctctggaaaatgaaggcaactctacccatactcatcttggatgctagaacatccatgtgactgaggcacagatgatatatgaatgactcaaaagggcacttctgtgtcttacttttttgtatgcacttagaaaacatcttagcattagttctcttatgaaaatgaatgaaaatacctacttttcagggttttaggaggattatataggttagtacctgcaaagcatctatacactggcacataggaaacattccatcttttgatcccataaatctgctagcagtgagtccttctgtacaaagaagaaaaaataattccccattatcagtggagtactgatgacagcctcataccagcttataggagccgattacattaatttcttcccagcttctaatgatgctaaaaattaagctcaatttttatacatttaccactataccaccatggccataatttatcttccatattctgtcctctaggaaatcttttagtagcaggtaggttagaaaataactactggaaataaaacaagcatgtatcttgtttgtgttaggcagcagcctcatattctgctgagatgtcaaagacaatgcaatgtgacctaattatatactgatccattagatgagattttcaatatcttagagtgaaaatctgctagttcagaaataccagtaggaagcacacttttcctattctccacttatgtgcccaccataggaataactgatcaatacactcttctcactgagtttacacatacttctgtgccacatattacactaagtgctttgaatacaaatcatatttaatcatgcaagtaattttctttgataagtatcacccaccacttaatataaaggaataaaataaggctcacaaggctaagtaaaggacctgatgttgaagagctgtgttagagattgactggctagaacacagactgcaaagcctgtgttcttcatcggtgtattctatcccttcccattctattgaataaatactgtgttgtaatgggtagaaattattcattttataaatgaaggtaactgagggattaggaaatgaaggcttttaaaacatgattccataaatgcaggatttcatttctccctatagaattacaaaataaaagcaagtccataaacccgattagcagatacagggctgcccgtctttgggaatgttaatctctggtcacatgttgcaaatgtttaactgttctatccatcacataatctcttcttgtaaatttatcatgaaatatatttacagctctctatatgacatataaatcatagactaagagctgaatttagccaacattttgaaatcattcccaagagatgttgcggtataaaattttatattcagtttagcacactatgttaacgaacacactaaaaccgcaggacatttcaattactagaattaaacagacctcttaaagtattccaaatgtattctgcagaggcttgtcagtggaggtggagtgtatgggattatctttctatctcaactgaaatgatcccacagtaagcgtttggttacttagtaacattaaaattgcagttaagttcccttacaattagtggccttcaaataaatagttttgagaactaattacatactttggcagaatttcattctttctgttttggtagttattctggtaaatttctaaatgtagtgggcatgatcttcctctccaaatgcttttttacgttttaaagaagaaaggctagtttgtactgaaacttgatttggagatgaatagatcaagaagaaatggacgtaagttgttcaaagaataaattgaaaaagatgaaataaagatttttgtcccattacttatgacctcaaaacatctatagttaaaataattaggcagatgaacaatcatatctaagaatatttgtgtacttacgatgttaaaaacatgatagaagatgatgtattatcctcggagacacaacatcatgcagtcaaagcattcagttctttggcctagttagtcatttctactacaggtatttgcaaattttaggaaaactctgttgtgactgatgaagtgaagcctcaaatttttattgaacattctataattaaagaagttaagaaagagtatccatatgttaccatttttgacatggttagcaacaatagtagtgactatgcaccatttatcttcaggcagggtggaaagtaaactactggaaagaaaacaagctgatacttgatgtgtaagagcactttcctgctttgctcaggttccaaagacaataaatgttacctattcatatattgacacattagataggatgcccattcacttagtgtaaaaatctgctagttcagaactaccaaggggaagcatacattttctgttctctgcttttatactcatgtgtccaagagatatcaaatatttgtcatacactgtgccaggtacatgaatatgacatggtccctagtacaaagagaattgtgatctgagaaatagatgataaacatacaacatagtgaaatggaactatccataagacgtagcagcaggtgatggaggtaacactgggcatgtgttctgaatgtgaataggaatttgataggtaagagtcatttcatctcagctataattttctccaataagtcattgttgacattgctcccttgcaccacccagaatgaatttgaggtggtacctctgagctcaaagaattcttaatgcattgctttgccatgacttgatataattagctaacatcacaaatcctctgaaagcttccaaaagccaaagtgcttatagttcttacattaaccaatctactctctttagctttttgaactcatctctttcaactcatctcagccaactagactctttgctacttgcgcaatgtgtggaacatgttctacttctgagcttttgttcttgctgtgccctcaacctggagagctctttccataggtaccaacatggctccccctgccccatctttaagtcttctcacatatcatcttctcattaaggacattcctgactaccttattttaaaacatcattcccacagacacttttttgatgcccctttcctgctttatttatttttttacgttacatacctttctgtgtctattatctatcccctttcctcgctccacttaaatatgagcttcatgaagacaggggcttctgttcgttttgctaattgctggactctgggacaagaagagcttctggcacataagaggcaatctataaatgtttgtagaatgatttaaaactgaaataatgtatgtattattcagaatacacagtaagtttttataatgtttcagatgccctttgaagatggctgttaggtggaaaagactgacagtatacaagtaaataagtaaataaaatgtactaattacagattgtagttaatagaatgaacaaaacaagcagatatctttatttaaaaatatgatatatgatatgatgtgtgtgtgtgtgtgtgtgtgtgtgtgtgtgtgtgtgtgtgtcttttaaaccaggacaatcagaaaatgcccctctgaagagataagctgagatccgacatccaagcatcactcatttatagagttggtgagcagaggtcagtactattcaaagcagaggatggagtaactgttaaaaaatatccagggcaggaaagaaatgaaatttttttatatcacaaaaattaaaaaggagaggatgtggaagacagtggaatgagcaagggttattggtggaggccacaccatacaaggttgtaggagacatgataaggcatttggatttatttgaagagtttttggaaagtatcaaatgattttaattggggaaatggcatgatttcctatagattttaaagagtcttctcttttaaagatcctgtgtagtgcgtgaataggactgtgacaagaatggaactggaataataggaggctcttatagccatccaggtgagatcccatgatttgggttaagaatattaatgatggtgatgcatggatatgtttaagattgactttaaggatagatcattaggtgttggattgcatttaggaggtaaagaaaagagagagaggaaaaacaagtcttcattttctggctttggtaataaaataatatcatttattgagatagggaatgtagggaaatgaatggggaaaaagggataaaaaagggatagaaatttggtttctttctggatatgttaagtttgaaaggcttatgtgatatccaagtggagatgtcacgtaggcaggtcaatacataggctagatctatgcctgtcttcatcattatacaatgaatttcccaagggaagatattttactgtattcgtccctaggtcagcagttggcaaaatggttgttttataaatgttgccctgaaagactactctctttatatcctgctgggcttaccagctagacacactgggcactctagctttgggaggaacatctccttattcttctttgctccttagatcagaacaggccattgcatataaattgttagctccagaataacttttcaaaaatattttacttcattttgaaaatagacctgacaaaccctttggatataacacaataagctaggtggtgtatttttagaagaaacaaagcagatcaatcataatagtaatattgtaagaggaaatatgaaaaattttagactcagggatcctgagagggattggaaaacagcgggaataaagtcaaaggaagccatgggccatgtgaggtgttaaagcacatggaaaaaaatgggatggtaggaagaatttttatgaacaagcagatcatattgttatccaataattccatttaccaaaagtattgaaattatcattttatattttattccacagggtatatatttcacatgacatctcttctaattgagaacagaaacatagtccaacttggctctaaaagttgtaaggatatattactaaaaatatgttaaaatatttgagatatttagaaatgtgactatctgatggaagtagattaaaacataaatgcttcttaatttccaattctgtttaaagaaactatgctgttttcaaaattctgtcagttgctagggaaactagaaagggggctattaaattgtatatggaaagctattttccaaaatacattaagtggaagatgtgagtagttagataaaacttttcataggcaagaaaacgtgtgaaatcctaggtgaaggatgaacgcctcctcaattgacagtttgatagagattctgtgcctcctttaccatgaaccattgttattttagagggcagcaatgttctcattgtcctcttggggaatgtattcttaaggaaggtgagtaatcctggaagaaaagctaagatctttttggaccaataatgttaatatagttacaggaaagatcactaggctaaaaattaggagaatcgtgttctaaaccagacccagatatgaacttaggaaagctagttcttccctggtctccaattccagcatctggatatgagtgaaataattgttagagttccttttgcctataatcatttaatctgtgagtgacaggtgaatggcaatccacaaagtagaggataatacctttaacaagaaggaaattgtgggtgatgagatcaattgtcaaggtctggaggccaagttccatttaaataacataaaagcaaagaaaaaaaagaaaaaagaaaaaaagaaagagaagaaaactttaagtgaaaatttaagaatgaattatttcggtaaggcttatctgtaagttaatgtacctgctaatatataatgattttcatttttgttataaattgaacattttttgttcaagtacactgtatttagccatttttgatatttttaatactcagagaatttataaacattcctaaaatccttttatgaaccttatcttttagaatgatagaagtctcttgattattcccttgtggtaccatattaaaaatgcaaaggaaattttctaactcctcaaaccacacaccagtggcattccaaagcctacagaatagctagtgaatatgaagttaaccagtccaaatgacctttccttccacttattcttacggtaaattatatgctgtaccaatattaatgtacttgcagcttcctaaaattcaacaaatatttattgaacatctacaatgtacaaggcaaattttttttttctttttttgatatggagtcccactctgttgcccaggctggagggcagtggcgcaatcttagctcactgcaacctctgcctcccgggttcaagcagttttcctgcctcagtctcccaagtagctggcagctgggagattacaggcatgcaacaccacgcctggcaaatttttgtatttttaatagagatgggattttgccatgttggccaggctggccttcaattcctgacttcagatgatccaccctcctcagcctcccaaagtgctgggattacaagcatgaaccactgcacctggctcgtacaagcaacttctaagaattctcccatatcctgtatgctatttttgctctaaatccatattttcttctatctacccattaattcattcataatgtatgagtcatattatttacaaacacagaacatcacacactgcacagtgtttatcaatctctgtgtttgtttttcccatcaaactttgacttgagtaacataattctgtcttgcttgtatttgctgaataagcaaattaatttttaaaaactatgcatgaattaattttaaagatactccataacagcaactttggctggaaatatttgttctatgaaaaattttaccatgtgagtgttacaacttcagatgaagcaggaaactcttcttttttaatatatagaatagtactaggagagaaggtatgataactaatttaaaaaataaatatatgaggctcgatgtatgtgacagatagatcaactctcaggatagtaggagaggacaggatgcctagaatggaagagaaaaagcatgaagtacaaatcaggaataaggacaaggggtagggtatcttaggcaacagaggtaatggtttgaaagtaggaaatatcacgatatactgtagtttggaaaggtaaatctggagcatttaggagtaaaaatgaacacagtagaagataagtttagaaaggaaggcaacggctagcatatgatgggctgcaaatgcaatgacaaataatttgaactttatcttgcaggcaatggggagcctctggaaatttataacagttagaattaaattttagaaagatcactggcagcaatgtggaagatgaattgcaagcacaggagaggaaatggaaacagaaaatactagacaattggaatggtaagaaattacaaaagtctgcaaacagtgacagtgtgaacgcagaggaatgaacacataggaaagaagttaaaccagtagcatgaacaggatttattccttaattaaaatttagggataaagttgtaagagaagattatatctactctcattgttttcaagacttaaaccaggaggacaggaggaagtggcaatggtaagataatgcactggctgggtttgagatgcttacgaaaaatgcactggaaatgtcatataagcagctgaatatgcaggtgaatacgttaggagagaattgtgagttgaaaacatacatttaggaaaacataagatgcttgagaagagcaactttgtcttgtttactctttattctcaactccacacataaagactgaaccttcagcaaatgctgagctgctactgctaatgttgaactgatactatcacccacttccaacctcccttgattagaaaactaatagatgcaagtctcctgacacataataaggatgcaataaatggaaatttcattgataacttgataacttggacaaggacagccctttttgtttctattatatattctagaatataaaatatgaatacatgacaaatgaccaacattacaatatatactgaagtatatggggcaagtgctattaaataaaggacatttaaattattttaagatactctatcaatattttaaaagcatacaagtttgtggcataatcagtattgaaatgaaatcaattctaaatcatgtttgacttctagttagaggtttatattctttcatttaatcagtgtttaccttgtattctgtaaattcatttggttttcactgggcttttatgtcattaatttcttatttaataatttgtaacatcccattttagcttagctgaaaaaagagtaaaatggattttatggcattgatcagtgtactacctaggtcaatgtaaaagctaggtagtagaacatgttttgaaaccaaagcaagttgggagagcatgttagtcagaatatggaatcccaggaataagactcactctttaggttatttcatctcagcacccaattttattaccaacaacctagttttttaaaaaaatattgtagtggcattagaaagttgggctttacactaaaatcaatagccctgttttcttagtaggggcctgaaaatatctcatagatattattgctctagaaagagtccatttcatgcacagatgagtctgcatgtatgaatcttacctgggcaatatcagttatgaggaacttaggacatttattctattgttctaatttgggctatttataggccagaattagcatctttggtgcccaatctctaaatagaaaaaacaaaaagctaaacatatgtggtaatgtggtgaccaagaaaactactctttttatgggtttccattaacatactgtgttcaaaaagcaaaacatgtttatgacaggactcctattatttctagtatcaaagaaatgacagtaacattacaactaggggatatttctagagattggtctgataaagctccagcttacttctccattgtaaaaaaagttatcttaaagatgggaatttttctatacaactcaatcaatatttagtctgcacatattgtgtgtcccacccaacatactgaggtatttgggaaggggtatgaaaactataagacatggttctgaggtgaaatactgctttttaaattgtcttttcttaaaccaattattagtgtttttttaatgaaattataccataaccatttgtatttacatacgcttagaatatgtgcaagtattattgaaaaatatttaaaaattacaaagttttaaacatgtaagatgggccttgtggcccatgtaagatgggcatgatctatttttgatactatttagagactatttctgatactatttagagtaagacgggccttgtaatatgcatcatcatgatctatttctgatactatttagagtatagcactagccttatgtttatgatcactatgcattcttatagttacagattatacccttctgttcagactcttatctccaaattgatgatatgtattacagagcagttgccacctaactgaataactcatatcaatcctaactgaaagcacaacagcacttaaatatataatctagcccaaacttaaacctaaggtagggatttctataggaacaagaaagcatatatatgaactgtattttttcattgtttcaattaattttaacctgtggtataagctatgtgctttccagatttacacatatataaaaatttgacatataattcgagagaattaatggattttatagtgaacatctaaggactgctaggtatttctggacctcaggtttaaaaacatgggaataactcattgatggtagaaccgtagtatcaatctggcatttaagatatggtatatttttgcatattctgaggaaggttcttctttttataagacacagaaatagaaataatagtattgggaagaattttaattagatctaagaataacattcctaatgtggatataaaaattaagatgtgtttctgggattctcagtaaagcttatattttatgatatagtcattacataattttccagaactataatagtttcagaacaaacctactgggagggccaatacgggagtcaggaagcactcaagaagttaagtaagaaagaaggatctgaaagaagcagggataggttgggaaaggaaacaacagagaagactgttttttttgtttgttcgtttgtttgtttttgtagagacaggtcttgctctgtcaccgtggctaaagtgtagtggtgtgatcacagctcagtgacacttcaacctgctgggctcctgtggtcctcctgtctcagcctcctgagtagctgggactgactacaggcacacaccactatgcctggctaattttatatacagacaaggatctctttatgtttctcaggctggtcttgaattcctggcctaaagcaatctgcctgcctcagcctttagcctcgaaaattgctgggattgaaggtgagagataattaatataatggtttggaatccttaatatacctggaacatgcatgttcttaagcattcccgtccccactattctgcttcaggggaccagcatctctcacctggactagtgcaataacctcctgaatggtctacctgcctctaatgttaccccatgttcaagccactatttgcactaaattaaaatgtttctagtaatatgagttatttcactttcctctgtaacaccattctgtggacactttttgttcttatcaatctgaattatttaccatggcttaaaattccctggcagatctgtgagagtgtagtcagcctgaaaaattgggttacagtcagaccacatactttgaataaattatgtgtttttattttttaaaaaaatattctgttagacatttagaggatgaatcaaggtggaaatactagaggcaaaatgatcagttagaaatctattccagttgacatgttaggaacataaagtaaggtgagtccatgggcatggatgtgaggagcatcatggaggtaagtttaatggaacttgaaaataaagtatatgtatttgatattaaatagcttcaaacctgagcaataaagaagatgatgatgaacgagtgttaaggtgaagcatcatatcctgttactggagggttattatggttactttgtctgcttggataaagaattaggccaaatagtacatttcataataaatcttcctcctagatgggctacacatagcatccaatgttcttcatgagaccagttagtgcaaaaaaatagctaagatagctatggctgtaaagcccagagatctctgatatggtgtgattaccatccttcacgatctattacataagaaagaatttccactgtgtgcctccaatgaaagaccaaaatgcaataagtagaacttacagaaatttcagataagaacaaacaagaatattttaacaatcagagctagaacatgtagaaaaatggtagaattcccattatatgaacatgagactatattgagagggattgagatctccacatgtagaagttctacaaatattagggcatatggaactgaaagggcctttaattcacaagcgagaaagcagtatcccagagaggggcaggcaacttggccaaagttgtacagctggttacagattctgatccagtttcagattcacagcccagtgacctccatgctacataatagtggctacccaaggccaaggagccagtgttgtgactacctcaaagacatcataaaggaaaggcttgaagtggactatgcagttggaagagaagggaaaataagttgaccatgaacaaagatactctactaggatggatcatatactagggaagggcaaatataatagtgaaaggattgctttccatttgaaggtatctgtgaagccattagaaataactaattactgttaataataacaataatacctacaatattgaacagattttttaatgcaagcttctgtgatgagtgttcaagatatcatgacaaccctatcaatgagatattattagcactctccattttacatatgcataaatgaaggcttaaagaggctgtataatttgccaaaaatcatttctgtagtaagcagctgaactgagtcccagaattcagcctatgttcataaccattttgccatattgctaatgtgggtatcatagtggatcccttagcctgagaaaacaacgagtttaatagttgcatatgtccctattgtgtaggagagccctggagagacattttagaagctttcttgataaaaaaagaaaaacaattagctaatcatctggattgttacttatttaatgaaacgtattagtaatttgaaatagactacaatgaattactcagagaaaatgggttcaactaattggttcagaaaagtcttctgaaggatataattaaattgcctagtgtactattactgctagcataaacactattactgatcttcaggaccacttgcatttccaacgtaatttaaaataagtagtgggagagacaagatccatggacacaatgtgtttcaaggaatcagccatgtggttagctaatgaaagcaaagcaaggtcagtatttgaactgtttccagcaattagcattctgttatatttttgttcctatgaatcatcaatttcaaataactcttaaacacctttttaatagaaaatactatcttatttaataccatacttctgggtcctagtatgctgtttggaataaaagatccttaataatgtatgctgaataagtgaattaaatttttataaaaagtgtcttttcttttaaattttacaaaagacataatttaaaatatacatatgacactcaccacatgacttattgaagattagatcagaacataatatttgacttcaattctgtatggttacttctgtgaagatttatgataaaaaagccaggaacaaatggtaaggaatgcaattattttttaagtgccatgatattttcatgactgattttcattaagcatgggaagtcatatctgccatggatcctgcattatatatgtcttataaataggctaaaatgatttgaacttcataaactgataaaaatgctcttgagatcttaggatcttaggatctttacataattctttgtcacaagttgacttctgtgaagatcatgaagcaatattgttctctagggaagatgtggaaagaaacaggtgcctgtatttctttttgtgattacctagatgaaaggaaagtacacacacacacacgtgtgtgtgtgtgtgtgtgtgtgtgtgtgtgtgtgtgtgtgtacagaaacaagcatagttttattacactcttagaacctggataatttcttagtacagagtggacaaacaggaaatgtttgctgttgaattaatgtatacaaaattagtttcagagactgtacaaacattgatatcatctctgcaaaatctaggtgttcaacatgagaagactggattcttttacttgttgttgttgtttgttttgttttttgtttttgtttttttagagacagagtcttgctctgtcacccaggctggagtgcagtggtgcaatctcggctcactgcaacctccgcctcctgggttcaagagattctcctgactcagcctcccaagtagctgggtttacaggcatgcaccaccacgctccgctaatttttagtagagacggagtttcaccatgttgatcaggctggtcttgaactcctgacctcctgatccatccgcctcggcctcccaaagtgctgggattataggcgtaagccactgtgcccagcccaagattgggtttttaattataaacccacttaaaaaaatcctgagaaaatgccagatataataagcatatcttaaatgacctaagcaatagcacaaataatcttactattaaattattctaatttgcttgagatgatactaagacactgtaagcagcagaaactagaatttagtaagtccagcatcactaattttacaatgctaataatctcttctttcttttgctttttaaaataggttctaaatttgttggattctcttacctgtcacaatataggatcctattttggtataagataattaagatgggtttttgattatttctatctagattttgaatatattatttactgcatccctttaaacattttcatgaattgctgttgttaaaaaaaaaaagcattatggatcttgatctcttcctctctctctcttgcctcacctccctttatatttagttggggagctaagaataaacatagaaaataataactcttaatatgtcatgagtatcatgacacatggtaaaataccatgctgatttttccttccatgcatattataatgtttccttcatcccatgcttctctctcactgactggaatctcatgctctcctgtctgctctttctcctttctcttagcaaatagcaaactcctcttttttccttaagtcccaggtcaagtatcaatttctaatggaaattatctttctgagactacatgttctcttttacctaatcagtgttgagtgatatttagctttgatttcaatcaatgttatcattggatatgacaatatcgttcaattttttttctcccatcctcttcatttgtctgaaaaatgccttgagggcaggcactatgtccaattaatctttcatctatcagtcccaaaacttttattaaatatttgctatgtgtaaagcactgtatttgttgctggaaattcttgaccctaagttcagtatattacacagaaaacacttttgtagaatgaataaatgggactttataatacatcaaggaaattctacaaggcttattttaagaaaaggtcttaaatgaaaagctggtgaatgtggggcagcgatcaaggcaggacaaagagcaaccatcttcatctcacatcattaagtttaaaagttatgtattttccccaggtttaacgatattggtctggaaaataaagagaaaataaatatgtatgtttttggaaagcctgtggtgttgtaaaagttatttatcacggtcataattgttgttttgtggataggagcatttgagagaaagctgggattgaaatccctgacactgagtcaaagtcatgagtgtttctctactctttgctacctaatgaaaacaccaaaaaaaaaaaaaaaaaaaaaacaacaacaacaacaaaaaaaaactgcaacagtggagcttattttatatgacaatccagggaagactcaaaaggagtaaagcatgaaaccttggcacctgttctaagctagatctagatgtatgttaaattaaaaaggtataaagaaaaaataaaagcttttgttttcataaataaatctctgtttagtatccaaagttagtaaagatgtgaaaaacagaaactcttgtgcccttttgaagggaaattttataatacgcataaagagttctaaaaagtacatggccttcaacttaaaaagtatttggcacttttagaaatttctcttaaaagctactaagaaaatgttcacatatttttatatgagaattttcattgaattgctgcttataattatgaaaattagatttgcattaattttctaaataacttacagcagaaccttaaaaaagattaaacacattaaaaatgaagatttaaagctaaccgtttaacatagcaatttatcaacaatagttaagttagggactataaaacagtatatacagtattaatatcattttttgtaactatctatatatgtatacttcaagagaattaggcacattattatacatgtgatgcattttgatataggtatgtgagtgcatggaaatttttgaagcatatgaacaaattatgttttattatgagtgcagtggagttatatataatatggataagtagacaatgaaataaataatacaaagaagtagaaactcatacagcaaagatatcccaaacttaaaataacacactcatcatctttaatggaaactagatatgctttcagcctaagtttaaatatggatatatatggcccccagtctcgagtttccctagagcaacattagctattttgtgtatccatggtcacagcagttctacgataataaaagtcagaagatttctcctttttcttatccttcacctacagaaatgaaaatggcattcatagtttagaaagttcttagctcaaactaaatactggataatgcagtaaagcacatatcaataatcccaattgaaacagtctgggctttgatcccagacttcctggcaaacaacagactctgtgggccaataggcaatggaaatgagaatcaacctcccagtgaaaagagaaaccaacatcatgaatgaggtcctaacttgaaagaaaaatctaagaagcaatttctgaaacagccccacagggagtttatgcacatttgtgagaaaagtaaaaaataaataaataaataaacaaacaaaacctcggggctggcagggaatttacctatcatttagcttgattctttcatttcacagatgaagaaattgaggcttaaaaggagggcaaattgccaaagttgctctaaaaattagttctataaagtcaaatctcctgattcctaacctactgcagttcttatgtaggactctccagccaaaacagtactgtttttgtgtgctatgcaattttcttgacaaagagagattgtcatagcaattccttttctgacaatcacaggcagagttatgtagttctttcatggttctacagtacttaaaaaaaaaaccttctagattacttgcaaaacaatatcaaaatttttgcttatctatttccagtagtaaattttgtgttcctgaaggacaagaatcatattgtgtttaccttaaatccttagtgccaattgcattgcacaaaatatagcaggtactcagcaaatatttcataaatgaatgattgttttattctgttcattagattcactagtgaggagaggcactcctaatggactagccaagggacattatgatatgatggaaacagcaagttctcataggtgacacctggatttaagtccctcctctatcagttcctaatggcaatgacaccttcaattgccctgagcaacacattccttatgcataagttgggagaaatcatacctgctaggctactttccagtgtggccatgaggatcaattgtgataaatgtgaaaataacagcaattttattaatagcaaattattacgtgaatggaaggaatatgtgtggggggcttttaaacagggtctagctttttcagggcataccattcaaacacaatgcccattatagtaaaataaaatatataggattgtttctactgataaatgctatatgcttcaggtatgttttatagaaatccaaagtcattggctatattgtactggggtaatgacagcccagaggcataccattaagcctttgacttttgagtgatgcatccacagatttagggattccataaacttgtagagattttaagttccaaaattttctcctaaaatgtataaataattgctggtagggaataagaaaagtacattgccatgtagatactgagaagctggccaaaggatttgttcctatatgtctccagatgtgagatttttatttgtgtctcactgaagctataaattactgttaagttggtgcaaaagtaattgcagttttgccattaaaagtaatgtaattactttttgagaggcaccctcaaaggtaatttgcaccagcctaacatggttcatgcttctgggtttcttctagtataggagacattgtaaatgttaaattccatattgccagcagtctgctagaactgcacagaacaatttagttatttgagacaaatatatctacttgtaaataatcatccatgcaagggttattagcatcaaattaaggaacaactgaatcttaacaaaacccacaaacataaattgtatgagttaaaagagtgtattaagaggacaatgtgggaggcataggtgagagtgaggcataggtgagaaacccacatgctagaataacttgacttctttcacagagatagtaagtatagtcaaatgaaaggcacatttgcttcaaaggcacacatttctccaattaagtttgaatttcaattctagtcctgctatttactagttatacattaacaaattttataacctctatgaggagaaaagctcctcatggtgtcaggagccagagaatttagtatgctgagcagaggttaacccttttctggttacacccatgtggatgatgcaataagggtcaggaatattcctaagctgcaggaaaccccttctctgcaccaagcagaaacaagcgtgggggagggaaatgtggagaaatgctttagaatatctcttttaagtttcaggaagcgaggttctatttttcctgggtttctttgattttatgcttgctttcaaatcttgcagtgacagtgatgagagctcatggatcaacattaaagagtagggtcataaagacaaagaactaagaaaaacacttcttctggtgtaggctttaagactctgagatccagctcagctcacaaaaatcagaagttctacatagcaaagacatagaatcaacctaagtatccatcaacagataattgaataaagaaaatgtatatatactatttatagtgtatacatagtattctgccattgaaagaataaaatcatgtcttttgcagaaacatgaatgaaactagaggtcattataataaatgaaacaactcagaaacagaaagtcaatagatgcagaaaaggcgtttgacaaaattcaacaaccttcatgctaaaaactctcaataaattaggtattgatgggacatatcccaaaataataagagctatctatgacaaactcacagccaatatcatactgaatgggcaaaaattggaagcattccctttgaaaactggcacaagacaaggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccatcatctcagcccaaaatctccttaagctgataagcaacttcagcaaattctcaggatacaaaatcaatatacaaaaatcacaagcattcttatacaccaataacagacaaacagagagccaaatcatgagtgaactctcattcacaattgcttcaaagagaataaactacctaggaatccaacttacaagggacatgaaggaactcttcaagaagaactacaaagcactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcacgctacctgacttcaaagtatactacaaggctacagtaaccaaaacagcatggtactggtaccaaaacagagatatagatcaatggaacagaacagagccctcagaaataacaccgcatatctacaactatctgatctttgacaaacttgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttggacctaaaaccataacaacctagaagaaaacctaggtattaccattcaggacataggcatgggcaaggacttcatgtctaaaacaccaaaaacaatggcaacagaagccaaaattgacaaatgggatctaattaaactaaagagcttctacacagcaaaagaaactaccatcagagtgaacaggcaacctacaaaatgggagaaaattttcgcaacctactcatctgacaaagggctaatatccagaagctacaatgaactcaaacaaatttacaagaaaaaaacaaacaaccccatcgaaaagtgggcgaaggacatgaacagatacttctcaaaagaagacatttatgcagccaaaaaccacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttagtgggactataaactagttcaacccttgtggaagtcagtgtggcgattcctcggggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattctcactcataggttggaattgaacaatgagaacacatggacacaggaaggggaacatcacactctggggactgttgtggggtggcgggagcggggagggatagctttagtagttatacctaatgctaaatgacgagttaatgggtgcagcacaccagcatggcacatgtatacatatgtaactagcctgcacattgtgcacatgtaccctaaaacttaaagtataataataataaaataaaataaaaaaacaaaaacaaacaaacaaaacaaatactgcaggttctcacttgtaagtgggagctaaatggcatgtacacatggacatacagtggggaataatagatattggagattcagaaacataggagggtggcagaggatgagggatgagaaattacttaatgggtacaatgtaccttattaggtgatagttacactaaaagcccagacttcactacacaatatatccatgtaaaaatgcacttatatcctttaaattgaacaaattaaaaaactaaagaaagagaagtcttatgccaaaagcttgattgtaataaattcagtgatttttgtacagactatttcctgtaaatgcatgtgttggagggattgttgcaaccctagcaggcagtttgttaaagacctggagccagagtttctgttgtatcaactttcacatgcatcaactcatgagtgctgatatttctccatatacttattttaatttattttatttatttatttattttgagacagagtctcactctgttgccaggctggagtgcagtggcgtaatctcggctcactgcaacctccgcctcccggattcaagtgattctcctgcctcagcctcctgtgtagctgagattacaggcatgcgccaccacgcccggctaatttttgtatttttagtagagatggagtttcaccatgttggccaggatggtctcaatctcttgaccttgtgatccacccgccttggcctcccaaactgctgggattacaggtgtgagccaccacgcacggcccgtatacttattaaaaacagaaaatattgatttttaatatgttaaatgttggtttccaaaaaatagagcagtttaaccatcttcatagctttactaatacaaagcaaaaagaaatttcaatgcaaatggaacggtattgatttgactatgaatcttcactcttctaatcaagcattcttttaaaaattctaaagacttagagagtatgtcttatggttaatgttttgtcttctccttccttttgttctcagtgattagcacataatatatactcaataatgttttctcagtaagggaacccatcaatctcatgaataaatatatctctctgacgtttttcccctaattgacaattacctgaacttttgggtgtaggaatcttccctttatttttttccttgacactgacatattaaatttctgatcaaggcttctatttctataactagctttgatactctgccccagatctctagggtcagactcttccagaggcagctgtcaagtgctgccaatagcactggaaaggaagataataattcaaatcccaattctgcatctactagtggcatggcattgaacaatttgcttcatccctttggacctcagttttctcatctgcacaatgtaaagaaaaaactttgtggttcttaactagaagtgctcaccaaaatcatctatggacctctattaaacatacacaagccaagattcatacaaagagattctgattcagtaggtccacagggaggaggagagcaagaaaatgtctgtttttctaaaatgatccataaatttcacagtctgtagtttcagaaattccaggaattctcaatcatttatttgcaagaatttattaaagatatggtgtgttctttttattttaaatcctctggaagaaatacactagatgtttcaacattgacttaattcattttaattattccattaatcatcaattttaatggtcaatttaattattaacaaatgagttcgaattcctttggtttctgcctatagttaatcaagttctagaggcaagaaagtaatatagaatattttaggcagttgatctcaactgtgaaaataactagctttcaagaattgactaatgctagagaggatagctctgtggctgacaatactgaggttactttacatggggctagatttatacctaattatggagtagatcaagctcatctctggtgctttttattcccttcaacaccctcatcctgggaatcatgtgggcatacagtattttaggattttttttggtatcctgtgaaactttccccatctttttatacttgtattctttcaatgtgttaaggttctaatacactaattgatccccagatagtattgttacctctccacatcttcatttctttacccctaaactgtaagatattgcttaaattttaaaagagaacttcaagacaatgattatcttcttttaagacttgattcaaatattgcttcttctgtgaagtcttccctaacttgcccaggcaaaacaaggttttactttccctaggctgtatttgcattttattttatgttgtacaaattatctgttgacatggatttctcactggactctacatctcttaatggtaaaggcattgcctttttacctctatatctgcattttctgccataaaccttgacatagacagttttaaaaaatgcttattgaacacatgaatgggtggaaaatgtcagaatttcaaaaaatgtttaaaagctgtcttaaaccttcaggcaaccttagaaaggggatctttggaatcctctcaaatgaagcatattactgaatttgtaccctacctacaaacctatactagactcaactctgtccctagcctgtaatgtccattcaataaaatcttgtcactttattttattttagaaagcttatcctatctacaataggagtgttattttaaaatctgaagagaaaagaaaaagagaaactggttaggagacttttgctcaaatgggaagcaattaagattgaaactagattggtgtcagtgggagaataagaaaaggacccacttggtaagcacttactgctgggccctgtgagtcgagcaattgatggtatgccatctttttgagaaaccttctaactacaagttatcattggtaatcagtctgttaagcaagtctgtcaccaaaagagagatctgatattcaaattgcatttagtgtttcaaaaaacagagtgcaggcagattttcttcatataaactacttttttttaggcatctgaaattaatgaattgcaaaattcaaataacatgttttatacaatttgaataaaaatgtgctaagagaaactgagttatacgtattagtcaattaacaagctgcttctcatttgccatgtagtttttataacactttagaacatttctttctcagtatttgttatcatttatagaataattttaatccccaaaataggcatattagacattttatagcatatgttttcatagaatattcatttataaatttctagatactggttaatctataatagggtgtttactgattactatataatatctactattcaataattgtgtatgtgatggtatatatattacatactggcaattatttatagaagagacattttacatagtatatatatggaatgcacagacatgtgtatttaagccttgttacttgctatctcatatttgaattttccactagaatataagttttgaaatgactttattttctaatctctaatagcaagatataagaaaatctggctgtccttagatactgtatatatgtactttacagccatagaattttagttgcagcatgcagggtatgtatttaccatgtaaactgtatagttaaaataatttacagatggtcagataaataaatagaaagaatattaaacaatgtgtttgcatttagattatcatttttaatgtttccactatacaggaacagataagcagagaatggcatggatctttatagttaaatagcatggatttgtgaaaaaccactttagtgaagtgaaaaagtatatttccacagacattattaagaggtgagaatttctcaaagccacattgtaacatagtgaccataacatatgacacttctcagtgtcatcatgttatattggaatgtaaaatattattgcaagaaagataataaaaatggcatcaaaattagctaccttaacagcttctctttttcaatctcttagtcttcctagatgaactcctggcttggcagaaatctctgaattctgctcgttccatgttcatgaatactaataatgtacctcgaaatatgatcccttaacatgaattaattctgcttcccaggatatatttttatttttcacatttcacaaagatttatgagaaataattgtttggcatttatcggcatccatgttccactaattaacatccttgtatatccatggggaagaatagacagaatctaacaatccacttcctttatcttttaacaacgtgtttgtttctgtttggagactgttaattagtttaaccttagactctttaaaagcattttatttcttttttaattcacaagttactgagaaaaagcatagagcaactgattcaaattaagaacaaagcattatctcatatatttcttataagggaggaattaattgaaaaataatctcatcgtggagagagggaaatatccagctggaggagaggaggtgataagtcactgtattttcttatgtttcatcagacttctttcccctctaaggggcaagttagaggcttattctaataagctcttaactgtagccagtttattcaagtttaagctctcagcttcatcatatattggcttttcaatcttaagcaagccaattaggatggtggcagaggagtgtagaggttatatagattcatttggtcatttgtttcctttggtcagccaggcactttgctttatgtagttcatctcatttaatctttgtaaagattattatttttactgttcatcaaagtaggcatgattaactttgctatattctagaaaatggaaacccagtgatattaaacaaccaagttaatgactggtaaagataataaacatacacttgggcaatttggggaaagaaataaaataatatatgtactttgaaaacaaggcagcattaaagacatgtaagatatgacatcatatagggacattcaatcaagatgaactgagaccaggtataatgcagttaatatgtcaaaaaaaaaaagttgaggagattcttcaggaatatggttgccagatttagcaaataaaaatatcaaatatctgttaaatttgaattttagaaaactagttaatttagcataaatatatcccatgcaatcttagggatagctgatactaaacaaatgtgtttcttaaacctgatatttgaatttaattgtgtgtcttgtattttatctaactgccctactcagggactttcctttataagaaataaaggctagagaggcctctactactgaggacaggaactgggaaagctgttacagtaggacctctgtgctttgattatgcatctaatatgatgactttcattattggagattaggccccaagtatgagaaagactgaagagtaaaatggtttggaaaaactgcagcctagattagcaagtttgagataatggaagggtgctatgtatggcagtaacactgagatccataaaagccagtaataattaggtttggatagctgagtaaagctttggttaaaaaaacttgggctggctcttgaaaaatgagtatatgaagaggaataaaagaggattagtctctggtggcattagtaaaaataaaacatgggaatgagtccttttcaaatatcaattctgtacaaacatctgtagctacacaaatattacatgaagaaacagctgagaaaaaagtaaatgctcatatataagattagcaaggtatggtggggcccagcaagacagggattaaattaggaagagagtagatactgaagatcggtcagggagctgttagagtaagcatcctgaagaaggcataaacaggcagaatgaatcctgttcgttgctcctacaaacatgcagcataggaggaagggaaacagcttttactgagaagctgtatttgtgtcagtcattgatattttatcatattaaatattcaaagttaaattaattgtgaagtataaatatgtatgtcagtatgaagatgaccaatgccaaccaggatcattgaataaaaaagagttttgtttaatctatttattgccatctatgtccaaagaggaagtcaatattggcagatagtctccttgtgctcaaagagttcaaaaaactatgtcacaacttaagagaaacagaactggaattaggaaatctggttgtgctattaacaagttaacagagtttattcatctgtaaaacgggaacaagactatctcagagaaaaagtataaagattctattagataagttttgggcaaagattatctcagctctaatattctaagttccctcctatggaaaagccattattctagaaacacctttttttgttttttttccattctcaagatgctatgccttaacaacactggggggtggatcacttagaaggacaacaattcaagtattcaaatacgtgtttccagcaggacagagactaagctggtgcctttgaggacaaataacagaagattttttttggaaaacattctgaacacattttgatagactttgtgacagtttggagaaaaaagatacagagcattaaaagcgggatatgaaatctaaaatataaggaaacaaggactttgggaatctgaaccaggaaacagaaactcagtttgaatattttataacaaagacctgttgtagaatccacagtattctctactattctgtgctgtagaaaaattatgaccctgggttcttttagatacagaaagaagaaaatattccagcaggtctctcttagaagtagagaagaacatttgctttttggtctgatatcagccttagagcatttttgcagattgggctcactctgtagaatgaaagtagaatgaattctcaaaattagggagaacggtctctataatttaatacctataggacaaactatatgtatgacaagatgagaagtaatgatacaaaattatgtactgttttatgtattaagtgagatatcttacataaagcataccacaggcacacaatatatggtgatttccttccctctccaatcacaccctgccccttccagatccaatgcatatcctcttccaggggtaccatgcgccaacttacccagagctcagtggtacaaatttacagcacctatcagtgataacagccagaaatgacatactcttcccaaaaaaggcttttctctgcagcgtagagggtagaattaggtcagttatgtaagactcatattaaacgagtacactttgggccactttggtgatattgttaatgtttctgccttcaagtggttacaaaaggaaggtgaagttaatttcccttgcttcggaagttctgttttataagtctgaagggtacaatattgaaatgataacctacattcaatattaaccatttgctgccaaagtaaatactatatttcgataatttcataaatatccaagagaaattgtcccaatattcacatatattgaagttagctcatcaggaaaagtcattttagtgatgaggctctgaagaggcccccaaaaattgagataattatagtgatacgtcaactgcaaaaaccatatttgtgagagatgctcagttatgtctgaataagaatcttagaattatagaatgttccaactggagaggatcttgtctaacacatttatcatagagataaagcaattaagacctggaaatgttaaattatttgcttaggattgcccaagaaatggaagagatggttctgaaccaggtcttttgacttaatttttttctaatgcatttgttatagagataaagcaactaagacaaggagatgttatttgttctgcattgttcagtaagtggaagagacaaaaatatttttcaatcaacaaactcttactgttgatgttaatatggctgacactgcctctctgccttaaagtgtattacaataaaatgcaaagacacctatgaaaacctttcatcataaaagacgaaatttcatttttttcccaaaacccaggttttaacacagaaaactttgagctccaagaattaaaatactctttttgaagctagaatactaaacatccaattttgcatgtagggaaatagaaacaaatattttaaatgttttgaacatagttttcacagctagaaaattacttaaaaaaaggcctctcaatctctgtctatgcttgtttcattcatattttatagcttttctcacctgaattctggtaaatccttatctttctgtcttacctccctatcactcatcctgaatttcatatatttatatttgatttttgttttaactccggggaagattagtatttatctcattttaatattttctctttgtgcatttcagtacattgctttagtattctaatgtcctccaaaatttagatttcttgcaaaagaaactgctgattcttaccaggtttgtatcacaaataaatcttttaaataccgtcttttagtcttccaacaagttgctgacattttattcatgtttgtatccctgtgacttgcaggtagggggtactaaatgctgtctgctaagtgcatgaatgattaatggaacagcacaaaggggagcaccccaggctggggattttttagttctctcactaggtttgccaagatgtttcaatcagtattccttgagtaccacttcagagtcagcctgagtgtgacttattctaccaccatctactttacttcaattttctataactcatttaaaaaaagaatgccaatgaaaattctgtcatatgcttgaaacattttggggctcatgttagtggaatgacttctagttttcccagcttcttccagtgcaagttttctaaacatatctcaaaaagccccagttttatatcacaacagtttcatgagaaagtgaaacagtttcatgagaaagtgaaacagactatgaaccttttgtactgatccatagtatctctagaaattaagcaaagtagatacacagatgagtatgcatatatttttacatataacatataaagattcatataaaatgttgaatcatctggagaatttcaggcttgggtaggaatatacaatactgaataaagtggctcataacgttttataaaagaaatattatctttttatttcatctcatttgactccacctatatatcctaaaaatttttacaataatactttccctgattaaccattaattcaaaagataaaaaaaaacaagacttagccttctaaattccagttgcttattggatgtaatagtacttttaattactaaatgattccaaaattaatactattggactctgacttctgaccataatgttttaacagaaatcagatataccatcctatgtgaaacaattaaaaaactggacaagatatacaaaacaatagttttcaagaaatacaatattgaacaatgtaggagagtaatccctgagaaatgagaaacaaacaagatgaaccctacaattgccctagcccatagccacaagggaatttccaggccattgcaacaggagtctgaggacacaaaggcttctaacatctacaagatagaggactagagaagaggactctgacaatccacagagggccttttttgggtatttagcaaataatttatcagtacctgaatgtgagttagccattacagcctgcaaaacatacagtctgaaagtattgaatcgaacagtactcaggatacacagaagacctggaatagtgcctgtacccataaatctaagtaggaagtcttataattcacagacacagtagaatactcagaagactattgcctctgcagtggagaatatttctatatatatactaaacacagctgtagtcctacctaacaaattataaaatagtagcagtaaagaacaagctgcttccaactaactgaactgcatcccagaacaaaattgaagagatttataaagataaaaagaatacaacaatcacaaaagtaaaatttacaatatctgaattgcaatttaaacaagctatcaggcatacagaatagtgggaaaaaaacaaccaataatgaaaaaaaataacaagtaattgaaactttcccagaattgaaataaacattaccatggatcaaagtgtcaattcattaagtagtagaataatcctaatcatgtaagcacctaataataggtctgtaaaatacataaagcaaaaatgaatgaaactgtaaaaataaaaagaattcacaagcacagtcataatttaaatgtccctctctcaataacttgacaaaacaagtcaactgaaaaataagaatatagtagacttgaacaacccatcactcaacaagggctaactgaaatttatagaatattccaccaaacaatggcagcatatacattattttcaaggacacacaaaacacttaccaatatggaccatattctaagccataaatcaagctttaataaatttaaaacaattcaagtcatacaaagtatacttttgaccacaatagaattaaattatatatcagtaccagaaggatatctgaaaaatcttcaatatttgggaactaaataaaacatttataataactcatgtgtcaaggacaaaaatcaaaatgaaaatcagaagatattttgaagtatatacaaataaaacacaacatattaaaatttgtgagttatcaatttagggcattatatgctatattagaaaagaaagaaggttcttaattgagtttgtgttgctataacagaataccagagactgggtagtttataaagcaaaaagcttaatttggcccataattttgatgtatagaaggttcaagattggtcatctgcatctggtcagagtctcaggctgatttcacttattgtggaaaataacagaagggaagcttgtatgtgcagagatcacaaggtgatagaggaaacaaagaaagaggcgaggtgttagcctctttttaacaaccactgcttgtgggaactaacagagtgagaactcactcatctctgacagtgggcattaatctattcatgaggaatcggttcccatacccacatacctgtcattaggccccacctccaacattgaaatcaaatttcaacattaaatgtttgggggacaagcatgcaaaccagagaaaaacgtcacaaatcagaggcttcagcccctgccttaagaaattggaaacagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcgatggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaagaaattggaaacaggctgggtgcagtggctcatgcctgtaatcccagcactctgggaggcctaggcaggtggatcatgagattaggaatttgagaccagcctggccaacatagtgaagccccatctctactaaaaatacaaaaattagccagacatggtggcacgtgcctgtagtcccagctactcaggaggctaaggcaggagaattacttgaacctgggaggcagaggttgtggtgagccgagatcatgccactgcactccagcgtgggcaacagagcaagactccatctcaaaaaaaaaaaaaaaagaaaagaaaagaaaaagaaattggaaacagaacaaatgaagataaaaataagcagaaaatagcaaataaaaatcaaagcaaaaaatcaatgaaagagaacacagaaaaacaatttaaaaaatcagtgaatcaaaaaagctagttatttgagaaaaatcaataaaactgataaatctctatccagattggtccaaaaaaaaaaaaaaaggaaagaaaaggcacgaataaccaatatgagtttttagagaagttatattgctacaaattatataatattaaatggatcataaaaaaacagtgtaaacaattttatgcccacaattttgacaatttaaataaaatagaaaagttccttcataattaattctggaagaaacagataactctaacagatctatctatctgtctgtcggtctgtctatctatctacataaatttgaaaaatcaatgtgtacctttttaccaaacaaatgaacaagcaaaaaacttcaaattttattgttgagtttattttaataatttgagattggtttattaaatacataattaaactaaagaaccaaaatatcactccatgaagagaacaaaatttggctcatatagttgattagtggtaaaatatcttcaaattggtttggaattttttagtagaaacacatatggatattttacacaaataattttggatacgtttgcttattttgccactgtttacacgtaaacagtacataaaatgctcttttgatttaggaaattctaatattagataccacagaatttaaatttctctttttttttctattgattatttttccaccagacttctttgtttgaacttgtggacctatccaattttcagctgtacttgatacaattcccaaaccctgaaaaattattttccagtttcatgtcatcatgtgatatcaactcaaaaagtgttaatatttaaccatacttaaatttttgcattgatttctaatttctttgactaatgtttataaaaataccatcaactagtgtaaggtatttttattacctaccaaccaatcaacatacaaaaattcaaaatcactctgaatgtgttagaaaacaaactgaatgctccttgagggaaatataataacactgagttatttattaaattattggatgctaacattgtggtagccaggtactaagtcctttaaatatcttttctgtttcctacaaaaatgtgagattaatttataataatcattatgcataagaaaaatgaggtttaaataaattaagtaacttggctgagatctcatgctgataatccacagtgttaagaactgaacgagctctgttaaactttgaagtctatatttttagccaacatgttacactgcttccctaagtctgtttctttcatttctatagtcattgtaacttagaagcagtaagtactcacagaatgcttattacatgctgagaaagttgattgctaacattttcattacttaaactaatctaaacctcagttcctttttggtatgaaaagatagtttataaaatataaacataaaaaactataaatctacctctattataaaaaaagaaaaaataaaaatgaatgaactggctaaaggatctatgaaagcttgatttttataatgccttggaggacagatgaaattttatatgtcttagttgggacaccacatttggtttacttgccaccattattgctggctttattcagcaatatgttgtatcatgattatgacagaaaaataatcagcctgtgacattcctcaaatgcctccattctgtacaaaagtattacccaacctgtatcttaaaactatatacatgatgatatgctgacttttggctccataaaaataagaaaaattattttattcagtaaacttggagaagcagaatgatgaatacatcttcaagatgtgaataagtcatgttctttctagtagcaagattagatttataaatgtaggactgctttgatacttgtataattttcttattatttttaaacacttattacatagaaattattgctttgcaagtgatagtagaccaatatatttattatatttgcagaaggcattattcatgcctgtcattcaaattattattctgaaagtagctctaataaagtagttcatttgcacaacaaagctgactaataaacatatgtctctaaatcacagtttatataaatattcaatgaaatcagcagaagacactaaaagtaaatgcagatttcaattttatgcaaagggaaattaaaaaaagacagcattattgtatagactcaaaaagttgttatggttggacagaacccccaaagtcattgaatccattaattgaatctattatgagagtttacatttgtccttgataaatttcaactttctagaatatgtccagtttttccatcagaaaggatttttttccttccaattcttattctataattagtcacattggtttaaacttccagctctaggtgaaggacaaatttcaaaagcaacattttcaagacttcatacaaatcactaacaagaatgcttccaaagagagagaggcagtcctaatagagtggaaagagcataggtcttggaatcaaaataaataggtttgaggcttgatgccataatttctgagcttatgaccttggccacatcacataacactgtgaactccagctttctcctctgaagcagagaaaatgtatcaaaatatgaagatactttatcaactgaaaatgactatatacatttacatatttgtctagattgtgcagtagatatgctactgaagaatatttttcagttgctattaataaacattatttaaataatgaatcagtctaaattaacatgtagctattaattcatctaaactcacatatttatataaccttagacaataactgcacagatttttcccagatatcttgctaagtttgttatctcaatagtcattttttgaaacaaaaatgaaagaattcatgttgttaatggcaatagcatgatttgtcattaattcttgttaaaaatgaaaataagtttactttttcttaaatcatctttagcaaatatttgtgggttactgtggctcacttaattcctttttaaggacttcgtcttagttaattttgtgttgctataacagaatacctgaaaatgggtggtttaataagaacacagatttgtttcttacagttctggaggctgggcagtccaaggttcaaggacccatatctggcaagcactttcttgctgctttatcccatgttggcagacaaaaaggcgagcaaatatgtgtgcgagagagaaaggaaaggggctgaactcatcttttttactagaagcccactcctgccataagtaacccatttccattataatataattaatctattcatgagctcaaagcccttatgacctaatcacctcttaaagtcctccctctcaacactgttgtactggggattaagtttcccacacatgaactttgggggacatattcaaatcatagcagattaatttttaaaaataagccagtgtacatgcctgtaatcccagcactttgggaggccaaggcaggcagatcatgaggacaggagatcgagaccattctgggtaacacagtgaaaccccatctctactaaaaaatacaaaaaaaaaaaaattagctgggcttggtggcgcacacctgtaatccaagctactcaggagaatggtgtgaacccgggaggcagaacttgcagtgagctgagatggcatcacagcactccagcctgggcaacagagcaaaactccatctcaaaaaaaaaaaaaaaaaaagccaatataatcagtaatatcagtaatattatttttccattattgctattctttctcgagccctgtaccttttgaaataaggtgttcactggtttgctggtctttgcagagaagtattagataaaagcactttataatttgaaaaactatgatgaacctggcttttacagttattaaccctgcaatcttgggcaaatagctttgcctctcagagcactgaattgctaactgatagaaatgcagaaaacattttttaatttgttaatttgtgatgaaaattaaaggaaataatgtatacaaaatatttcgtaaatgtctaactccaaatgttacctctctatgtcttgttttgttatcatctcactttcctctgtgaaacagaatgaagtatttctaagtgtgtcctttggaggcatggattcctaaacatataatacaagtagaaaatacagtgagcactaaaaaatagtttttctaaaatttgcataagcgaacaaaagcacaaaaattattcctgatgaaagtgattttctttaggggcactggaaaatatagcctcatacaaggaaagaaaaattatttttattctgatgtataagacatcatttcagaaatatatacaaatggagggtgttgcctacagatacacatcactgaagccaggaagtttttaagccaaggtaacaatcaatgacctcagttgaattcccgaaagggctctacatcagtgttaaaatggccatagataagaagataattaactatctgtcctgagaatctatttgaaagagctgttctaagtttctgagagcaaaccattaaaaacagaaaagtgaaagcagagaatttgggcttattccattcactggcctcctgttttctattaaaagggttgatcgtaactcccttattttttgttctctgcatctttgaacacttgcttgaggggccaaaaaaaaaaaaaaaaaagaaaaaagaaaaaaaaaaaagcagggggcataaagtaggaggaggaagggtcatagttccaaaatatttccagaccatccccagacaaagagcagctcaggtttcgatgtcaccttcctccatgatttgtaagccatatccttagtttctctgttccttctccaatactactttgctttcaatcctgagcagttcttctctggactattgcaatgataggtcatttgatattcccaagctctagtctgattttcattttgattcacttccatattactcctggagtgatcctttcgatacaaaatttgctcctgaattccccctgcttgaaatcttctataattctactgctttcaggataaagtttagtctggaaaataaatcacttcaaattttgaacctatgtttccagagtcttctctagccacaaaaaattaaaacttgaaaaacacccttaactcatgaacaccatgaactcatttgtccctgttagatgagagacaagagctaggccctcaatacattcttggtgaagaatgaattattgaatactggagttcccaatttcctacttacattttatcatgaagcggcttatgcttaattctttttgatgactctttcatggaaaatcatttcagtggaagtttttatacattattttttgaattgagaagagatgattactttcccagattattgtttagatcaaatcgtttaagtgacttcatataccacatattttgtgagcaactgccaagtgccagacactgagaatacaatggtaaagaaatagatataatatatgtcctctggaatttatatcttagttggaaagagaattaattaaatgaataatttctgtacaggatgacgcatactttgatattgacctattgtgttatagccactgtgctatacatagttgagcttatgatcttgccaataagagatatatagataaaaatgccgaataatatttaatcacaaattacataaaggcaatgattttaagatgcaggataataagcaatcatgcaaaagaggtgaagttattttaggtagcaagggaagacttcactgaggaagtgacatctacactgatatttgatggatgagtaggaattagctgagctaaaactgtaagaagatcattccaattaaaagaatagcatgtgcaaatacggaggcagagaagagcttggcatattttaagaactcaaacaaattcagttcagctgataaaagatgtgaaagtgtggcagcacacagggctggaatacaattatcttcttaagaatattgactcttccggttcctgaatgtggtacatctttccctttaagtctttatttcttctcggtgacattgcttgccaaacttttcaacctttcaatccatattctttctctctctctttctctctctccttccctcccttcctccttctctccctccccttttgtcgcccaatttctctctggaaatttgaggtatcttttctttctctccagttttttgaagtgtgactaaaacgcagctcaatagttttcaaccatccaggaattaaaagggtaatttcaatcttgaaattcatgttcttcagttctgaggatttttcttaaaacatgattttaataatttattcaattcattttctctattcttttgcaagtttttcttattctaatgctgggaaatcccagagcagttctccagttttcttgtgttttctctcctctattctattcctttgcctttttgttttacatttttagatatttcctcgatttgtttcttcatacccttctattagatgttttatttgttacatatgctttcattttaagaccttattatattcctttgtggaatataataatgtaaatattatttataattacattatttataataatgtaaataatgtaaaatgcttcctttgtggaagcatttcctgccacttttaaggatgctgtatattttgttttgtgtttaaggatattattattagttctttaactttccacctccctgaagagtttctatatccttcagtattttaagtttactggttttgtgctctgtcttcagtgttagaagttttcctcagatgtactagtgatgtgaaatggtctcttcataattaatgttaggggatttcaaaaaaaaaaagactagagactgtgtctgtgagtgggacctgtctattgtagattttacatcaggaagtactactgactaggatgctctctggctgatcacccatgttgagctggtttcatgggtctcagggaaggagatactcccactttcctgcatagagagaaacttctggctacctgcattctaggatcccaactggagaagagaacttgggctatcaacatttagtttgtaaaagttttcttatttccacatttcagtatagtgccttgcctctcacctgatgttgggaccttcaatccagagatcctctttttcaccctgtactctggatacgtttcaactctttggctaactagataggattctggggatgcttattgcttaaacaaactttttattattcttgcttcttttggtcctacgatcattccatcttccagaagtaactgctatcacagatttccgagcttttggaaggttctatactgcatattggtttactccttggctgagaatttggctttctttgtaatttagttactacttgtccattttaaaatttgtgttgctatcatctcttcttgcattccttcggtctttgtaagatttaagggcaatgtttctttattctatttggaagcattaagaaaaaaaaaccctgaaattaaatgtcagtgttcaatctgctgtcagtattggaagttgttctgattggcttttgtggacttcacagaattttctggtggcgggggagaaggactgaggatattagcagtcttcgatgaacatacaaggaactaccagagctagattacatggaaagattcttttattccttggaatcgctatatgaattgctctcctccccaccatcctgtacacaagcactgtggcttatttagaaagctgtaaatcagtagcctccaactttactggcaccagggaccagtttcatggaagacaatttttccacaggacagtggggcggggcaggggggtggtttcagggcaaaactgttccacctcagattattaggcattacattctcataagtagtatgcaacctagatttcttgcatctagagttaataataggggttttacgctcctatgagaatctaatgctaccactgatctgacaggagtcacagttcaagtagaatgctcacttgcccactgctcacttcctgctgtgttgcctggttcctaacaggccacagacctgtactggcccttggcctggcggttggggacccctgctctaaataatttaccagtacctacatatggatatgtgtgtgtgtgtagacgggtatgcatatgtatatggcaaactgaggtttcttaactaccatcatcttttatgagtcatatttcatattgcatgttcattttcagagtaacatatactacatgcatagtcatatttataaatctaaacatgttttaattttagatatataacacagatgagttaatatttatgagctcatgtgaaaacttcactaagcacgaagtttgcaactaagtaccctgcacatttcttagtgccttggtctgccgtgttttcttttttttagtttttcatgtgcaagtctttatttttattacctatctgatggctatttaacttatgctaaggatcatctcagttatttcagttaacaggataaaatcaactacactggatcctgaacttttttttttttgagttaaggtttgttattttcttaagtactgctgaattttttctttgttgatgtatattgtttttgtgaacacccctcaaataagattgaaacagttttgctatttcatccatattatcagttgccttcagtttttcctctaggggtactatatttacattagcccaatctgctcagaaataccagagacagtctttactttccttacttgccactctaccatcttcattatattgagaaatgagttatgtcttaaatcagcaaatcaacattttctatgacttttatcaagatgagggaatagatatttgacatacagtgtgggtgtctcttgtaaaagaaattgacaacacaaatcacaagtgggatgcaactaatgctagagagctgctttatgttttaaatatgaataaatctctcaaaatatgaaagtggaaagacaagctggactcaaatgattacagcttttagaattaaaataaattagggcaaatactggctctaaccacaagagagattatcactgtttgcctatttctgaaggaaccctcaaggaaattaaggtggcttgggttttagtgcaaataacactacatgttttctttaatatttccatttctccttaattcatttcacctgttaacacaaggcatgcccaaacattactctaaacattaaccaaactccatgttctaagtaagaaataaaatgcattatatttttttggacagtcactgggttatgtaggaagaagtaattatttttatataaaagaaaatgatgaatctcactctaggtgttaagctggtgttaagaggtgttttcttctagaataatatccttaaaggtatatgaacaaatgcgggaggtcttgaatggtagttcgcagagaccattatgatgtcaaaataatgtaaggccaacagagtattgacagttcaattttcagttttagcaatttttaagcaaaacaaattaccataaattactgtcatctaatacaagaaagagtattttacttaccaaaataaaaaagatggtttcttcattgtacttaccaaaattaagtattaaatatttagtacatatttgctgtttttcttagaccctaagttctgtaggaattagtgatgaaaaataatttttaaaataaaggccattatcaactacaaatacacagacacacatgtatgtacaaataattatatatataattattttatttatttatttttcttttattttggacctttgaaaatttcattaaagccttccaagggccaatggaccagcatctggtagccactagtccaatgggtattaggtaactgatgtccgttttccaccatctggacatattgtcactggtgactgtcatatatgtactggacaagaaggattaaatggcataatgcccataaaaagcattttgtaatctttaaagcactaaataaatataaggaattagtactgttatggttatgatattgcctcagaatgcatggtaacaaattctaacctgaaaaaaaatccctttatctacttaaaaatcacaagactatgtagacttttaggaataaaattttcccataggagtggtaatcaccaactttttcaattgttttgctacataatccagcctgctatagaaacttcaaaaatggaaaagtggaagtgtcaggctataacaatctcttgagatgtcatattaaatgtaaatacatcttgaaagtttcttggcatatcattagagcaagattctactgtaggaagcaagaggtttatttgtaatggagtattttttttaaacagcaccgtcttctctggctaaataagcaatttgtacaaatgacaaatgtgtttattttgcttgagaaatgaggacatctgaacgccagttatttacaaacctctatgtaaataacttcaaatgcaagacctatgtaagtaatttaatcaatgtgctaagggcagtgccattcacctctcctgtaattgcatcaccctcacctactgacctcatctggcactactccacatcagcaatgttacattttcctcccttaatcttccagcacacttcatctttctggatgtctagtcacacatccttacatgcatactcatatttcacagagatttctagacctcatatttcatggagatttctagatcttttagtttttagttttctacaaatatgttatgctcttcttgctatgtaaactttgctttaggacaaatgaagagtcagctagttcccctgcttacgccattttcatttcaccctaacactctttgaacagctgactgtgcttattttgtaccagaacataaaactactcacttggttggttgtttgaatcctgctgcttcttccagacctgctattttgatctcagatgattccaggattctaaatgagaaactttaaaaaatcctatctgctaaaatatggattaaggtttcttcagcttatttatttcattaggtgcttattttgtaccaggtattctttatagtgacataggatagagcagtaaacaaaatccctttcctcatggagcttaccttctagcatagactagagagacaataaaccaaataaataagaaattttgtagcaaatgtgctacatgttataaggcaatacatattattgacaaaaataaagtgggtggggggtaaagactatcaatggtagggtatgtttcatgtttaaatgtgatggtcagagatgtttcagtgagaaggtaacatctgagtgaagattttacgtgacaaatctattgatgttgatatctgggggaaggttgtttcaggcaaagagaacagtaagtgcaaaagccctgaggtggaagtgagactaggaacagcaagaagaccactgtggctaaagtgaattgggacaggggaggagcaacaggacatggatgagaaaggcagaagaggtatgtgttaatctggtaacatagtgtaagactgtgggttttactgtaaataaatggcaagtaaattagatggattgttagaggagaaaaaagataaactcgtatactttagttaccatctaaaccagaatccagatataattgttttgtgttccttgagatataggtaattgtacattcacaacttaggatcctaattctcatccaatcttatttgttctaatttgggcatatatatatttttctttaaagtgtttacttggaactggagatatgaggacccaggatcatgacaggacaatataagaagaagaaaataagtaaattgataaagacaaaaatataaaatgttatttctaaatagtaaaataacaaaccaatcccataaaaagtaaagaaaaggatacttgttatcacaattattatacaccagtgattaaaaaattttagtgaatgtaataaatcaagaaaatagtatcattagtataaggattggagataaattgactcagatactttgtgttaataaaattattgtgcatgtttaaaatccaaaacttctggagaaaactacaaatattaaataagaattttgaattatacaaacattaagtggcttttctcattattagcaacaattagttggaaatcaaaaatatactaacgaaattacaaagggtggtaataattcaagaaaacacaaaatatttataaagcaatctgtctttatggcagaatgtaaaaataggaattaaatgtcttctcttttttattagaatatttaatatcattaaaatttcagccctctaaatattaatatttaaaaacttaattttataattagaaaaaaatcttaaaaaattcttaaagaccaacaatatttaagagaaaaacaaaattagtatacgaaaactaaaaataattagagtggcatgacttacaagtattaagtataatagaaaaacaatgtaatcaaaacactatgttggcatgcttggtggctcatgcctataattccaacgctttgggaggacaaggcaggcagatcatttgaggccaggagtctgagaccagcctggccaatgtggcaaaaccctgtctctactaaaaatacaaaatttggtgggtcgcggaagcacatgcctataatcccagctgctagggaggctgaggcgagagaattgcttgaatctgggaggtggaggtttcagtgagctgagattgtgctactgcactccaacctgggcaacagagtgagacttggtctcaaaaacaaacaaacaaacatccacctactatgctgctacaaaagaaagataaataaaacaatagtaccaaagagagtatctaaaatgatataatagtatacagaaaatatataatttaaaatatgtataattctaatgaaatatgaagaagtgttgttatttcaatgggaaagaattctttatttactaaatcatgcaggcacatctgatcatctatctcaaggacctcgcaatgcaccaattttaatttaaaaaattgtagttggattaaatgaataaagatacaaaacaagaaaacaaaactttgccagttttcagagaaattttttggatcaaaaagaggagtgaagaagctataaaataacttttaaatatgtatttgattatgtacaagcaaaaaacggcaaatttagcataatcaatatcctagaaccaaagtatatattgaggggaaatctgtatgtcaatgattataaagccaaagagaaatgtgaggaagagaatgtccatattcacattggttacctggggagaaagtaagaagagacaggaagaagggagaggagaaggtagacaaaaggaaaaacaaacaaacaaacaaaaccacaaaaaccaaaagagataatggaaagaagaaaacaaaacaaataatggaaaaataaaaaatatatatgcactagcataatgtctacttatattaatgctacatgttaaaaaggatgaatggacatattgcaaagcatcaaagaggaaaaggcaaatgaaaacaaagatttgatttggggattggattttggaaagtattcttctgacattctgttatagcaatatagtaaaaatatatttaaataaaatatatttaaaatatatttaaaataaaagtgagagagagaggcttcaaaatggctgactgaaggtatctggtacttgcctcctccgcaaaacaaaaacaaaagtaaaaaatctccaagcaaatggataatcacactttgaatgtattgccttagaaagaatgctgaaattcaacagagaagtaacagaaaacacctaaggcagaaaggaaagggaagtgaggcatccttctctgccaggagccaggagagacttcccaatgtggggaaagagtaagtgagtgacccctaatggtccatatccccaccacggattcctgcaatacttgccagagccgttctacccacactggctgtgagactaacagagagagctacgtgaagacagctctgacagcatggctcaagaaagggaggtcacgctgtgtattcgtctgtttttatgctgctgataaagacatacccaagactgggcaatttacaaaaggaagaggtttaattggattttgcagttccacgtgcctggggagacctcacaatcacgaaggtaggcaaggaagagcaagtcaggtctcacatggatggcagcaggcaaagaaagagcttgtgcaggaaagctccccattatagtaaccagatctcatgagacttagcatcatgagaacagcatgggaaagacctgacccccatgattcaattaccccccaccgaggccctcccacaacacatgggaattcaagatgagttctgagtggggacacagccaaaccatatcacgctggatcctgcacacatctcaagccctaaacaactacagtgaggtaccattttgagagcccagtcaccaccagtctgtatcctgaatctccttattcctggagtaaaactgacatcccctgatcacagatggatgctgctgtcagatgctatggccaatgccaagtacaagccattggcagcaaccccaactgccacaagtagcagggccatcatgcatttaaaagtgccatgaagaaaggctatctcacttgtagccaccacttggggctaaagattgaactcccagcctcctgcctatggcttttgccactgaaagcaactccaccattcccagaagcagggccacagtgcagccgctgcctccctaaccaagcattctgccaggaatctgggcatcattcagcccatgcctaccacagccagcatcagcatgtacctatttgggacctcatgacagtcacaccccattcaagtatccctcacccagtgcctgaacatgtcacttggcatctgggagtttggcaatcgctctgccccatccaccacctctcatggtgctgaggatgagcccacccaaattgccactaccaccacagctggcatctatccacacacaccaactgtgggccagcgattgcagccactgataacaccagcttggactgcttgggatccaaaggattgttctgccactgctactcccatcaccaacacaacacccactgctcagggacctgagtatctacctacctgcccaatgcaaagctgccactaccagcacctgagcaagctgtctggaggccaaagaatcagctagcctgagcccgttaacattggtgccagtgaatgctgtgcttggtgagacccaggcacatttagcctgccattgccaccactggggcctgaggactatctcagtggatgttcctgtctccagcaaaacatcactacagacttcactaccaattgtaccataagctactaaggaaatcacagacaatactgacactgcctatacccaaagaaatcatacaaaaactacactactgcacacactcagagccaaagtgccctatccaatcaataccacagatactaatttgtagatgacatgatcttacatatctagaagaatttaaagactataccaaaaaccttttagatctaataaatttagtaaagttgcaggatgcaaaattaaaactaaaataccagtagtatttctatacaccaataatgaactggctgaggagaaaataaagaaggcaatcccaattacaatggctattaaaaaaatctataagtatacttagccaaggaagcaaaagacctttacaaagaaaactacaaaattctgatgaaagaaatttaagagaacttaattgaatatgaagacatcccgtattcatagattgaaagaattaacattgttacaatgaccatactgctcaaagcaatctacagattccatgtaattcctttaaaaataccaataatattcttcacagaaaaagaaaaaaaaatcttaaaatttatatggaatcaaaaaagagcttgaaaaaccaaagcaatcctaagtaataacaacaaagctggagacatcacactacctgactttaaaatatattacaagaatatagtgaccaaaacaatatggtatgataggaaaaatggtacatagaccaacagaacagaatagagaacccagaaataaatccatgcgttttttatccaaatgatttttggaaaagttgtcaagaatattcaatgaggaaagaacatccttttcaataaatagtgctgggagtatttgatatccatatgcagaagacagaaacaggacccctaactctcatgatatataaaaacatcttaaatggattaaagactcaaagtaagaccccaaactataaaactactaaaagaaaacatagaggaaacacttgaggacattgggctaggcaaagattttatagctaagacctaaaaaacacagacaacaaaaacaaaaataaacaaatgggattgttttaaaccaaaaagcttctgtacagtgaagaacataatcaacagagtgaagagataacctgttgaatggaagaaaatatttgcacaatgtttcatctgacaagagagtaatatttagtatatacaaggaacttaacagcttaaaaaaaaaactaactcccgctgcccccccaaaatacaaataattgcatgaaaaattgggcaaaagacatgaacagacatttctcaaagacgtataaatggccgacaggtacatgaaggaatgctccacatcaataagcaccagggaaatgtaagtcaaaaccacagtgaggtatcatcaccccagttagaatggctattattaaaaagacaaaaaataaaagatgctggccagaatgcaaagaaaagggaaagacaatattggtaaaattatacagacactatggaaaacagtataaaggtttctcaaaaaagaaaaaataaaactatcgtatgatcagcaattctaatactaggtatgtatctgaagaaaaggaaatcagtaggtcaaagagacatttgcacctccatgtttattacagcactattcacaaaagcaagatatgaaataaatctaagtatccatcaatggattaattgttaagaaatgtggtatatgtaaacacaatgaaatactattagcgcataacaaataatgaaatcatgtcatttttagcaacatggatgaaactggtgttcattatgttaagttaaataagccaggcacagaaagacaaatattacatgttctcactcacatatgtgggaccaaaaaaaaggttttcgcatggaagtggataccagaggctgagaagggtgtgtacatgggtagggcgtaaataagagaggttggttaatgggtaaaaacaattgtacaattagatagaagaaaaacattctaatgtttgttagctgagtagactatcattaacaaaaatatattgtttgttctaaaatatctataagagagaacttgatatgttcccaacacatagaaatgataaatacgtgaggtgatggatactgtaaataccctaaccctaacatgatcattactcattctgactgtaaaaaaaaatcatgtgtaccccatacatatgtacaaatatgtatccatgacaaaagcaatttaaaaaattactttttgtaaaaaaattgccaaatatttttttaaagtaaaattaagtaagaaaacagattttggcatgtacaaaaaggtaaattgagagaatctctataaatcatcttgaagcataaagacttgtattcatgacttgctaagctattagaaaacaataaagctttaaaatattctgaactaatgactgaatgatatctaatcaatattcactttatcacctggcaagtctaataatatgaagtcagagtactgaagaaactacatctattttccctgcctttgaaaggaaataaaacctacgaaggcttcctttaaaacagcacgtgtccaagaatgtatctggtcttccttgtctcaccactttactaataatttgacttttcctaatccaagtgattgattagttgaatgcatgtttaagcctcatagaaagtgctcatttcttcagacgtgatttgcaaaggccagaaattcaccattcagtaagaaaagctatgaaatagacctgtcataaactcatggggagggtgtcctagggagtcacctctgttctccaccaggagacttttagctggcttacttgcagagaaacatatatttagtctactttttcgattttagggtgtgagaatcctgccttttacttaggctgactgagttgaagagaaccgtttttctgcctctctattactgccatttttccccccctgcagtttcagccactctaaaatatctacaatgtgttaggtatgaaaggtatgaagatttataaacctttacccacactttcaaggagcttatattctagtgtaagagggaaaagaagaaaacagaaaaataaaaatgaaaagttccagggatatttaaggggtctgtggaagtcttactggagttcaggatatcttccaaactgcctggaaatgtcttacgtgataaacctgatacataaacctgagtatataggtaaaagacagggaagtaattccagggacaaaacagtgtaggttacactgtaagctagatatgttcagagaattgtaatcattttgagatagaataggtgaagatacagcagtgggaaggtgcagaagtgtgtcaattctgatattcggctggtatgcatcagcataaattaacccattggttatgacttgcatctgttttgattggatccacatcttactagttgttacatattttaaatctcacctctgagtatcataggaagtgactggcagattttaggccatgtagtgtatgccaaattacggagtggaatatgatggcaaaggggagtcaactaagatcattttgcaaaaggatgacacaattacacttgttttacagaaaaaacaactctgaggaaactggggatgatgggatgaggaaaaaagaaaagaagcatttttaatccatgttattgatacaatttagcaaatgagaggtgtaaaaataactgtattaaaaagactaatatctatatccaaagagtacatttcttattaaacttagcacattcttttattttaggtaaaattaaatcactttgggttgaatgaggaggtagttcaaatgcattgcctgttgcaattgctttgaacattatgttccaggatgttgaagtcaaaaaaagctcctttgttctggttctcctctccactgagaatcacggcattcaagcctgtaccctcaactccaaccaacactcctaagactctccgatctcataacccatcagaagcccttaaacctcaagaaggattgaaaaaaaaagtggagtttatgtgcaaaccatgactacttttgagtaatattgaaaacttaatactgctatgtaagtaggcatattcatcttcacagatgaaaaaactctggatcaggaagcaaacctctcctgtaaagggtcagatagtaaatatttaaggatctatgggacatatgacttctattaaaactgttcaattctgctattatagccccaaagcagccatagacattatgtcaatgaatgcgactatgttccagtgaaactatcgtacaaaaatagaattcagctgatgggcctcagttaatcagtcactgtttttagtatgatttatcacaatgcctgtcaacaaatagaaatatacatatgtatatatgtgtgtatataaatctgtgtgtgtgtgtatatatatgtatgatagttcacatcttctgttaattccaccaaatcatgtcaatcttctagaaaacaggccaggcgcggtggcttatgcctgtaatctcagcactttgggaagatgaggtcactggaaatcaggagtttgagaccaacgtggccaagatggcaaaagcttgtctctaataaaaaatatacaaaaattagctgggcatggtggtgcatgtctgtaatcacagctacttgggaggctaaggatggagaatcgcttgaactcaggagacagagactgcagtgacttgacataccgccactgcactccagcttgggtgatagagtgagtgagattctgtctcaaaacaaaaaacaaaaaacaaaaacaaacaaaaacaaacaaacaaaaaaacaaatctagaaaacaataaagagcaaatgtttttgactggaattcagcacagaataatattcagtttgcctttgtttctctgtagatgtttacacacatttataaagcaacttcaaacttttctgtttactaaaaactaaagtttcatcaaaaagtttagtttcctgagaaaatggaagtgcagtttgaatagtccatctaattattaaattttcttgattacagaaagtgtaattgctcctggtttgttaatcttattttttttaaaaaagaaacattttcagaatcacctttaactctacattttcctttgtttaaattatctatcttgaaaatagagaaaaacatattatcttatactgtaaggacaaaatttattactgaaattgaggattatcaaagatccagagatggttttccagaatggtttaggatacaggttatcttctaatatcctcactgccatttactgcctgtgggaccttgagcaaattagttgtctctctgtgtctcagtttcttcagctataaaatgaagttaataataatagcttacaaatagaattgctataaaaagtcaataaattaatacatgaagatcaaccacttagaacagtgcttgttaaataaagatcactctataaaaagtgattattatcaaaatgttttaaatatttatctaaacaaatgttcgcagtgtaatcaatctcaaagccaccagcgcactttgagatgcagattactttaaagcacaagctctagtattagaagagggcttcaaagtcctgggttggtttcatcctggacataggaatacttcttcatccaataacatcaaaagcccctgttcattttcagttgtcagacctacagcacctcccacgtcaactggtattatttacatttcagcttatatctagcaagcagagttgcctttaaagacataagttacgtcggccgggcgcggtggctcacgcctgtaatcccagcactttgggaggcagaggcgggtggatcacgaggtcaggagatggagaccatcctggctaacacggtgaaaccccgtttctactaaaaatacaaaaaaattagccaggcgtggtggcgggtgcctgtagtcccagctacttgggaggctgaggcaggagaatgtcgtgaacccgggaggcggagcttgcagtgagaccagatcgcgccactgcactccagcctgggtgacagagcgagactccatctcaaaaaaaaaaaaaaaaaaaaaaaaagatataagtaacgtctctgagtttcagattcttcatctataaagttaggttaatattactcacttcagaagggacttgtgagaaataaaagaaatatctcattctttacattttaataggggtgtttgaggggaacttttatgctccaggagagaaaagcatggaaagaaaacacacagcttcattccactatcttcctactatcccttctggggatagtgactcatctgtctggtgaaactggagaaggggttaagtgtgtacgactccatctcttctttttatggagcagtctgttctctgaacctgagtttttctgttgtccttctgaaagctacctattaaagcaagcaagtcctgtgattgttcagtcctgtctgtgactgtggggatggagaagaatatttggtcacagatcaaagatttggttttcatttagctaatatatactaattccatgacttcttgctggtatttaatttgaggaaagggctattatttaatgaacctttaaatccctaacagtgagaaattaatataatactttatgtgactctacagttacaaatgttaaatttggccttactttaaaaatatcttgcattatagtttaacaaaatctttctctcctcattgtttataacagatggagtaatacctttcaaaaataataaatgaaaccacttattaacagtataggtttcctggtttccaatctccactgactgtttctcaacccactgccacaccccttatgctacacacacacacacacacacacacacacacacacacatacacacacaaacttccttctccacttgcctccaaatttaggaagaaaggccatcaagtgatttttctatttctaaacttttaagctatatctgccccaacacatttttaaatttctgttctagttctgtagtacatcttctcagttggtttcctccacctggactttaaatgccaccccttcccacatttttatgcattttatactattcgtaaccctcttttcattaattaaatcacctatcctacctggataccaaaattaaccaattaaataaacaactgacctttgcatgcaagatacagatactatatatcataaaattttaaaaatctaaaaattatgaagcttggcattgtctgaagatcataaagcccaaattaaatgacaagagtaaaaatattttcaacatattccaatgagctaccttccttaatttataaagtttttagaaatcaataaggaaaaataaacaaaaaatggttttagtacatggataggtagcttttaggaaatattgacataagataatatttactatcttactcataattttaaaactacaaattaaaacattgtgatgccattttcattcataatattatcaaagtgcaaatgatttaataatgccatgagttgacacagaaatacaagtgcttttcactatacattttgttcaccacttaaactatttttcatgattataaattacatctttggagagaaataaaatgttaatgttaaaaaatctctctttacctcattttcccttaaaatatacagttgacccttgaacaatgcaggagttagatgcaacatcatgttacacagtcaaatatctatatataacttttgactctcctaaatcttaactactaatggcctactgttgacccaaatccttacaaataacataatcagttgattaacacatatttttgtatgtggtatgcattatatactgtattcttataataaagtaagcaagaggaagaaatgttatcaagaaaatcatagggaagaaaaatatatatttactattcattaagtagatgtggatcatcataaaggttttcatcctaattgtcttcatactgtaggctgatggggaagaggaagggaaggggttggtcttgctgtttcaggggtggcagtggtggaagaggcagatgaggtggaaggggaagcaggagaggcaggcacacttagtttaacttaacacatttaaggaaatgcatttttgcctttttttttcatttctctaaaaatgtttctatacagtaccaatccttcttccactgttagctttaatttcagtccctgtatcatagaaaggatcatgtcataaaagaagtcaaaagcagtcttgaataactgaaaccctcctgccagattatctaatgtcaatttgctttctgttactacttcttcaacatcatcttcctcctcatctggcactggtccaaaagcactcatctccatcaaagtcatcttctgttaattcttgtagtgtgatgtctgttagctcttgaatttctccaagatccatattctgaaaccctttacccccacctttttttttcccatacccatgatctcatgatttccttgattggctctatcataaatattgtgaagtgatacacaagatctggaaacagttttcttcagcaggaatttattgtatcaggcttgagggctttcagggctttttccataacaacaattgtatcttcagtggtataatttttccagactttcatgatgttgtctctatttggatcctcttcaaccagttgatgatcctttccatagagtactgtgtgtaatgagcctttatggtccttatgacccctaatctagaggctgaattagagactttgtgtctggaggcaagtagatactttccatgttgaactcatgaggttctgggcggtaagaggcattgctcaatagcaaaggaactttataaggtagtccttcctagccaggtacttcatgaattcagggacaaagtgccgatggaaacaatcaaggaaaatagctctaaatgtccaggtcttcttcttgtacaaccaaaagactggtagctgatgtttatcttttcccttcaatgctagaagattagcaactgtgtagataagaaaagtcatgatcataataaacctgactgtattgtcaaaaaacaggagggttagcttactccttcctgccttaaatcctagagctcacttctattctttactaataaatgttctttgtggtatttttctgtacagaatagaggactttgacacacattaaaaacctgttacagcaaatattccttctcctcagtggttttcttaatggtgtcttggaacttgtctgctgcttcttgggcaacagaagctgtttttctcattatcttgacaatttttaagccaaatatctttgtaaaattatcaaaccatcctttgctaacactaaattctccagctttagatccttcaccttccttttgagtaagtcatcctttaatgactttgctttttcttgaataatattagactctaaatgtatgcctttcttatacccaatcatacacctacataaaagctgcattttcaaaattacagaaaaaggtatttccccagaagagcaaggttttcacatctgctggtgtagccacagggatggcttcatacgtttccttttctttcgttatgttggtctttccttatgctggatttgtttatcttgaaatgaagggcatctgcagctgcagaccggaatccacagtacatattaagcaactcaactttttcttgtgatatcatgacttttctcttcttcttgggagcagtttcagcatcactactgacacttttgttcccatggtgttatttaaggttcacagtattgcaaaagacatgataaaaaaatgtgcaataatcaggaacaatcacttttcactgtaatgcatgatttagtggtgaaatgcacagttcacagggagatgattagcctcatactgtgatttaagcagatactcataatacttgagatcattgcaatatcaataggaggtggctttgaaattacttcagtagtacaacatgtactgcagttaattttatgcagttatgatttaatagtaaatctttgttttctcttaatcaggaatggctcacaagtgtgcacaaaagttttgataaattttaacttcttataatagattggtgtagattttatggtagtaaatgataaaatagtatatgtaaatattacattcatttatcacacatattttcttatttttaaaaaaatattcctagtcaacatggtttgtgtgtgagtttgtccaaattattgcaaatctcaaaaataaatttcaacctatcaactgaaaaaaatatgtaaatggagacctgcacagttcaaactcatgttgttcaagggtgaactgtagatttcattcttcattccttattagttcaacttcccaaaatactggcttatatgtcatgggttcatttactcaccatctactcacttcttagctacttcattgttaatctgcttttattactctattcagccatgtcttgttaaattgccaattctctccacctcaataaatccaaatggccatttcagtgttattttcacttgatctcctaaattcagttgacactggtggtcttgcctgtaaatactctcttccattggcttggatgacacaacactcttggtttcccatcaacatctctggatttgcctgttcctgtctccaatttagagttcatctttttttttcaacctaaatgctgaggtccctcaaagataatttcttagaattcctctcttaattttaacaaacacgtccttgatttgctattatcctgatgagtctctcaattctatttacagcctatatatctcttctgagctctcaacttacatattctcctacctagtagactactttatctttgaaatgtacctgaactccacttatccaaaactgaactcatgatctgctctttacttcatatctgacatttcccaaagacctcagtaaaggtactatcattcctattgttaacttttatcccacattacaaattaatgacactgaatagcccagtagaagaaaattatggacatgcctttttattgcacttgattttattgtaactccacagatattgcattttttacaaattgaaggtttgtggcaactctgtcctacacatctgttggcactatttttccaatggcatggtctcattttgtgtaattttgttaattctcacaatatttcaaactttttcattattattatatctgttatggtgatctgtaatcagcgatctttttcgcttatattattatttcaatttacatgataattgtacacatttatggcatacagtgtgatatttccataaatgtatacaatatataaggatcaaatcagggtaataaacgtatccgtcacctcagacatttattatttctttgtgttaggaacatgctactgttgtaattggtttggggcatcacaaactgtgcctatataagaccgtaatgagggtggtatgttctgattgtcctacccactggctgtacttccgtctctctccctctcctcaggcctccctaaccctagagacacaacagtattgaaattaggctaattaatagccctacaatggctaaatgctcaagtgaaaggaagaattgtaagtctctaactttaaatcaaaagctagaaatgattatacttaatgaggaaggtaaggtggaagcaaatataggccaaaaattaggcctgttgcaaaaaacagccaagttgtgaatatagagaaatgataagaaagagaaacagccttattgctgatgtggagaaagttttcatggtcttgatagaagatcaagtcagccacaacattcttgtaaaccaaaattctaatcaagagcaagatcttaactctctttaatcctataaaggctgagagaggggaggaagttacagaagatgtgtaaagctagcagaggttatttcacgaggttgaagacaggaaactgtctctgtaacatcaaagtgctgggtgaagcagcaggtgcagactgatagagaagtttcaacaacatattttcaatgcagacaaaacagcctttttttggaagaagatgccatctaacactttctcagctagagaggagaagtcaaggccttgcttcagattgtcaaaggacagactaactcttctatgaggagataataaaactggtgacttgaagtggaagccaacaatcatttccattctgagaagactaggaaacttatgaattatgttacatgtattactgtgttccaaaaatgaaaaaaacaaagcctgggtgacaacacatctctttaaagcatggtttactgaatattttaagtctacttttcagaattactacacacacacacacacacacacacacacacacatatatatatatacaaaaatcctttcaaaatactactgctaataattgacaatgtgcccggccagccaggaggtctgatggagacatacatggagtttagtgttgtttacatgcctgctaacacaatatccattcttcagcctatgaatcaacaagtaattttgactttcatgtcttattatttctaaaatacatttcataaagccataactgtcatagatggtaatccctcagatggatatgggcaaagtaagttggaaaccttctggaaaggattcaccattctaggtgtcattaagaacattcatgagtcatgagagaaggtaaaaatatcagcaacaggagtttggaagaagtgattccaaccctcatggatgactttgagatgttccaatacttccagtcaaggaaataactgaagatgtagtgaaaagagcaggagaactagaattagaaagtgagttcaaagatgggactgaactcctacaatctcatgataaatcttaaatggatgaggaattgcttcttatagatcagcaaagaaagtggtttcttgaggcggaatatactctggtgaagttgctataagcattgttgaaatgacaacaaagaatttagaatattacctaaacttagtagataaagcagtgatagaatttgaaaggactgactccaattttaagagcagttctaacgcgggtaaaatgccatcaaacaacatttcatgctacagataaataccacttccttttgtgaaaggaagactcatttgatgtggcaaacttcattgttgtcttattttaagaaattgccacagccactgccaccttcagcaattgccaccctaatcagtcagcagccatcaacattgaggcaagaccctcaactagcaaaaagaatctaacccactgaaggctcagatgatcacttgctttttttttttagcaataaagtatatttgaattaagatttatatatttttagacataattctattgtgcacttattaggctacagtacagtataaacataacttttttttttttttttttttttttttttgagacagagtctcgctctgtcgcccaggctgcaggacagtggcgcaatctgagttcactgcaacctctgcctcccgggtttgcgccattctcctgcctcagcctccagagtagctgggactacaggcgcacgccgcgacacccggctacttttttgtatttttagtagagacggggtttcaccgtgttagccaggatggtcttgatctcctgacttcatgatccacccgcctctgcctcccaaagtgctgggattacaggcatgaaccaccgcgcccccccccactttttatatgaattgggaaaacaaaacatttgtgtgatttttattgtgatactgttttattgtggtggtctgaaatcaaacgcacattttctccaaggaatgcctgtatacttgtttgaaaatgactgaatttggaatagacattcttgctacatgtaaagataaagaataatatctacctctggggaatagccactatcatagtttgactagaaaaactgtaatttcattggcaaggatatttcttacagtaagttcttatcatttccattttgaaaaatattgatgtagattgacctctaagaaatgcttcttataatcctcaagtacttttgaaatttaagtacatttcctttttgtggctttgtaataatcatcgtagtaaagaatattctcaaattattcaaataaagttaattatagatcaaatgaaactatcttttcagttgttaatttgctaaaaactagttgtttccaagtcttatttaaatttctaacttttaaataatgtatttcaagtaattctttcccagatctagaacaagacagtgtattcattctagaaaataagccccttaagaaatgccattactgttcagattattgatctcagcctgctgtcagagccaaagtgtttagcaagactatttcagggacctgaacaggatatttttattggcaatgagacagcagattacccacagctcaaatggaaagacctagtggtgaggtgtgtatcattctaacattctattgatgtgcagcacagatggtgagatgtgctgatggatgaggttgtctcagcagcagagttgtcttagtcctgccaagcacttaagttgaacgacctattaaacatggttgacctaaggcagttggagatatttataagtaactacagctattaaatgtggaccttctagtaggctctaaatatagcctttttttttttccacatagctttgacttctagttcctaaagccattcattcaagttgaattggggaagagaaggagcaaaaagagagattttcagaatatctgtaaacaaaataacactagaatactgaaagaagttatagcgtgaactaaataaaaattttcaggaggtagcactgatataaaatactaattaaaattaaaaatttgaattatctaaaattttaaaaaaataaactcaggttctatgtagaacctagggtttgctatcaaataataacttcccctctgtttctactctacagaagacaagttagtagaaaagtacactggattataagttatggtagttgggtaattgtgtcatccaaattttggaggtatcagtttcctcatttgtaaaattagagttagtagatgtaaactttttcttacaaactattaacttttgcttttctgttccatttcacacatcaatatttattgagtcttacttagaactcctgtgtataaaatagaatagtacttaatatttaggttgttcttagatatgggttttttcataacacttatatgaccttctatctaacttatctgtaagtatcataagggcaataattattgtttttttgctcattgatttatttcaagcacttttacatatagtaaacactcaacatttgtcaaataatgattaaatgaaacaatacatgtaaagtgcttagcacagtaattggcacaaagtatttgataaatggtcctataaatggttctgataagtggttttattaacacccacagtgccatctcactaagatagttggaagaagttaggatatttcaaagagaagttggagagtactgaggaccacactgttgttcccaaatatttgaaagagcatcacgttacttttaaagaaaaaaaaacatgggccaagaggcagaaactgcagggagacagttttaaaatttggagtaaggaagacctaacaaaactgctcaaaaatgaaatgaactgatgttcaagtaaatgtcaaattactaaatagccagttaatgtggggataaaaaaaatctaactagaggctataaatttagtattccatgaattaaatgatatggaaagaactctatgtttatcatatacaaaatagattttaaaatacccaaaatataaaattttgcaatgcttctggaaataaaatcatacatggaaaatggcaaatattataaaagccaatctatttacttagtgtacatgggatcaaagaacatttgctttttggcaaatacaccatatgactgaaaacaaatgctgctgatttttcttattaatgctggcaaatggagcagataggaatcgtggaattctttattccctatcagaaaaacagaactacttaaagctagattttttttcttttctgttatttttactgcagtggtaacactgcacttcagaatacagtataagaatattggcagttggcatgtttgtgggttgtatgaaactaactggtacatcattcctgccaactagcgacgattttgacaaaatatatgacattgataaaaaaggaatctcactcaatatcatttttattgaaggatgtgtggcctcataccaaaatagccccatcaatctattgccatcagatcggacagaaaagaattgggtacataaaatggctgtcataaaatgtatcccagctggagctaagtctgatcacagacggtcagttaagcatttggaaaatgaaggaagtacatttcccttaataagccatcaaaagttaataacaagtgacttggctctctatttggggcagaaatcctgagaaagatgcagtggattctaaggtttttgctgttctttacactggctacgtgttaataaaaagatatatggtacataatgttttaaaggtatgcaatgaagaagcagcttccctaccacttataagttccagtgttaccatctcagaagtgcacctcattcacacattcaaaactacgatgttgtcttactaattatgatagttaattttatgtgtctagtgcctgggctatgagtgcccagacattttaacagacattaatctgcctgtgtctgtgagagtgttctggatgaaattaacatttgaagcagtagactgagtaaagcagattgccctctctaatatggatggacttcaaacaatcaactgaagacctgaatagtattaaaaggctaagaggtaatgttttttgcctgatagcatgagatggacatcggtctttttcagtcttcagacttggactgaaacattggctcatcttgaattgcaagcctaccaactttcagactgcaaattaatattatcaactttcatagttctaagacctttggacttggattgaaactacatattggctctcttgggtctttaatcacatgaaccaattccttgtagtaaatatcatatgtgtatatatatatatacacacacacatatgtatatacacacacacacaaatttatacatacacatatatatgtgtgcaggacacatatatgcatattttttattatatatgtatatacttttggttttatttctctggagaatttgactaatacactgattcagccacaacaacagggaatgtgctgagttgtgtcaatcaagtgaattatccagataattaaagtcaatctctgtagaagctggtattttggtatcttgtctagaaacaatgtaggtcaccaggcacctacatttttgtgatataaaataacaagccaattttctaatgctttaaaaatgtgctctgaaagcaatccctcattttcaaacccaaaattctatgattcaacattataaaccaagctcatgtagtcattctcaaaatcagctttaaaagcaactatgagtttgagtcatgtttactttccaagtgaattactcaagcatataaaaatccatttcattaccttacagtcatggtttttaggacttaaagatgcatcatcttcatttgttgattcctgttactattaatcagcacatggcggatctacttattttccatgattttctccaggcacaggtgcgttatgaaatttaagctctatttccactgcacagattaagctttgaaagaattttttatcatacactaaaagctacccttcagtgctgccaaattcctggtattaactccatgtaaattttcttattatcactcacctgcccagaagcagaaattctcccgctagacccaggcgcctcatggccatcagcagacctctcaccgtcatgccctcacagaagcaggccaccacccgggccttgggcaagtgacttgtgagcttcttcagcagcttatcaaagctctgctcccctgcattactgtagattttgtaagagtgggcgatgcaaatcccttccttcgctgacatatctttgaaggcttccatcccactttctccatagttgcctgtgtgaaaacatagataagcagagggatagtgaaatgagagtgttgcattaattgggtataatcagaatgcaggtgttaggagcatgaaagtcattggtatgggacttgcaacctgaagacctgaattttggtttttgctcttttgccgaattgcttattttgggcaaattacaattgaaccacattatatatgcattgatcatttatattttcactgtgatggagagaataatataaaaagtgtaagcaattcatcatccttttatgactcaaaatagctcttattctaaatatgagctgatggaaatatttatctgctatttttttgcattctatctcacttccctttacttctcattaatgacaatttcatcccactgagatttttgtatttaaagatatagtacatataagtaatacatgtagtttatatagtatagatgttgccatataaatattttataaagtattatattatatataatattcagtatattatatacttataatcatgagaatttatggtttggtcttaattgaaaaactgagatccttgcttaagatttagtcttgtcgcaggtgaatgtgtaaacttatgaaaaacatttacagttttatcctatacaaccatggggaagttattgataaggaaaaaaagttcaaagtcttttgcaaaatttggggactaaggacaaatgttagtctttaaaaattaatgaaaaggggattaatattgacagtcagctatatgccaggacacaaggacctttatatatgtgatctaatttagcactcacaataaaatattgatgtagctattatgggctccattcaatacatagatcagaaaacagagcagttaggtccatatttaccttgagttacactagcagtaagtggagggctgaactcattcacagatctaatagcataggttctgctccctctacttgtctaaggctgactcttgggagtctcagaattctaattacatccgcatttctctttcccatttcagagtgacaattctccaattttagatatttttggaacattttaaggctctatattttatacagggctcatattctgaattttcaaaatattagatatataagggggattgctttgaagaatacaagaggctattacaagataaccaagctgtagaacatataaggatgtgactgacttaaaaatcaacttgacctaggaactggaatctcatcaggaggagtagatatcaaattaataaggagcactgtgggcattcagttgcatagggttcactacatgtctataactgcaataaatacaactccacaacaatttgattttgggaaagtcagtttatatatgttagctcactgctccttacaacaactctgtgataaaggttaatgttctcttcccttggctgataaaactgaagttcaaatacagatagtaggtgtcaggatcttagtttgaacacaaatctctgattcctgtcctgatgtgggtgctaccataccacaggtaccttgctgcaaatgaaatctgttaactttgagggtggattttggtgaagttttatctccatgaacaaactgcaaagggcagagcagagcaggtcagcttgaatctcagccaaaaatactggtgggccagctgcatcttttccctccttctccagaattaaaagcaacaagaagcctctgtcatgatggcaggtgggcaatctagttattttgcaattaacaaagtttaaagggcactttctgaaaaatgtgccaaagggcctaaattaccagttttacactaatgtgagtaatctattattctttcatttatttttagctaactctgtttttcaacagactgtcttgcatttcatgttttgatttaaggcagaggcatttgcataaataatttgaaattaggtaagtgattgtgatgtgaatttatcgagaatttcacatcatttatttacttttattctcaatacattcactgttaaacaagaaaagacatctaaaaaattcagattatttagcattttgttcctaacagctttaacactgtttatgtttatataatatgttgtagagaagcagcttgaaatagtggagagaactttgttattagagaaacctgagttcaacttcaatttatatagtctttttaatctcagctttctgaagtaacactgcttaatatccagatattttaatattatatttaatgtatgtaaactatctggtaggtcacctgaacccaattaattgaacctactgaaattataaagaatattctagacagagtttagctactctttactggagcatccaaaacaaaacagtggagaaaatggcactattactgtacactagactaaaaaattaagcttacactagcagaataaagtattattttcccagagcaaatcccaagctgtactctttaaaattaaaaaaggcagggggtatatgaaaaattttcactcaattttgcagtgaatcaaaaactgctctaagaaagaaagtttacttgaaacatttaaataagaaacagttttaacacatgtgtgacataaaaattttacagaatataattttgatttaacaaaagaaatcctttgtaagctgggagacaaagagaatatgtcttccaataaaatggaaaagactgaagtgttgagactttctggtagttgatagaaacactgtattctataattatacattttaaaataatgaaaaaatgcagcaaaaaaaagtctacaggcttctcaaataaaaatagaacacatttcaagtaatatgtagaatgaggaaaaagctaaggaagtaactattactttttccaatagagggaaacaagtaactgagaaagaaagctgtggtataaaatatgaaactaacatgtgacttcattttaaataaatagaagtaagacagaatccatagaacgttcttctttaggtagcagagggtttacaacttggaattatgtggagaaaatgtaatcatagcccaatgtcttcactcgtagctcacgctacttacaggtataacgatgcaaatgtcaatcattgattttcaaccttaagaatccacctatagacaaatggaaaaactcattatgcaataaaatatatttgttatcaacttttacaatgacaattaaagagaaagatgatgaagtctgagaggtagatgcagggaaagttgttgggaagaggaaggccattaaagtcactcactcccaatttggaagtcaagatatacagaaaataaaatgtatgtgattaagggaattatttgatgctaaaataatcaggaggcagctaatgtagtgagataattatattaaaagaaggaataagaagatgtacaaggtaagagataatgtctatagtcatttaaaagtagttactttttaaaaagacatattcatattagagatatggaggtgaaaataaaaggatgaaaaactaaaacactttttttcactttaagctctgctgtactatttgacttttgaaaatatgaaaatatacatttaataaaaaaataaactagcatacttaaaagtcattgaaaggagagagttgatgcagataatttttaaagtaattgtcttctctctgctttatcattttatcctgttttagggataaaattcacagaagttctttatatgctactcttggtggaaatgtaaattagtacacccattaatagaaaacttcacggaagttcctcaacaaaactaaaaacagaattatcatatgataatcacccctacccctggctacctttccagctaattttaactgcactctcatgttcatggcagcattatttacaaaagccaagttatatccatcaacagataaatgaattaaaaaatgtggtgtatatatatatatatatatacacaatgaaatactagtcagcctaaaaaccctaaaaaatgggtttaaaaagaaaaatttctgccatttgcaacatcagcatattattcatttttgtaccgctaatgggacctgttagataactaacacatgttgaataaagaaataaattattgaatgagcagtacaaaataatcaatgtctatttccagattaaaataattgcccaactatgtgaccagcaatcaggattgccatattgtgtctagggggcgtcactctaataagctattataaaatatttcacttaaaacatgaacagagttgcacaataatcaaaatatttaccctgaggaccccagttttttcctcagatcgtaacagattttaataattcaacctcaaatactgtttaaagctagtgctttcactaatactatttgacctgaatttcatcagctgggatctggaagtatctgcctacattgaccctataaagcacacattggaaacaggatttgttaaagagtaactataaaactttcttctgtaacagagactggggaccccaaaagggaagaggtcaggaagggagtaagggttgaaaaattatttattgggtacaatgttcacatctggctgatgggtacactacaagcctcaaatccaacaaagggcaatatacccatgtaacaaacctgcacatgaacaccctggatataaaataaaattaaattaaattaaattataaaataaaaaactttctgctaacctaggaaaaatgttttatttgaactgtatattaaaaggcaccaaatcatactttagtaagtaatttgtaatcataggtaaatgctatttcagatggtacaaattcaatatcattaacaactgtgttacattggccactttaagataaagataataaagtataacagcatagacaaggtgtacctagtgagattttcatttttctggcaaaatagccattaaatatattgtttcaatttatcaatctcgtgtggtagggaaaactatcattagaatcaaaaccaaactattataataatagtaaagatacaagtaattttgttttctttgatacttttctttttttcatagtatctttacttctctttccataaatcagaccctgattcactgcatagaagcttgtatactattttatctatcatctcttatttttcattttcccaaaccctaccaaccactattttttgtttggtactttttactattctctttcatatgtatcacagacaccccacatattctcatttatttatttttactaatgctgttctttctacatggaatacatttttccatgttgtacaaattcaattccctagattcctttaggctggagactacatcttctccatagttccattatttaattacggtatttgtataatctctgtaatttgtaattgctaaaaaagtttataattgtggatccttcacctttataacaaggctgattatactcatgatttatttgatgctgaaaacttggttaaaaatataaacaacgatgctgaattttttcttaggaaacatagctcactttaaataatgtgttttatcatgggatttctaaaatgcctcagagtcaggaaatgagttaaggtactaagtattataataaattaaaatagatttctgtattatatatgttgcctattgcatatattcattatattttggatgtatttacatatccttcttttcaaaactgtgagcccatagagggtagttaatgctttatttaactacatatcatcacatggtaggtacttacgtatttcttgtacagaaaagtagtacagaaaaataggcaaaaaaaattttggaagagtaaatacatttttctaagcagaacaccaagcagatgctaaaagaatgtggaaaatactttttcagaaagtattcacttcaggaaatactaaatctttgcaaagaaaaggaataagtgtaaccttctacaatagaactttattttccatcttagttggtccaaattatcttttcctcacaaggaaattaagattcccaatataaacaattattttaaagtatatttcaagtggctttaactactaatatcctgttgctactgtaaacacagttcattttactgacaactactagtgaagtaaaattttctttccttatgtccttattctatgagctttttactatttaatgttgttgtttttgtttttcttactttttaaacttttttcttaaaagtaaagacacaaacaaacatattaacctaggcctacacaggccaggattgtcaatatcactgcctttcacgtccacttccacatattgcccactggaaggcctttaggggcaataacatgcatgaagctgtcatcccctatgataacaatgccttcttctggaatacctcctgaaagatctgcctgaagctaatttatggtgaattttttaaatgtatataagtagaaaaagtacactctaaaataatgataaaaatatagtatagttaatacataaatcagtaacatggtcatttatcattgttatcaagtatgatgtcctgtatataattgtatgtgcggtatctttgtacaacggacatcacagtaggtttgtttacatttgcatcaccacaaacacatgtgtaatacattctgctatgacatgatgatagctatgacatcactagatgagaggaagtttttagatccatatataatcttatgggaccactgtggcatatgcagtctgtcattaactaaaacatcattatatggcatgtaacttttaatttgttaaaatttgcaagtagggaatgagctaacaacaaagactgattgtgtaacacgcatactgatctttttcactccaatggtctttttcatatctgtatgtgtatagatgatacttaagttgtgcatagtttttcatgattttgaacactgttacaagaaacaaatttcctccatttttgattgttttcatttccataaagtaaaatcctgaaataaaaatgaaatttcttggtcaaaatttgaaatattggtcaaacagtgtaactatttagtattttagcaaacttgctctccaacaagttcccaccaatttatactttgattagaagcatatgagaatgcctgtttctccataccttcaccattactggttattgtcatgttattaaatttttgtcaccatattgcttgaataaatgagagttgttttaattttcaaaaaaataaaaaataaaactcagtcatctctcatgtgagttgtgacattagtctggcatgatatcatcccctaaatatacatataagcagtgtccagtctccacttcgtgtcctttaatgtgaattagaagtgttcatcaagagatcttagcccaaactgcccatattgacagggttgtggcttaaactagtgattaaccaaaatggccaggagtgggaaaagcttgacagtgaagcacctcttcttattttattaacagtttcataaagatgttcttttgtttgatgccatttttcccactacagccatatgtgcaatggatgtggcattctaaactctgtattacactcatttgtttatatttatctcctgttactagacagtgtcctttaatgcagatatttctttcacaacaaaacattgtatatacttatttttatgcaaataaagaaggaagttaaatgatgcaagaaatgtgtatacatatttttatggaaagaaagaaggaagttaaatgatccaagaaatattcctaaaaattcctatataattgagatttaggtgtttaggaacctggacatatgattaatgtgaaagttttaaagccaaaggactggaataaaaagttatcattatcatgcaccttcatcaaggtacctgaattataaatgtcatggatacgaaaactttgttaacaaacagttttccaagttttgaacaatggcccaattatttctcatcctgccctggagtctttctataacacgacccatataccacagcattaagcataaggcatggcattattgaatctcatccaaggtgtttattattggaagtaccagaaggatctcatttagaaaatttgctttagttattactctaggaatggattatgtcgtaacatttgatgaactcttcaacagtaaattaagcagaaaacaaattgctagtataattatgtaacaaatgtagataagttataagtttataactatgcatcgccccactcgtggattttaaactatatgtataaaacattatttaaaggaatactaaccagggctactgaatattgccataaaagtacatgccaagtggtttgctgagtggtatgctgagttggtgaattttcttctggctatcaagtatggagttagagaaagaagtttgatcttaagagcaaaggtacatgttgaccaaataaatttagatatggtagaaaacaggaaatcagattatttaaagaagaatacgtgacagttttaactgccatacatgttgaggacaacaagtttgagtgtcatatttggtttggtagattcctgagccctggaatcgaaagttgattctcaacatgtatctactccctccagcaactctagttcatataactgggttgaatgaactgatacaaacataattgaaagaaaaccaaatttggaaagaaatttttaaatttctgtgaaatagccaagtagaaatgccaagtaggaaattaaataagaacattctggctaagagaatagaagtctgaattggaactatttgggagtcctcagtatatggatagcaacaataatagataaaagtgtaggaagtgaaggaaagagagctctgagttataccctaaagaattcaaatatgtgtgcattaactgagaaggaatagctcacaaagacaatgaagaagaagagaaaccaagataatatattcttatggaaatcaggaaaagaaactgtttttacactcttttttttaaaacactctgttgaaaactaaagtaagatgtgtagtgaaaaaaatccactaattctggcaacatagtagaagatatataggagtaggcttgtgtgaatgggagtaaaaaaagtgaagacaatatatttatacaacttttttgagacacttggcactgaacaagagctaagagtatggtggtgattagaagagaatctggaaactcaagaagttttctttgctcatattaagaaggggttattttaggtaaagtacttagcccagagcatggaacagagtaagcactgaatacaggatttttttataatcatcatcatcaccatcctcaacatttatctagatcctgtaaaattatttggtaaaaggttaataataatatgaacaaattattgcactattcactccaaatgtgttattattaaaaccaaccaacctaatgaagttgctattatttcccacatttctaaagaaggtgttgatgctgaaacaatttgccaaataattgacagctagtaaatagaagagctgaaatttcaaccctcattctgtcaaatttcaaagcccatgctctttgccctccatatattgttactcttaagacactgggtaaaaattgttcaatttagtcctgtggttcttccaaaggcctgctactaaatgtttcatttgaaactaattccaaatactactgaattgaatttgtctcagcaaacataatatttaatatataagtattttgcttaatttccaaaagattacagatgtatgtgatttagcactaaatgattcagtccccatgttgctgatagttggtgtttaaatctcagagcctttctacaaaatacacaacgcttaatcatagcttttctatggacaaagtcctgtaaaataagagggggctcttgaaaatagacataccatattatcttgtattagttacttaactacatcattgctgaagagggagaaacttcagagagaccatagaaaatgacaaaaacagtgattttggtgttaaattttttggaatattccaagcttttattattttttaaaatggtttgagatttccataatgaaaaaatcacttttttaatcttcttaaaaatattggagtcttcctcatttttttcctctggctattcttcctagaggaaaataaaaacttgagacagaagctatgacccagattcccactctaagcttccagaattcaacttctttctgctttctttgtaagctgtcaaattcacagctgaagacttcggtgcatgtctcattaaaagtaattccatttccacagaaaggagaaaactctatacggagctgtgtgtcaatgggtcgggtggatcggtgagttatttattttgcctgttttagctcactagccaccaatgatccttgattctaactggatctaatgacaatgcagaaattctcccatcaccagctgaaggcagaaaatcctctacagcgcagccaaaactcttcatgcttgacagcttttgctgaaaaaaagtcgcttctttgacagcagctccctggcctgccgctaccttctccagtttagatctgtgctgtctgggttctgttgtagccagattccctttggaaggacttggtgtctaaacaaagtactgagaggaggaactcaatttggattcagaaatgagaaggaagaattaaaatgtagtataatggctgcactgtcattgttgccaaattttgagcctcatttaagagtgggtaactatgctgtgttcaggcattagagccttggtgactttcctctataatttagacttgtgctgtccagttaatagccacttgccacattgagatgttcagtgtaaaccacaaaatacatttcaaagacttaatacaaaagaaagaatgcaaaatatcccattaatatgtggattacatgttaaaatgatagaagtttagatatattgggttaaataaaatgtattattaaatttaatatcatttatttttactttttcttaaaattataaatatagctagcattacatttctattagacagtaccactttaggcatgcaaagaaatttagatcctatacatttcagggtagaattcaaacttcttaggatatttaatggcatccaaacttttcatgatctgctgcttgactcttctctccagtctcactgcctgccttttcctgaggcacagcacatgctccagccataacaaaggatatgtagatcaaatacactaggcttttttacatctctaaatttcacacaatctctcttattcctggaatacccttctatttagctaattcctacccatccttcaagagttggctgaaagtgacagaattctctaaattaagtttttattgttgttgttgttgctttttctgagacaaggtttcacccctgtcaccaaggctggagtgcagtggtacaatcacggctcactgcagcctcaactttccaggctcaagtgatcctcccacctcagcctcccggttagctgggactacaggcacacactaccacacccagataatttttgtatttttttgtagagactaaatttctccatgttgcccaggctggtcttgaactcctgggctcaagcaatcccaggaggctttgggaagcctcagcctcccagagtgagtgctgggattacaggcatgagctaccacacctggcccacagttctaaacagatatcttccactgtgctgtcattgctcaactcccctccaatgtcataggatattgtttatgttttattgtaattacatatttgtcttactccataaaagactgtgagacagttaaacaaaggggttaattaccctctttatctcaagggcctaggcaacctaagtatttgttgaataaataaattttagaaaatgagcagcaatttttcataagtaaattactgagcatccactatgaatcattgtgtatagcagcttctgttactgaagctactctgcattcattgtgatataaaagcactaaactgggctaagataagatatattatcaaggacagcacagcttagtcacaagtgccctcgacagagtgaggagacagtgattgaaaatctatttgtttgatttatcacttacatggtttttgggaaatggcttaccttttttatgtaaatttgtctcctcaattacaaaattatatgtattctaagaaaccttagagagtggatttttagacctgcttcctacattgttttgttatatatatattttttctttttgtgactagtttatttcacttagcaaactttattgttttttggggaaatatagtcattttcataaaaacattatttatgttaacatgcagagtaaatgaataacaaacacttaaaaatcctcagttttaaattcaaatagaataaatgtcaatagatatatccactgcatatttctatggtgccaatagttgcattactctaattataaaatttaatgtttgtctttttactatatggtgactagtgtgacaaggactgtgtagtattgatattgtatctacagggaagattttattttttcattttttttaagttctgggacacatgtgcaggatgtgcaggtttgttacataggtaaacctgtgccatgggtatttgctgcacctatcaactcatcacctaggtattaagcccagcatgcattagctatttttcctgatgctcttcctaattatcatcagagcaaacagaccatctacagaatagggaaaaatgtttacaatctatccatctgacaatggtctaatatccagagtctacatgaaacttaaataaatttacaagaaaaaaacaaccctattaaaaagtgggcaaaggccatgaacaaacacttctcaaaagaagatatttatgcagccaacaaagatatgaaaaaaagctcaacatcactgatcattagagaaatgcaaatcaaaaccacaatgagacaccaattcatgccagtcagatggtgatttttaaaaagtaaagaaataacagatgctggtgaggttgtggagaaatgggaacacgtttacactcttggtgggaatgtaaattatttcaaccattgtagaagatagtatggcaattcctcaaaggtctagagtcgaaatgtcatttgacccagcaatcccattactgagtatatacccaaaggaatataaatcattctattataaatatacaagcatgtgtatgttcattgcagcactattcacaatagtaaagacatggaatcaacccaaatgtccatcaatgatagaccagatttaaaaaaaaatgatacatatacaccatggaatattatgcagctataaaaatgaatgagatcatgtcctttgcagggacatggactaagctggaagccattatccttagcaaatgaattgggaaacagaaaaccaaacaccacatgttctcacttataagtgggagctgaatgatgagaacacatgaacacagggaggggaacaacacactcatatatattatgttgaccacatagacagtagagctgaaaatagcctaaagagcataaaaaactgtaaaatatgttaaaaggaattatgtttaattagaattgtctgatatttaacttttatttttttatagcttaattattgtttatagaatttaatttttaataatggctgtgtttaacaagagacacttaaaaatttaacatttctcttacaattgcctagatgagctggttccagcacaacactggactatgccaataaaatatcctaaaattcttctagtcaatgatctctgtcatattttcagttactccatgactttgaagggaccactgacttaactggctataatagagactccctttttataaagatccagtacaataaaggtgaacgtttaatgatgtagaatggaaaatactgtcatttctgttttgctgtactaggaaaaggtctgttcataaagtataatttaaatgtgaccctgcagaaggagttgactttggcattctagatggagtaaacagagcataggcaggttaaagtgggtagtatgtggtcaaaatccagtctgcctacagttgaggctatatgatgggagggcaagtaggctaagattacaagggggaggcccaaacttgatacataaagaggtgcaatagaagaggtttctgaaggcaggtaacatgaattaaactgcaagtaagactacactggcaataataggttaagagagtacagtggcgctccagaaggatacaatagagtattacaatgacagagtttaaaatgaacaaaggtgtattcttaggtattttattccctttgtagcaattgtgaatgggagttcactcatgatttggctctctgtttgtctattattgttgtgtaggaatgcttgtgatttttgcacattgattttgtatcttgagactttgctgaagttgcttattagcataaggagattttgggctgagatgatagggtttactaaaaatacaatcatgtcaactgcaaagagacaatttgacttcctttcttcttatgtgaatgccctttctttctttctcttggctgattaccctggccagaacttccaatactatgttaaatatggtgagagagggcatccttgtcttgtgcaggatttcaaatggaatgttgccagtttttgaccattaagtatgatattggctgtgggtttctcataaatagctctcattattttgagatactttccatcaatacctagtttattgagagtttttagcgtaaaggggtgttgaatttcatcgaaggccttttctgcatctattgagatagtcatgtggtttttgtcattggttttatttatgtgatggattacatttattgatttgcatatgttgaaccagccttacaagggatgtgagggaactcttcaaggagaactacaaaccactgctcaaacaaataagagaggacacaaataggaaaacattccatgctcatgaataagaagaatcaatactgtgaaaatggccatactgcccaaagtaatttgtagattcaatgctatccccatcaagctatagtaaccaaaacagcatggtactcatatcaaaacaaatatatatagaccaatggaacagaacagaggcctcagaaataacaccacaaatctgcaaccacctgatgtttgacaaacctgacaaaaacaagcaatggggaaaggatcccctatttaataaatggtgttgggaaaactggctagccttatgcagaaaacgaaaactggatcctttccttacaccttttacaaaaattaattcaagatggattaaagacttaaaagtaatacctaaaaccataaaaactctagaagaaaacctaggcaataccattcaggacataggcatgggcaaagacttcatgactaaaacaccaaaagcaatggcaacaaaagacaaaattgacaaatgggatctaatcaaactaaagaccttctgcacagcaaaagaaattagcatcagagtgaaaaggcaacctacagaatgggagaaaagttttgcaatctatccatctgacaaaggactaatatcgagaatctacaaggaacttaaacaaattacaagaaaaaaaaacaaccccatgaaaaagtgggtgaaggatatgaacagacatttcgcaaaagaagacatttatgcagccaacaaacatatgaaaaaaactcatcgtcactggtcgttagggtaatgcaaatcaaaaccacaatgagatgccatctcaggccagttagaatggtgatcattaaaaagtcaggaaacaacagaagctggagaggatgtggagaaataggaacacttttacactgttggtggaagtgtaaattagttcaaccattgtggaagacagtgtggcgattcctcaaggatctagaaccagaaataccatttaatccagcaatcccattactgagtatatacccaaaagattataaatcatcctactataaagacacattcacacatatgttgcagcactattcacaatatcaaagacttggaaccaatccaaatgtccatcagtgatagactggataaagaaaatgtggcacttatataccatggaatactatgcagccataaaaaaggatgagttcatgtcctttgcaggcacatggatgaagctggaaaccatcattctcagcaaactaacataggaacagaaaaccaaacactgcatgttctcgctcataaatgggagttgaacaatgagaacacatagacacagggaggggatcaccacacactggggcctgtcaggggattggggtctagggatggatagcattaggagaaatacctaatgtagatgacaggttgatggttgcagcagactaccatggcatgtgtatacctatgtaacaaacctgcacattctgcacatgtatcccagaatttagagtataataaaaaataaatacataaaaataaaagcacataaaatgaacaaaggcctgattttggatgtttaccatgaaatgaagcattgacaatatgcaaggccactttttaacataatttgttagagtttgacattctcctggaatacaaagtaaataatgatctttggaattatgctatacaatcttggcttttgttgcctttgctgttggtgctttagtcatgaagtctttgcccatgcctatgtcctgaatggtattgcctaggttttcgtctagagtttttatggttttaggtattagtttaagtctttaatccatcatgaattaatttctgtaaaaggtgtaaggaagggatccagttttagttttctgcataaggctagccagttttcccaatgccatttattaaatagggaatcctctccccattgcttgtttttgtcaggtttgtcaaagatcaggtggttgtaggtttgtggtgttatttctgaggcctctattctgttccactggtctatatatttgttttgatatgagtaccacgctgttttggttactgtagccttgtcgtatagcttaaagtcaggtggcgtgatgcctccagcgttgttctttttgcttaggattgtcttggccctacaggctcttttttggttccatatgaaatttaaagtagttttttttctaattctatgaataaagtcaatggtagcttgatggggatagcattaaatctacaaattactggcaaactgttacttcatttggggttgaatatgagaaaattcaagaagcttagtttagaggctaatgtagtaaggagtccagatgagaaacaacagtaacttgaaagaaagtgatgaaagcaaagactataccatacataggctgttcagttttaggatgttttattgcgtcttttttcataagaagtttatattaacttcttagtgtcatgtcagagcactgctggcttttgttataggccaaactgtgtcttatagaaaattcctatgttgtaatcctaaccccaagtacctcagaatgtgactgtgtttgtatacaaggtctttaaaaaggaaactaaggcaaaaaaatcatatgggtggtccctaatctagctgaatggggtccttataggaagagattaagaaatagacatgcacattatcgtgtgaagatgcaaggagaagatggcatctacaagccaaggagacagatcctcagaaggaacacagcctattgagaccttgttcttggacttccagcctctaaactataaggaaatacatttctgttgtttacgaaccactgagtctattggtttgttgttatagtatctcaagctaactaatatagtcctctgcagctgaccaaaactttcagtcacaaaaagtacccaaatccttaggctacatgaaattaattttattgtcatagagatcataatacttggaaagggcattggcctttgccatatatagactgagtttgattcctgtatccacaatttcctagatacatgaccttagacaagttatttaaatgtctctgagcttcagtttctttaatcatatcagatatagtaggccaatcaccagaccaaagtctggcacaggatagacactcaacaaaatttagtttctgtcttagctctcataatttcttcttctcagtaggcaatcataaagagctcttatgagaatggctctgaaattagatgaaatttgaacttcacttgaattaatcaaagctgatttcaaatcccggctctgacatctactagtttggatgtttgagcaagttattaatctttctaagtcttttttttctcatctataacattttcataaggtggttatgaggattaaatgcgattttgcatggaaagtgcttatatcagagcctgacatataaataaggctagagtagtattttttaatattaattacacacatttttatgagttcttattttgctactaacttcttagttgttggtgtttgtcacaactatgacacattcctgaatgaaaaccatctattctccatgtttcactaatacctatggctcctaacttatattctcagttagatacctggcaaatgttaattcaactattgccaagcattctttctagaaatttaaaactaaaactgctcattagatatgcactgagtattcagtagtttttccaaagtaacagcgtcttagtacttcttaaaaacatggtccttgtctctattgcctatgtgggcacctcacaaagcaaattggaacagatataacccctgtaatcagggatcttaatagctaaagcaccttgattggattcccctagtgttttaacaaaatcacttatggtctaattctcctgtcctcattttgctgctgatgaaatcccacgatagtaccaaagtattggcttttttcaactctgctgcactaatgtctgctgttttccttccacactaatcctttaatcatacctttgagataccagaatgtaaaaaccacttgggattacctaacacacaggaatagcaagttttgctctgaagcagatggaagcagccaatgtggctcctttttttcctttaatctcaagatatctgtaattctgcccaagcctccaggggacacttctggctaagaaaaatcctggaaatggaagtcctatctattcctatttcactgaaagggtgaatcacttttagaaacatttcaaggactcaggattacactgggtcatgagtttatgaaattgtgtaggtagctatggaaaaaaggaaataatcatggatatgctttaattttaattaaaaactcattattattgatacaaaaaatggtacctgtccagtttccaagaactccagcaatgcaatgactgttcataatcccttttcctggaaatagatccctgtttctctgtttatttgatgtgtgtacatgatccactttacttaataaattgtaaggcataaatttttaaaagtgttataataatttatattaataaagtataattttattttagatttataactcttcaacccccaacctcagttattggcttaaaggactgagatgttacctaaactgctcatcgggccttttgcttatgtttttcaaactcaagctaatagagaatcactttattccttgaaaaatatttttattctcttcaaaaatgtgagccaacagcagtcattagtcatggttccaacctcatgaagaaatgaaaagagagaacaatgcctctataaaaaagaggggaaattaataggtgtaaggaggtaaatctgtcagtataaaatccctggttatatttttttagtggcccctactatatccctgttttttcacaattacataaacaagtagattctttttgcttgattttaatttccataacttacagtgatagcatcctgtctttctaatagaagtaagaaaaaatataagggaagaaataattctagggagaggttagaactttagttaggccacaaagaacgggtagaaaagaagaaatacttcactatatgagaggatattctagatatgggacagagctttatagggagtggagtgacagatatggacataaagtatgtttttggttgtcattagatttttctgaatcatagggcccatatgggtgaacaatgggagaaagcactaaaataaagagaagtccccaagacagacagagttgcaacctagtaatacactaggcaatgcagatagtttatgtctcaagcatgaaagttatagaatgaaaataatatttaaaaatatttttctggcaaaggttcataagggtgactggaggcaaaaatggtgtgtgagagagatccattgagaagctactgaaaaaaatccaattgtgacatgacaagaactttaataggtcacagacaacagaaagcaaagaaagagttaatcataaagccacttctacaaagaaatcatggtgtttggtaccatattttgtctagggctaagtaatgcataaaaagaaagaattaagaatgatttcatagtttgtagtctgatagaccaactaacagataggatagccaggcagtagaagctgatgtttgaaagggaatcttgtgttccattgtggacacatggattaccacaaggaatctacaaaacgacattttggactcaaaaattaacctaataatggagctctcatgagaggtctgggcagtgggggatatgggtgtacgtgtaaaaatgagaggtaaagccaagaaactgagtgaagagaaagaacagagagcttacgccagagcttttgctcagaattaaataaacgattaaagggaagaaaggttgtttgaaaataataataataatagattgaatactcccactcaatacaaagaaatgctaaatgtttggatggtggatatgctaaattagtgtgatgtgaccactgtacattatatgtatgaaaacaccactatgtactccatgaatacgtacaattattattgtcagttaaaaataaaatttaaaaatgttgaaaaaatgtatcaatgacatctaacattattgagagttagagttgggtaagcttttatgcacataatctcaatgaatgttcaaaacaacccagtgagactggaatgaaatattatcctcatttcccagatgaagaaactacagcagagagattaaacaacttactcaaggtcaaataactattaaagggacacagaataagaacttaaaatcagttctaatatcaaagcttaggtatttatacacaagcctgttcaacctactgcaggaaagaaaagaggtcactggaaatagaggagacctacatgcatctaagaaagatgatgattccagaatggaaaggtgccctatagtgttaaatgccataatgcaaataaagataactaggactgaaagaaggcagcaagacatggtggttagtaacctgtagcagcactgtcttagtgaagcagtagagcataaatcagacttgagtgcaaagtttggatgaagaataggaggtaaaaagagtatttatggaatgcaaattctagtatatggaaatgaaagaaaggagagaatccatctaagccaggtaaatccacattagcaaggaagaccctagcatattaaggaagtttttattcatgtaatattttcattcttcagagttatttaaaatactgtgtgtactgaaaaggaatttataggtgttgaacaaattgctgtaatttcaaactacataacttattaaagttatttactagactcttaaatatcttgtaatcccataacaaaaaggagataataggttagaaataattataccctataaacagatgaaaaaaaaagttcaatagaattcattaacatactgaaggtcacaaaattaataaatgttaggaaaaaaaacaggctgctgaattttatcaagtactgtttccattatatcacacagaaacctgtaaatctaattatcattcaactaacagaaaaacctacatttttagtgagaaacaaaatgagatggacagagaggaacaaattaacattattaagcattgttaaggtattcctggaaatttttgtgagactaatgaaagctacatgtttcagaagatatcatattatcataaatgcacagagtaatgaaatataaaattaatcaccaaggaagaagcatattaagatgcaggaaacaaggcactaacacagtgtaataagataaattcaatcatctaaaaattataatacaaagaagtgatgcaaattagtaatcatttaaattttacattttattaaagtgagccttctaaaagataaattcattataacttaaggtgaggctgcaattatttctccttcaagacctttatatttttatatattagctattattattaagagataggcaatatttaaaaatatataaattgtgagggaggcagaagaagatggcaaatagaaagctacaaagatcttccctctcccactgcaaggaagggatgaaaaatatatttcacacaaatagaaactagaataagagattttaataaacagacctgaatcactgacaccaccccttcctcaccctggcagtgacagagagcatctctgggaatttagagagggaaaacacagcaattgtgaggtattgaataaaaaacaaggaatcaaagcatattactagaaaaaatcacttaatcacaaagaacaaatgtaaaagaagaaatgaaaaaaggatcaacaaatcaactggaaaacaagtaacaaaatgacagtagtaaccccttacctatcatttaccttatatgtaaatgaaattcttcaatcaaaataaaacagaaaggctgaatgaattaaaaaaaaaaagacccaactatatgctcatacaagaaactcatttcatctataaagatacacgaagactgaaagtgaagtaaggaatgaaaaagatattccacacaaatggaaactaaaataaagcaggagtagctatacttacattaggcaaaatagagcttaagccaaaaactgtagaaagataaagacactcacaatgataaaagagtcaatagagcaacaggatataacaaatataaatatacatgcactcaacataggagtgcctaaatatataaagaaaacattaatagacttaaagaaagagattgcactgcagtacaataatagcggtgggtttcaacaccccacttttagcaatagacagatcatccagatatagtgaaatatagtttatttacatagttaagccacactgtagaccaaataaacctaataaatgtttacagaaatattcacgtaacagcctcagaatatgtatttttctcagcagcacatggaacattctccaggatagaccatatgtgaagtaaaaaaaatactcttatcacatttaaaaatgttaaaattatatcagataacttttctaaccaaaatataataaaactaggaatcaataacatgaagaaccttgggaaatgtacaaataaatgaaaattaaacaacatgctcctgggcaactaatgagtaatgaagaaattgtgaagaaacatttttgaagaatattgatacaaatgaaaatggaaacccaacataccaaatcctatgggatgttgaaaaagaagttacaataggaaagtttatagcaaaaacacttatatcagaaatgtagaaagattccaaagaaataagcaaaagttgcatttctaaaacctagaaaaatgagaacaaaataaaccccaaactagtaacagagtgaagaaataataaagatcagagcataaacagaacatagactaaaaataaacataccacagaaatacaaaggatcattacagactcttataaacaactatacccctaacaaattagaaaacctagaataaatggataaatttatggatatgtacaacctaccaagattgaataatgaagacacagaaaaactgaacacctgaacagaccagtaatgagcaatgatattgattcagaaaggaaagttcaacactggatatattcactgccaaataattctatcaagcttttaaagaaagaaataataccaatctttctgagatgatttaaaaaaaaaggaagtacaaggaatccttgtaaattcatgcttgcatggtatttgcataaaaaacagacatatagatcaatggaacagaatagagaacccagaaataaatccatgcatttccagccaattgctttttgacaaagtatcagaacacacattagggaagggacagtctccttaataaagggtgatgataaaactggatactcatatgttgaagaatgacactataaccgtatctcttatcacttacaaaaatcaactcaaattggattaaagacttaaatgtaagacctgaaactatgagatactagaagaaaacacaggaaaaaaatgctttatgacgtggatctgaacaaaggtttttgcaataaaacctgaaaagcagaggcaacaaaataaaaagtaaacaaataagagaattatatcaaactaaaaagcttctgcacagcaaaggaaaaaatcaagagtgaagagacaacctgcagaatgggagaatatatttgcaaactatgcacctgaaaaggggttaatattaagaatatataggtatacaagggaaatattgctgttttgatttcagaccattacaataaagcaaatatcacagtaaagtgagtcacaaaattttttgcttttccagtgcatataaaagttataataccacactgtagtttatgaagtgtgctataacattaggtttaaaaaatggacatactttaattttaaaatatgctgaaacatgctaatgaatatctgtgccttcagcaaggcataatgtttttgctgatagaggatcttgtcttgatactgatggctactgattgatcagggcggtggctgctgaatgtttgggtggctgtggcaatttcttaaaataacaatgaagtctgccacatgaattgactgttttttttttttcatgaaagatttcttggtagcatataatgctgttggataacattgtgcccacagtagaactgcttttaaaattggagtcaatacactaaaaccctgctgctgctttattaactagatttaggtaattttctaaatcattctcatttcatcaaggctcacagcatctttgctgtagcagattccatctcaaaaaagcacattctttgcttatctattagaagcaacttctcatccactcaagttttaccataagattgtataaattcacattgtgaggctcaccttctaactctggttctcttactcttctaccacatctgtagttaattcttctacttgaagtcttgaacccctcaaaatcatccatgagggttggaatcaactttttccaaattcctgttaatattgatattctgacccactcccatgaatcactaatgttattaatggtaattaaaatgttgaatcctttcccagagattttcaatttactttgcatagattaatctgaagaatcacaatctgtggcagctatagcattatgaaatatatttctgaagtaataagaattgaaatccaaaatttctccctgatccatgagcttcaggatagatgttgtcttagcaggcatgaaaacaacattaatctccttataatttttcatcagagctcttgggtgcattgtcataaagcagtaatattttgaaaggaagcttttcttcttaagagtagttcttaactgtgggcttaaaatattcagcagagcattctataaacagatatgctgtcatccaggctttgctgttccatttttagagcacaggcagagtagatttagcatagctcttaagggccttggggtttttggaacaataaaagaacactggcttcaacttaaggtcaccagccgcattatctctaacaagagagtcagccgtcctttgaagccttgaagcaggcactcacctctcctctctaggatggaagtcttagatagcatcttcttccaatacaagtctgctttgtctacattgaaactgtattgtttcgtgtaaccacctttatcaattatcttatatctggatgacttgctgcaacctctacaatagtatttgctactttaccttgcacttttaggttatagagatggctactttccttacactccattaaccaaactctgctagctgcaatctttccttctgaagcttcctcaccattctcagccttgagccagttgaaaagattcaaggccttgctattaattagactttggcttaagtgaatgtggtggctggtttgatccaggccactaaaactttctctgtatctgcaataaggctatatcagattcttataatttgtgtgttcactggagtagcatttttaaatttttcttcaaaaattttttatttgcattcacaacttgactaagtggcacaaaaggcctagactggttagtgtatcggggcttttgacacaccttcctcattaagcttaatcatttctagctttcatttaaagtgagaggcatgtgactctttcttccagttgaaaatttagaggccattgtagatgattaattggcctaacttcaatattgttctgtctctgacaacagggaagccccaaggagcaggacacaaaagggagagtggcccattggtggagcagtcagaacacaaacgtttattgattaagttcaccaacatagataggcatgatttgggattccctaaacacagataaaaaatgtggtatataaacacaatggagtactactcagccataaaaaaagaatgaaatggtgttatttgtgacagcatggatgaaactggaagacattatgttaagttaaagaagtcacgcacctaaggcctaataatgcatgataccaatcataattggaatcttaacaagttgagctcattgaagtagagagtaggatagtggttaccagatgctggaaagagtagcagggaagaggggaggggagaagtcagtcaaatggaacaaaattacagttagataggaggaatgagttctggtgttttattgcacagtagtgtgactatagccaagaataaggtattatatacttcaaagtagcaagaagagatgattttgacaagtatttgaggtgaataatatgctaattaccctggtaaattagcacatgaaaatatttccatcattagacattagaagaatgcaaattagaaacaattagataatttcacacaagtattagaaagactacagtgaaaaaaagaaactaaatgctggcaaagatgtgaagcaagggcgactcatacattattggtgagaatatgaaatggtatagatatttggggaagagaaatatttatctttttcattaagcagtttattattattattattaaggcagtttatcattaagaaatataacatatcaacctggcccagtggctcatgactgtaatcccagcactttgggaggccaaagcagatgtatggatgtatggcttgggcacaggaatttgagaccagcctgggcaacatggcaaaaccctgtttctacaaaaaaaatatgaaaattagctgggcatggtggcacatgcctgtagtctcagctacttggaacttgggaggctgaggtaggaggatcacttgagccctggaagcagagattgcaatgagccaatatgctgctgctgcactttagcctaggcaacagagagactctgtggaagaaaaaaaaaaaagcagaaagaaagaaagaaagaagtaaagagggagggacagcattgggagagatatctaatgctagatgacgagttagtgggtgcagcgcaccagcatggcacatgtatacatatgtaactaacctgcacattgtgctcatgtaccctaaaacttaaagtataataataaaaaaagaaggaaagaaagagaaggaaagtaaaatataccatatgactcagcaatcttattgtaatcatccaagagaaatagcaatttatgttcacagaaaatctacacaaggtttatttatttactccaggtatataaaattgccaaatttggaaaaagcaaaaaagcacagatgttcttcgataggtgaattattaagcagaacaccatgcaccagttgccaatccctggagaagactccaaatatttctgcccattgcattttggtattgcagttatcatgggaatcacaacacagtcaagcactggatggaacaactctttattcacatagagaggaaacagagaaaaattcattctgagagtatttttcaataccccatggccagggggtctctcccagcaatgaatgcagggtaattgtccatgcacactccttgagtaccacagaaggtccctattccctccccacagtggagctggccaagtgccaagggatacacttgcttaaacagaacaaagggacatatactaggctggcaacggagaaagatattctcacacaaggcaataggccctgcacaggtggtgtgcactctttttatcttggtaagaaagtattccaggcccaaaatccattaggtggctaagtaggagaaagactgtactcatgagactgtcttttccaacatgaatgaattaacgaagtgtagttcatccatacaatggaatactcatcatcaataaagagaaacaaactagtagttcatgcaatggcttggaaaaattccaaatgtattatgctaagagaaagaaattagactcaaaaggtttcatactgtatcattccatttagggctttctggaaaagacaaaactataggaataaaaatcagatcagcaattgcagaagataaaagagactggcacaaattacgtttaggcaatttggcggaggggttgatgaaaattttctgtacctagttctggtgataaaaatgtgtatatttgtcaaaagcaataaagagagaattttttcaaaaagtggattttgttgtatataaatttagatgtcagttataggataagaaatactatggaaattgtaaataaaatataaaatgtgaggaaaaattttgtataaatatttaactgagaaggactctaaatataaatgtaataaaaggggttatgagtgcaaattgaatagattaaatagattaaaatgtaacattttcctctcttaaaaataacaaactgggaggaagtatctggtaatcacagatctgacttgtatccagaatatagaaagtaatcttagtactcaacaacaagaaaataaacaattcaattttttacattgggaaaattttaaatagagataccataaaagagcttaagtctttaagttagatattaatattatattaataattaataaaaaatggcaatgctagtagaaaaatgaataatggacaatagcaaatttcaaaagagaaatttagagtaataaataaatgtaagaaaaatacacacattaaaaaagctggtgagaaatctacctgtaaccagtctccttccctttctttattttataatgtcagccatatgtttccaagattttcatcacctttctgtatttatatgagcatatttttccttgattaatatgaaataattcctgagtaaatattttttacctgtttattttatctaactttcatctaccttggtagatgaaatgatcagtatggcaagcattatcagataatctgcttttagtactatgaggctctcagcagattgcctatagagctgaaatcacagctctttctttgcagcaaattttcagtctttattaaatattacttaatatttccattaggatggaaggtggggtgggaggaaacaaaactaaacactagccttattatagagaaatagatgcatgtatttaatgaataaaatgaataagcctttaatgaagtggtttgggtacacagggaatttctggagaaatgcttgagatttcaatatgaaagactggagaggagatggtatgagaattttgacatgagccagccaagtcttagacaagaatagaagcatcttttgctaggcatgaaatagacagcatgcaatttttggctgtttgattgccaacaaagaacgctatgaggcagggaagagagagaaaaggagcatgaaataaaggaaaaagaaggtcttaacagaaacaaaaatgtgaagagcaagcaatgcgtaaatattaggtagagcacatgaataaataaaatggaattgcaaatatgcattgaagagattatggcaataggaaaaaagtgagtaaaaactgtacattttgtatatttctctaactcatattattcattcattctaccaatatgtattagtcagctcttttgtgaataggaccccaaattggcatagttctatataagaataacatacactgaattaaccttataaaaagccttccttatatttacatttaaacaacaaccctggaatacaattctttcctcattttaaatttgaaatttctgaattactttaaagttatttctgagcaagaacttggtaggaggtctcctgaccctggtccattgtgtttcccacaaaaccatttgacttatatcatgacaagacatgtggcttcaaaaatttgttatcctatcgggaaatcttaagcaaatagaatgttttaaaggaagcaagatttactgacaaaggagaggtacgaacaattaagtgtgttgggaagtgtctagactttaaagtcttattggattgggttcaattctatttctgcacatactatttgtgtaactttacacaaattactttaacactcagtgtactgtctggggaaaaaattgcaatacctatcttatagaattgttgtgaaattaaatagttaatataggtcaagaaggacacaacactgaccctaaataaatgacaggaattatggtaaaaggtaataacattgtatattacagaagtccaggaaagcctaaatgaaggtggtgttttctttgatcccttagtaggatttatatagtcaggggaaggacattaagtgacatgtatttttcagtgtaagcttcaaatttaaaaaaaaaatattattaaaaataagactgtgttaactccatctcattttcttttaaaggaatcctcttaaaaactttaatttttaatggatttgagactttaaaagtttgagactgtcataatgattttaaacaatttctttaaaaatgttaccatgctcaaccataataggcctaaaaaaaaaaaaactgtcaccttgatttcttcaactatgatgatcaacaagagatgaacttgatggatttaataactgtagaaagttacttggcagagggcaaaagataaacatcttctgcgataaaataatgatattaaactataagatatcaaaagaatctgaaaacttaaaaagcaagttagtttggtttcagttatatggaatagcaagcaagcacgtatttattttctcttcactagaagaaaagcagtaactcttcaaaaagatgaaaccgagttcaagtataaatggagactgtagtaacaaaggatgaaaaccatgtgaactcagttctcttagacttttctagttctcatttaaatagtggccatttgttttgctcttgctaacttcagcttcaatactccaatttcctatgggagactttcaggttttgtgaaacacaaaacagaaaaaaaaatccttattgttctgtgaaaattacaaactaattatttaaaaattttgaatacaaatcatatcctacttaagaaagaatccaatggcataataagtacttatataaaactgaggctttggagttcttagaaatttttcattttctatacaaaatacaaatcagaattgatggaatgctgggcacgttggctcacacctgtaattccagcaccttgggatgccaaggtgggcagatcacttgagctcaggactttgagaccagcctggtcaacacagggaaaccccatctctactaaatatacacaattagctgggtggggtagcatctgtaatcccagctatgcaggaggctgaggaaagagaatcgcttgaacccaggaggtggaggttgccatgagctaagattctgccactgcactccagcctgaacaacagagtgacactctgaatcaaaataagtaagtaaataaataaataaataaataataaaaagaaaaatatcatgcctgtaatcccagcactttgggaggccaaggcgggtagatcacgaggtcaggagatcgagaccatcctggctaacacggtgaaaccccatctctactaaaaatacaaaaaaaaaaaaaaaattagctgggcgtggtggcatgtacctgtagtcccagctactcgggaggctggggcaggagaatggcatgaacccaggaggtggagctcgcagtgagccgagatagtgccactgcagtccggtctgggcaaaagagcgagactctgtctcaaaaaaaaaaaaaagaattgatagaatgaaattcacctctcattcagccccttgtaaaattgtgtggagactacaatttatttattatattaataaatatgtcaggctatcaatagctaataatttcaataatttcattgaattcaagatcaaacagctgatgttatgtttattattattattaattatttgtatttccatatgacaaggtttggctgtgttcccacccaaatctcaaattgtagcccaaataattcccacgtgtcatgggaaggacccagtgggaggtaactgaatcatgagggtgggtctttcccatgcttctcatgaccgtgaataagtctcacaagatctgatggttttgtaaaggggagtttccctgcctatgctctctctcctgcctgccaacacgtaagacatgactttgctcctcttatgccttctgctatgatttttgaggcctccccagccacatgcaactgtgaatccattaaacctctttcctttatagattaaccagtcttgggtatgtctttaatagcagtgtgagaacagactaatacagtaaactggtactggttgagtgaggtacttctgtaaagataccccaaaatgtggaagcaactttggaagtgactaactgggagacaatggaacagtttggatggctcagaagaggacagaaagatgtgggaaagtttggaacttcctaaagacttgttgaatggctttgaccaaaatgctgatcatgatatggacaatgaagtcccattcaggtgatctcagatgtagatgaggaacttgttgggaactaggtcactctttctatgcaaaaagactgtgggcattttgtccctgctttagagatctgtggaactttcaacttgagagagataatttggggtatctggtggaagaaatttctaagcagcaaagaattcaagaggtgacagggcataaaagtttggaaaattttcagcctgatgatgcagtaggaaagaaaaaccaattttctggggagaaattcaaaccagctgaagaaatttgcataagtaacaagaagtcaaatactaatcaccaagacagtggggaaaatgtctccagggcatatcagagaccatcatggcagtccctcccatcacaggcctggaggcttaggaggaaaaaaatggtttaatgggcagaccccagggcccacttgctgtaggcggcctcaggacatggtgccttgcatcccagctgtttcatctgcagccccaagccttggcaacttacacatggtgttgggactgtgggtgcacagaagtcaagaattgaggtttggaaacttccatatacattttaaaggatgtatggaaatgcctgagtgtccaggcagaagtttgctatggggtcagggccctcatggagaacctctgctacagcactatggaagggaaatgtgggactggaggccccacacagagtccccactagggcactgcctagtggaattgtgagaagaaggccactgtcctccagaaacccagaatggtagatacacctatagcttgcactgtatgcctggaaaagccacagatactcaatgccagctcatgacaagagctggagccctacactgcaaagtcacaggggcagagttgccccaagacataggaacccacctcttgcatcagcatgacttggatgtgagacatggagtcaagggagatcattttcgaactttaatgactgttctattggattttggacttgcatggagcctgaagcccctttgttttggccaatttcttccattttgaatgtgtatatatacccaatgcctgtaccccactgtgtctaggaagtaagtaacttgcttttgattttacaggctcataggaggaaggaacatgccttgtctcagatgagactttggactgtgggctttttagttaatgctgaaatgagttaaaccttttggggactgttgggaaagtatgattgtgttttgaaatgtgaaagggacatgagacttgggaggggtaagaggtagaatgacacagtttggctgtgtctctacccaaatcttgaatgatagctcccataattcccatgtgtcatgagagggacccagtgggaggtaactgaatgatgagggtgggtcttccctatgctattcttgcggtagtgaataaatcttatgagagctgatggttttataaaggggagttcccctgcacatgctctctctcttgcctgctgccacataagacatgactttgctcctcctctgctttccgccatgattctgaggcctccccagccatgtggatttgtgagttcattaaacctttttccttataaattacccagtcttggatatgtctttattaccagcatgagatcagactaatataccatatttgtccttaaaattgaataatatttccacatttcaaaatttccacattactgccttaactgaattactcattcctaagatctgaaaagaagccattttttaaaataatattttatttatatatgtttataaatgtttctgaatttatatatattataaaatgaggtacatcccattcttgttttatcctattttttaggctctagtttaaatcagtttaaatatataattgttatgttttagatcttccatctactgaaccacaactcaatgtgcagaaaggaaaaaaatacaaaccaagattaaatcctctgaagcatatgttttataaagacacaagtggcaactcaataaaagtattatgattattccacttaaatttcattataattagaaatccttctatagaaaaatccattgagaactttgatttttaaattacagtcatcattagtaaaatttctgaattctatagtaggtaccatgttttttttttttttttttttttttttttttttttttggtaaaccagctgtgtttgaagctgggagttaggggactttagaaaggtatttaaatagtacagtatccctccttaaaaagtttttcagctccagtaagagaaacaaattaatatataaataaggtttccacagataacctgcctttaaaacaaaccaaaccaaagaggcaatatgcagttctcataaaaaaaaatctccagtctctttgatatagaagttaaaaagaaatcacttagggagatagcaagggtttgggaatcctcagtcacactttttacctcatgaaaagcagccccaaatcatttactaacaaagagcagcctggaaagttgagctgcagaggtagacaagtgagctgagagcttgcacaggtgaatgttggcaggaactgaggactagacattttcaagatggcagctccattcttcccttctctgccagccatgtatactgtaaagagcagacgagatggtgccgatcaactggaaagcctatttgcataataagattaaggtggggtgaccagccttctctgcactctatgtaaacatcatacctgatcaaaccaatctatgagccctgtataaatcagacactgcctcctcaaactggactatatattttggtgcatttgcagccagccagtcctttccactcagagacctgtatctctatagagaaagctgtttctctttctcttctcttcggcctattaaacctttgctcgtaaacttctcatatgtgtctgtgtcctaaattttcctggtgcgtgatgacaaaccctgggtttacaccccagacatagctgctttataatgggggctcgtccgggataacaacatacaacattcatcgagatggtgagtagaggagcagactccaactctgtccttttattctgaggcccttggcttccattttagaaccagatcaaaccaaatacggggcccctttcagccatttaaaaataattagcatggctgccagccttacaagacttgggggacaggattgctagggagaacatggagcatcccccagtacccatgggtcactgggcatactggccctgtttgaaccagcttcctttcactgaggacttagctgtcatgtggggctggaagaagtcctggtgtacctgaggatttccggccagggttaccaccattgttatccaaaggtatttggacggaccccagcctctgactaccctgatgagatgtcggcaacagaatctccaactttttatcataatttcctcctttcctgtctgcgatcatcatatctatttcatcctctctgtgtatgcaatgtatgggaaattttatagttcagggaggtaatcttgtttggcaagatcagggaatgtcatagtaaccagcgatatagctcaagggaaggcatctttgtgattttcgaggaacagagggtcaccctcaccacagggagcatctctctctgcccttggtctgaaaagcacatgacatttcaaggccaacagccccacctagtggaatagggatcttttccatgaggcacatcgttggtcctttacccaaacactctagctaaccaattctctccctttttgcatccctctactagacaccatgctttatgctgcttctgttaacaggaaaactctagcttcaacaattaggattaaaatgtcttctggaaccaaatgttagttcttgatactgtcccatcagcaggaaaattgccatttagtccatacatttttaagacacctattctgcctccaattagaatggtacttaattagtaaggggattttaagtctggaagttaaccagaaccattctctaagggaaaacgctttagtacagcccataatatcaggtatagatttcagtctagcccctccattaaagagggcttgcccaactattatgtagttttttttttgagatctatttttcagggagccagacaggtcacacaagtctaggaagtcaaagggaaatcacaggcagaggacagaggactagagccacttgggtgagtgtgacaaaccccaatctctaagtgcctctgtttccatagctggcagtcatgcctgcaactatgggtggcatgttcaacaaggtgccgggacccaggaaccatggaaggaatatagcaaggggaatgcccccactgtcttcctctccactctgtcacacgaaaaggaaggagactaaagggatacttttttgtcatttctctttctagatgggtaccatattcagcctgcactcccctggagtgcattctgaagcacagggactcctcttaaccagagactttaaagaaaaagcagctcattttcttttgcacaagggcatggcctttttactagatccttgcaagcactgcaaaatgaatccagctcttttagcaatcatatcaggcaggccaaaagagaataattccccaaaatgagaaaagcaacttccaggggaaccacccgaggcagctattgtgtgtaccagcccttccagtctgccttaaccggggccacctccaaccatgccaccagttcttctacctccaccatctctaaaattttccattccatcaccttctcacttacccctacagaaaatacataattgaggtgatgccaccaggattcaagtacccttctcattgcaggacctcaggcaattaaagggagacttaggccaattttctaatgaccctgataggcatatagaagttttccagaatttaactcaggtatttgacctctcatggagggatgttatgttgctcctaagccaaaccctaactgcagctaaaacagacagctctgcaagcagcagagaatttctgaggtgagcaataggtctcctatagtaggccaaatgggaaaagagaagatagagaaagtgaagaaacaggggaaacaccattcccagcaggaagagaggcaatacctcttgaaaccctaatgggaagccccagactcttctatggtgtttttccttttttcactgttttcaatggcccttttatgatgttcattcaacctgggagaagttaatttacccaaaccttaaaatgcttggcttacagttgagctgggggagaaagaaaacccagaagcatgacatgccggcaaaaaggtaaaagtttttttttactagttgggtttttggcttctctatccctgtgcaaaccggtaaaagaaataataaggatcactatttatattttctgaaaagttttaattaatgagaaaggatttgtgaggttggccttaagttgtagacaatctggtgtgctttgtgtgtctttctgtatggttctgtccaaagaaaagttactttaggttaggatgcagacccaggaccccctaagcctgctgttcaagccagcccaacaaaatgatcagtaacaaacttggctaaaggcctccatcttgcttcttgtccttgggaacatgacctgtaaccatgtggcgaataatttgttttagtctccaccattttacaatgtttgctgacttcttatgctaagtcagtttctgggtaatggccacaaaatcagataagccagtttgtcaataagggagctgccagctgattgatcaagggcagggtttacaaaatatcttaagcactaatcttgagggctaagttaagagatggtcaaaatcttgtagcctccagctgtgtgactcctaagccatggattttaatcttgtggctagtttcttggtctagtacccaggcaagaggaaagtatattttaagaaagggctgatatcatctttgttttagagtctaaactgtaaaccaggtgcctcccaaagttggttcagcctacacccagggatggacaaggacagctcgcaggcttgaaaaaaaatagagttctttgggtcagatctctttcactgtctcagtcacaattttgcaatgacagtttcaaaagctgcttatcacccctttaaaaacaccttgtacactcactgttacatcgtaacataattaaggcttgttggtttcacctgtgaggttactttttgtaaagttcagaagctgaaaatcttaactgcttggcatagctaaagttgagtaacagtggatttaaagggattttgttaaagagtgctcagcttaattaaaactgggtattcaagtaataaatatatttaaaaggcctttatatttttctcttcttggatcttgttttctggaaaaaaatttttatttttctcagttgactaaatcatctttctccattttatttcttgacactcttaatgcatgtgtgagaggccctaagataacttctggtagtccttgggaaaaacagaggaggtgccacagaccccattgtggggaaaaaagcaaacaaacaaacaaaaaaaaccctttcttttcctcatgaaaccccaggaattaagagcagatagtgccctctctaaattaaaggttctgttcagttttgctttgtgtgttctgaccattttgagttttgggtgtatcaaaatacttcacattaggagagagctttgatgtgtaataagtaggcaggaaatacactttaagggatggcaaatagtagttataaatcagagaagcatgctcttggccacctgaaagatatggaaacatccccacatccccacatccccacccccgactgagagatgatactcccatgggggataaagctgattagctttgggttgccttacaatgaaatacatggtagaagcaatgcactgttttctcccatagtatctccctcctttaggggaccaaaaatctagtataaaatggcacacttaattttagggatctgcctttgccttcagctgtgcctacttattaggccctaaaaatgcatgctacctggcccagttccaccaaaggctccaccctgaagccagtaatccaattaagaaactgacaaatgaaaactcttacaagtgctgaatattctgtttgtgttgctatatatgtgttgtgtgtaatgtctacaataagagctctaattaattggcttaaaaaatagtgcttaaatcaaatatgttttagttcatgtgactttaatttttaagaaataaaaataatcttaaggattattggtaaaatgcaagggtcatcaaaatccaaataggtggtctaaatcgtaaaacagatactaggtttgctaaatgttcaaaggttgtatactgcctgattttcagataagtaaggcctgggacacatggagttagatgctagaaagagtcagatcttatatgcatttctgcctgggtcctaggctccacgcctggtacataattaaaattgcttactaaccaggtttctcaacaaatgtaaaacttgctaagagttaacagtgcagcatgtatttgagatcactgaacagttttaaaggcaaggtgtataaaaacagtaaaatgtgttttttagtaaaggattataagaaaccatagaaatataaatattgcccagggatgaggaattatcttaaatttgataagataaagctacaggtttaagcatgttgtggaaagatggtcttttcataaactgagcattgaaataaaagcactgtaaggctgtcttaagccactaatctgccctttagcaaaatgggttataaaaaaggtttgtaaggatttcatctcatggtcaaattggttaagattagatggaattgtctttagggtggcatttaatcaaattggggttaacattaataaattaacgcaaaggtaaaatttggctttgagcaggatttttatgtaatagtaaaggcttatgaaaggtttttgccttttgagtcatcattttggcaaaataagtaatttatgactatctggaattctatttcataacatcaactgttttaaacctctaacatttaacagacataccaaaatcaaacttcaagtttcgaaattgtctttcctgatgcgtggctttctagattgttcagggggcccctgaaacattcagaaaataggtgaacaggattatttgacatgtttaatcacattgggattgccaaaatgatgtccagtcttaacttatatttttgtgaataataccaatatatgttccaaaattgtatgggatttctaaaattctaatgtctcataattaattttaaaattattgtaaaccacggagataactaaacttctttgtcagtcatgtttttaactgtaactaccctgaaaattttgtcacttacagacaattgttatcttgctatgttccttctcaaaagatgggatataatcaagctataagactttaacagctgttctcaaatgcagatttccaatagctttgaagattgtaacattggaaaaaatgtacaggactcatgaagaactgaaatgtttatgaatatcaagtgaaacaagagttgtcttaaatggattgtgctcagaaagctaaagcaatctttttgacttttgcttagaatattgctgatccttattttgtttttcagagtcaaggaaacttattttgaactatgtgcagcctttaataattaagtaagttatactcttgtgaacaaaattcggagcaggtttgtttctctgtacctggttcctctagaatttggaaaccatctgtgagtaaccttaacttacggcaatatagttgtttgcatcagtgccacaagaagtcttttttttttttttttttcaataagacacaattagaaaaactggttattttatcaaagctttgacaggaagtgtatgcttccccctttaaagagtcaatctcagcttgcagagctgataaaagcaccttggggaagactggcctcataccttgtctacacagtccctggacaggtttcttaatctgtagtcagtaaagaatgtcactttttaacatgtccaggacctccaagtttatcttgggaccttaagtgtaaagtatttggggataaaaacccattgctgaacttggcttgaagaggtattatctgagattccttatggaacagagttccatcaaagccaacccaaaaggcctatgtagggataattattcttgctgcactttatgcaaatattcacgccaagtataaggctaaagtttattctacaaagaacacagtcctatcataatttgtttttaccaaaaatgagcaatggagagagaaattgtgctccaaagcttatcatacatttgtcattaaatcctagtcacaataattgtttttaagctttttacctacattttagactaaccctgcttatttctgtgaatcaagtggtgatctcctgcagcttggaagaaacaaagagagatgggtaatgtgaaaatctggataaatatgctagttctgggcaattattctgcaaattctgccaggtaatgaaagtgagtagggtgcccataacccagaggtttatttgtttgggaaaataaagccaagaaacttcatagactccccaaagggaaattctgtatcttggcaggtaaaactttagatgaaaattatctactacaccacacttgcagaaattgctatactccctctactattcacagtagggctatacacagtagcaccttctaactggaatatcagacagagagtttccactgctgtagtattttgcttaattattatccttacaggagggataatagtcaccaaaaaaaaaaaaagaaaagaaaaaagaagtatgaaagttttactatcactgaatctgctagaacttcttattgggtttggtaatgtcacaccctggctatatacaaaggatataaaggaaaaaatattttacataagaaaggatcttgtatgataaatacttctcctaaagagaacagttggttgtttaaaagagggatgtttaggagaagtcagaagatttgagcatgttatagatggttgtggaagtcatgaaaagattacaaggatggtaaatacctgtcctaaaaagaatagttggtcgtttaaaaagaaggatgttaggacaagtttaagcacgtcttagatggtctgttgaagtaatgagggaattaatacttacaggaaagatttagccaaggttaacactaaagttactctagctacccaaatccaataccacttattcaaaaaagaatgttacttgtatattaatatttcagcagcacctggtggaggaaaaccagtatcacaacccattggaatgactgacagcaattaaactccaaatggagctttagactgaacaacacatggatgcatctttcttccaggaacccttagatcgaaccaagaggagccctagctgctgttccccacatgacgtcccttttcagcaggaagtagccagaaagagtcatcatccaacaccccttaacagcagttagggttaccactccagagaggggaatgatagaggagttaagaagaaatcacttaggcagatagcaagggtgtaacagtctttggtaatgcttttctttttaatgaaacacagccccaaatcatttactaacaaagagtagcctgtaaagttgacctgcagacatagacaagcaagctgggagtttgcatcggtgaatgctggcagaaactaagcactagacattttcaagatggtggctccatcttctcttctctgttagctatgtgtactctaaggagcagacaagatggtgctgatcaactggacagcccatttgcataataacattagggtggggagaccagacttccctgtgcattatgtaaacatcatacatgatcgaaccaatctataagccctgtgtaaatcagacaccgccacctcaaactggactacaaaatttggtgcatttgctgtcagccagtcccttctgctcagaaacccctttctctataaagaaagctgtttatctttctcttctcttctgcctattaaacctcagctcctgtactgcttgtgtttgtccgtgtcctaaattttcctggcgattgacaacaaaccctgggtttataccacagacaatgtagctgcttcatcttgaggtctgcctatggcactaaggtactttctctttggtcccaccactgcaattttctaacctgtgttctagtgcctcccaggcactaatcttcagaatttcagaacttttttctggctgtgtgcttgaacttggaacttaatggcagaatcggttttatcttcactgcttgtttgttcctattcctgtttgtgttctcctcaaaaaatcatatgttaaaatcctatccccaaagtgagagtattaagaaacggggatttggggacaatattaggtaatgaagacagaatccttatgaatgaattagtaccctcataaaaacagaaatgaaagaacacattttttgtctctctgctctccccaacatgagaatacaatgtgaagattgtcatcaacaaaccaggaagtgaagcctttccaaacaacagatttgctgccaccttgatcttggacttcccagcctccagcctgtgagaaaaaataatatctgtttttgaagccacctggtgctatttttgttatagtagcctgaactgactaagagagtagacaacagtggtaactctggattaaaatatacatattactggaattaagttagtgtaaatttgaagcagactgataaattgagatatatattgtaagccctattgaaacaattaagaaaataactaaaaaagtaaactaattaaaaaaagactgagctgatttttcattgtagaattcaattgttttggatgggggaaagtgatttgtaacacataattaaataattacaatctttttgaaatagtttcctcatcagtaaagtggaggtaaccctacatcctagttaggctataaagaatgatgaatataagtttggcagtagacaagttggaatttttaacctcaacttgtagctttgtgacttcaagtgcatcactaaaccttaggctgtctctttaactgtaaagagggaacaataaccatgatcatatcttaaaccattataattgaataatatagtaaaaattttgcacaatcaacgatgagtattaactatcataattggattgtgaaaatatttataaactctgaagaatttattactattggtattcattatttttccccacaagctaatctgattatttgtaaaggcaaaaatggaaaaaaacaagtccaccatataattatcacttggtttcttaacatctatgctacttttaaacaataatgtcaatatgtgaactattttaaattggtttttctatgaaaacatttgctgcttattgacatacactgtgcaataatatgcctctcacatctattatagaattaaggtctgtgtgatcaaatgtaattcaacaaatgtttattgcaccttctaagtgttagtcactatgttatgtgcttgtgatgtagaagtttaaaaacgtatgtttactagtaaaaaacattagtttttataatattttagaagaaacagcactagaattgagaaaagtaacattaggatgaaattagaattttgaaggaggttctccaggcaaagaaatggacaaggcatttcaaattgtattattaactgcctattagagagaaggtaatatgtattgaaagttttgcaacaaacatatcacttacacaataactactccatttcatagatgaatttaatgaatttgatgaggtaactacatctagtagagggtaggccaaggctcaaatctaagtttgcctgtttccaacacttgtgcatctaatcactgacatacataaataaggcaattgtcagagaagcatttcaaactttcctgaacattccaaaagggaaaggcatcgtatcataaataagaagataacaacaaagatttccaaaggaagatatgtagaaagggatacgaaaaaaaggaggaaataaaacaatagcaagtatcaaaaacaagagttgagatggggcagagtgggaaatgagagtattttagggttcaacagagaatcagaagcaataggagaatctattatctatctatctgtctatctattaatatagagaggtttatttattgtaaggcatttgcttacacaattatggaagcaaaaaaatcccataatctgcaagcttgagactgaagaagaccagtggtgcagttctgaggaccagagggccaatgatgtgagtcctagtctgagaaaatagaaagaatggtgtcccaaatcaaacagagagagtgaatcctcccttcctatcttttgttctattggacatcataaaagattagatgatggccacatacattgggaaagtcagtctgcttttcttagactactgattcaactgtttctggagattagcctgattcttagactaatctccagaaacaacctcagagatataaccaaaaacaatattcagccaaatgtctgagcaccctgcaatccagtcaagttgacacataaaattaaccatcataaagtgcaaaatttgttaaatgtctgagcttgcagatccttttagggcaacatcacagaccctgaactccaggacaaaataccctaatcaaacgaactgcccaactagtgttctgaaacacaggatgaatcatcagttcaatcatggatggctaaacctaaaaaattattccttaataataaccgtatgtctggaagaaatcaaccttctaaaaaagacaaagttgaggaactgcaaaaggaaattcaaactcctctgaaactcttaacaggcaagaaaaaatatgcagttggataaactgacattcaccaaacttaaaattttgatataaatattcatagggttcatcccttttcttctgtctagcactactagctagaagtcagaatttataaaggacagcccaatatttcccctcctgggcccacagcagacacaaaaaattcataatgaaacgttttttctttaatctgcaaaaagtctattattccttcttaataccatgttttgggcaactactcttaatcaggtaagatgcatgaaataaatttgcttgcaatactgttgctgggtgaacatcagcaagttactgatggtagtcgttctctgcaggatcatttttgcctcctgagggacatttggtaattggggacattttttactgtcttagctgaaagaggtgctgctgacatctagtaggttgaggtcagagatgatgtcaaacattctacaatgcataggaaagaccacctgaaaatatatgtatattcagttcaaactgtcaatactgctaaggttgagggcctttagagttagcctgaactcacaaaattttccgataaaaggcactttcctttcccttccaccttataagctttaattcatccttaaaaggttttggtgaagataattttctttgtaaaggagaaaacatgtaagctttggaaccaggaaaggatgattgtgcatcactacttactagccccatgtttgaccaactttgtttccttgggcgctataacaaaatacaataaaacaggtgccttagaacaacagaaatactgtctcacagttctggaggctagaagaacaaattgcaggaccatgctccctctaaaacttgtagggaaattcttccttgcctctttccagcttctgagggtttgacagcaatctttggtgttccttggcctatggatgcatcactccaatcctccatcttcacatgaccttctctctgtgtatgtctgtctctgtatccaaatttccctcttttgtaaggaaaccagttatattgaataagggcccacactagtaatgtttaactcgattaataataataattaataataatgtttaactcagaatatgtttaacttgattgactctgtaaaggccctattaaaaataaggtcacattctgtagtaatgggcatttggactttcacatcccttttttggaggcgggaacataattcaaccaaaacaccagtttgcttaatttcccaaaacttcagtttccttatatgaaaaatgcaaataatactgactgtctgtagcattaattgaaagattaaaataaatggactaagaaataaactatggaaaaccaactagtatagcagctgctgtatcacaggtgctcaaatatatatacggtcaccctgttatccagtcatatgtgtcatatatacacacacacacacacataaacacacagatttgtgtatgtgtatgtataaaactttcccttttctcccaggtatttatgtctctttggtgttcacacaaaacatgatgtatttttctttccattcgttacattatatttgaactatatatctatttatctatctggcttgctactactttgatattagaaactgttgcagtaatttttagattgatacctaactttgtttactaattaataatttacttatcaagtaaaggactaaatggaaaaatggatggatgaacatgactacagcttaccaaaaatgccctttatacctgaatttctcttagtgggtcagagtttaggtggtattcgaacgaatcaaagggatatacgtattttgcttttggtatgtgtttgtgtacattctcattattgttacttgtcagtttcctaggtttccgattgtgatctttagatttttttgactagcctacaaacttagatttttaaaatcctaatgacatctacagcagtttcccaggagctttctttcagaatatctgccaaaataatttattgctgtcttaggttatttcatcttgagcaacatgaacattccatcaagcagagggtatagggagaagtctcatcagtaaataagctggctaaaatttagacgtccatcaatctctgttaaattttatctcatataccctgagataggagagtaatataaccattttaaaataaaacttatttcttgcccatttactgtatttggaagaaaaaaatagtggataattaggaagtggataattctggaagaaaataattagtagacttactaattatttatgagggaaagaactgagaacagtaattttaaaatatatccatgttcttgaatatttccacccttaagtaactacagaggaaatggactgatttaccaccaaagattactttataataataacctacagtttgaaatttaagctccatttaggagccagaaccaattatttataatactagaatggcctgaaataatcttgtattatcctgaaaaaaaaatctgaagtgggaataagcccacacctcatttatgtgtgtaaaacaatctcagctttacatcttttaagaaaagtctgaataactgccttatttccacatttctttgcataaataaggcagtgcaaaagctttgtcagctgattaaatttatatgcaattttggtaagacattgttttctagttccacaatatatttttgtccagtccaccgaaatttgagtttgattcactcacaaagctgatcctcccaacttcatttaataaaatgtaagaagactttaaaagatatattaggaataactagttagatatggagaccgtctcatattaattatttattttatgagtgtctgctaaatatataaacaactctgctggtaattatttatgggtacccaggtggcataaaaaatgaagcagagacagaaaattagatgtagcttctaccgtagattgataaaaaccataaatgcagaactacacagactagagtggatagtattaaaaactatatgtatagtgatgtactggtaaatgtataacaacctggtttctgaggaagaaaaaatctctgctttctaacattagttgatttccatggcacaagcactcctatcatgaccagtttcaagccacaaatgtgaaatcactgaacacagatttgggaagagatggacacaactcttgaaagtcagtgtgacaaactgaaacacagcactgcttacatatagatatataaagtggatgactattttaacagatacaaaagcaaagaatctatgtgaatttttaactaaaactgaaaatattatatacctaaaagcatgttggttaaaatgatcattttgaatatctaaatctacacagtcataattatactgatgctattaaaacatggtataatggccttctgtatggaactcatattaattgtaataaatattcaattatataaaattttagagatcatctactgtatattagacattgtgctatgaacaggagttacacagatggctaggacttagtttctatttttaaattataaaaagggccaccaaatggataattccagtagataaaataataaatactaagatagaggtaagcatctgtcccgcagtacagagaagagccatttagcccagtcttgtttgggatggttttctgggaaaatgatgttgtcaaaaccaccttatgaaatgcaggctctgtcactttacagttattcctagtattgccaactacaacttcgatcccatatttgaagtgatctctgtaaattttgttaaaggtaaagcaggtccatgattttgtggggatagtaaacagaggcttaaaataagacagaacttttaggccagttatcagatctttaatggaacttaaacatattacctgacgtggacaggtagggagagccctagaggaatgctgatggattgggtaacttgtgagatccgtgtgtgagcttagtcaagtcattttctggtatgtcggtttccttatcaatggaaaaataatggtttggggtggataataataataaaatcatagctaatatctattgattgactttgatgttgttatatcccttgacatatattaattcacttagttctcacaacaatcctataaagttgatatccttctttctctttttatattagataaatctgagataattgtaagctatatacaatttcaatgttaggaaagacctgaggtagaattccaacctagttctttctgactctaatctcttagacattccctgaagtcgtttccagccttcatgttctttgaccccagaagtatcttggaatgtttccctaattgctgtgatggcaacacagcagagctagggaaatcaaagacctaggctatgccccttcatgtttgtgcattatggtgaatgagctctgaaagtgccagggaattttgccaccaagtcttcacattaacttttcagcaatattcctcagtttaggagggaggcctatccactccttgtcctttgaaaagtgatcatttgcttgattgctctcaacagaagtcttcccatagcctctgatattttcttttcatttcttctgagttgtttatttttaattacttaacatttttgacgataccttttccgaatgcatctcaaacttagggctaaaaagccaaatgcttcaactttgttttcccatctcttaggcaaacagccaaaataagttccatagttgagcgaggtttttccataactctggaattatacaagtagttcccatttcagggcgtggttgccatccttttctacatttcttagcatggctaaattctctttattctttatggtttagacgatcccctgagaaggtcccaaaatgccgtgtgttaactttatatgctgcttttctctttctggcttaggctgcagactgcctaagggcagagaaaagtttttttgttttttttttgtttgtttgtttttttaatgagtttatcttttgaacctgatgcaatgccagtataacttagggtggaagaacttgggatctgtagttaggatgtctaggtttaaatcttacctttgctacttaatagtcatgtggacttgggaacatttaaaaatttcccccagactcacattctatctgggaagagaagatccaacaacttacttcaaaaggcttttgtgaggattaagtggtccatgtaaagcacttggcatggtatctagcacatactgagtattcaaaaaccattatattgttattaggtactcaaatgttaaatgaagagtaagaaaatgaatgtacttattcattcagaaaatatttattggtgctagacccatttctaagacctggaagggtagcagagagcacatccaagttgctccctggtttttctagagcttacattctctcaaagggagaaagacaccaaacagaaaaataaatatgtgtgaaaataaagcagagaggccgggtgcagtagttcacgcctgtaatctcagcactttgggaggccgaagcaggcggatcatgaggtctggatttccaggccagcctggccaatgtgaaaccctgtctctactaaaaatacaaaaattagccaggcatggtggtatgcgcctgtggtaccagctactagggaggttgaggcagaagaatcgcttgaatccaggaggcggaggttgcagttagccgagatcgtgccactgcactccagcctgggcgacagaccaagactccatctcaaaaaaaaaaaaaaaaaaaaaaaaaaaaagcaaagaaaaggaaagaaaagaaagcagagtaagaggacaagcaacagcaggggaaatgttactttagataaggtagccagagatagactcctgtttatgataatatttatttgtgcacctgagtgaaaagagggatagatctgtaattctgtgggttggggcaggggcgaagcaaatgcgaaggccctgaggctagagggtttctgtcatcatcaaagaaaagcaagagaaaggactgatttggtagaagaggagatatgagaggatgtttaagagggagaatgttaggagaagagggtgagcatcaaagtgtgacacatttttaaactagtacaactgctatggaaaacagtatggagatttctcaaagaactaaaaatagaattaccatttgattcagcaatcccactactggctatctgcccaagggaaaagaattcattataccacaaagatgcctgctcgcatatgtttatcacagcattattcacaatagaaacaatatggaatcaacctaagtgtctatcaagagatgattggataaagaaaatgtggcatatatacacaatggaatactattcagccattaaaaagaacaaatcatgtcttttgcagcaatgaggatggaacaggaggccattatcttaagtaaaacaaatcagacacagaaatacaaattcaacattctcacttacaagtaggaactaaaataacatgtttgcatgaatgtagaatgtgtaatgatggataatagagattaggaagattgagtagtggagaggagcacagattatgagcaattacttaataggtacaacgtacattatttgggtgatgaacaccctaaaagatctgactttaccgctgtgcaatttagggatataacaaaattatacttgcattccatatatttattaaaaaagatgtgacagatttttagggattgttggccaagtaaaaactatagatttcatgctgagtgagatggaaggaatttcagggtttggaatagcattatgaaacgaattgaagatgctctcattgagaatgaaataaatgattaaagggtctcgagatagattcagataagtaagggtatagtagccaactgatgaagaggatgcattaaaaagataacattcggggaagggcagagagttgacaaatgaggtgttaagaagtaaaactagactgacctcacaaaagagaaaattaagacaaaggcattgtgatttatgcataattgtcaatttgtatgtgtacatatatgggtccacttgtcaagctttcattgcctacagctcttttgactatttattttccttcaggagcccatactttaaaaacattttctcaaccaaagataatttatttataattaattcatgccatcatattttttcaaagccataagtaacctcaatctcaacttccaatgggtgacagcaaaccaatgtcatcctctcctggagtcaccattctagccaagagcaaatgaacctatgatttccatcaacctgtactgccttattgcaattaatatattctatcccttagtttcttttaaacactggaaatagctttagcttgtatactcccttttctttttcggtggaatcccaggagtctctgaaccataagtgtggtattcaaattactcatgtaaacctacagatacaatgtgtatcttacataaccattatatacatattccatcctatatgtgcatgtattacacacaatgcattttatctctagaatatatgtatatattgtgtatatagtgctttcaaataaggtcatattcacaggtttacacagttagaatgtgtacttatcattgtagggaataccattcaattcaccgcagaggtatttattggaaaaatgtgtattggaaaggagaactatcaggctgcattatttgttaaccatctaagattattatgttaatataaaagatctcataaacagaagctcttattacctagtcaatagttgttttatttcttattgatatatgattatgctgccgaattgtgaatttaatttggggcatgaatgtgtcatacatcttcatccaatcagaagattcagttcagatgtgtctatataatatatgtgtttatctttcagaaactttgtaagtaaagaatattacccttacagataagtcactctcactggagagaagatcgtgaggtagggaagaatgtggaaattaacatctctgagtacatgttcccaacgatagggccatattgatgaggggtcggaaagcaggagcctgccaaagagcaaaagataggcccgtgtggacaagaggttactttattatttatttattcattaattcattcatttattcatttacttattttgagacggagtcttgctctgtcacccagactggagtgcagtggtgcaatttcagctcactgcagcctctgcctcccgggttcaagtgattctcgtgtcagcctcccgagtagctggaattatgggtgcccatcattacacctggctaatttttgtatttttagtagagacggggtttcgccaggtttgtcaggctggtctggaattcctgacctcaagtaatctgtctgcctcggcctcccaaagtgttgggattacatgcatgagccaccatgcctggacaaggttactttattaaacggggtaggacctcttattagattggttcacctggaggatggtcttagtgatacctgactttgagtctctttcagtctctctgcaaagctcattttgaaagacatttctgagtctcctactaaatgccagacactgagatgagcaaatgaacaaaataaaagtctctgactctagagaacatcaaccccggagtgtggcaaggcaggaggcagtggtgggggacaaggaagagaaacatatgcattctctacattcaaatcttattatactttaatattttagagaataaaacaggaggggaagtcagaacaaataaaggacaagatctgaaaactgttaaggactttaaaattatattcaaatttatttaagtacccttaaatttacttagtgtataacagaagagaaagctgagttatattggttaccttctgttttgtaaacgcaaattaattttacagtgtctctcttagccagataaaaccattgatatttattgacaagtaaatcaaaagcatttatggttactggcttcttaatttcatctactcttgtttctgtcactggggagttttcagcacttatattggtctattttgatgaaagactcacaacagagggcaactaaaacaagagtgttcctcaagtgatttttctaggatgtaagacatagattattactttattagccctccccaaattttgaggacattcgtacataaatctgagagttattttcatgagattatctcaccagatggcttacttaaatatttgtaccattgtagaagtaattacttcatctgggagaaaaaaaaaagttcaaaagccctggattatttttgtctgttttcatttgtttcatttctattttactttctagacaggagtaaacttacatttctatgataaatagatgttggtaaggttttggaaaatacatatatgtcaaaatataggaaattctctgtgtcagaaataaccacaattatggtgtaatgaatgcaatactcaacagagagttggaaaataaggcataaattttgagttttagtaaatatgagctatgtaaccttgtgcaagtcacttaatcttactaacatcatattcatctgctaaaaattgagtaaataatggaaactccattgagccattatatgaattaaaacataatgccacatttgaaagtgctaaggaatccacgccagaaaaggctaattaaggagttaatcaattaccattatcaattttttaaatactaaataattactagtttgaacatctagtactgctagtaacaggttatattttgcctagctatttgaagcagttaaaaagagttcctttgaggatttgaggcagtttggctaacagggaaagaatcctggcctggaagcagatacccaagttcaatttctcggtgttctatttgcctgaagtgacaccttgggtagattatttgacttttcagggccacatgtcctcatctatataatgaggatggttatgaaaaataaattactacttgtaaagtacttagaggcttgtctggaatgttatgtcagccctgtggatgttagctagtagcgatcatcactgagttttcctgaaagccttccaacagctgggaggccacagctggccacactctagtgtcccacagagggaccacaggagtctcctcctcttgccttccatgcccccactctgtccaaaactgctagtagtgccacacaaggacatagaaactgagagcaagactgagagaataagactaagagagagagaattctgaaaatagaacaaaatgctattttatcaaaacagagcagagtttggaaggcttctagtgctctatcttctcactaaatatttgtatgactttaaaatgtcacaatttctctgcagcagtatttactcatgcgaatattagaaattattataattacatggaacatttgtttagggttttaccatttacaaggtgggagagcagaataacttaatcgtgaacaccagagctttggaatcaagcaggattagatcccaggtttgttgtttactagctggtcaagtcatttaacttctctatgcctcagtgttttaatttgaaaactagtaattcagaaatgttcctcagaattattaaagatttaaataaaattgtttattctcatatatatatttatagaatctcatagcagaaaatttggcagtggtgatgcacataaatggtagctttaaaaacaattttttctgtctgttgtatgtaatttatataatttgcgtgtaatcccaccatgattagaaaaaatattatctgaggagactaaatgcagcataagtcaattttggagaaagtggttataaaacaattccacagaaaacatgggaatatgccctaaaatattgactatggttattaaaatgagggaaaatatgaggcaatatttcttatctatacttatccatattttagcattccatacaaacatcatgttttccatatttgagaaaattatatgtgccatgaaaatacttgtcaactttgtccatcttgcaaacctactctcccctgtcttctacctaggaactgtaataggaggtattgctcctaaaaatctatgatcgcatgatatattttgaaaataatggtcataattcaccatattttcttacatgatggaaaaaatttgttagtctcttttctagtaatatgaataaaaatgatcatcttgggtttggtaagtagtgactgcatgcttactaccatccctgctaggagtttctttcctctgcaccacctctttcacatatagcccccagaatatatctttctaaacccagattcggtaactatctttccacaagcttaaaaatgactgctcaaagcataaaaataagaggctattttttgcctgttttaaaaagtagtatggccttaagttctattttcagcttcttatcctattataccttattttaacaaagtatctcattttctaggtatattggaatacagtcttcaagtttggggtcattttctctctctgactgacatgaattatgatttcctcattattcgactgtgaaaatccttttaatatctcagttcaacctaaaacttcaccaaaagcagatattaaactgtttgttcagatttcagaatgcccagtgaatgagtcacatttacaaagtgtgagtttacctatatgcatatggtggtcccttctctccatactgcaaggaaacctgttattctagcattcttagttgccttatattagtactctgatggtcagaaaccctaatcactttgaacttggcagcctgttagtggtaagacttggactttgaggccgaagtcctttcttggagacgttgagtccaaatttatatattgtacttgaatccagatttttcaaaacgtttaattggcagttacaggcaatgccccaactaaaattaaagtggaacttacatttctcatttgtccttgttccttgagtatattattgccttggaaaccttgtgggaaatagatgatttataaagcatggttctattaatcttgggtttctctagccaaacaacatttaacagcaatctaaaacttatcgtacatgtagtatattagcaaaattgccatcctgttcttactcatatacttcctcgctcaaagtggctggtgtctaaggtaaaaagtgtctccagactcgttcatattattcttttctactttccactgccaaggtaaatcaatggccagactacactgccatcccttttttttctgaatttttgtctacttttttttttttcactctgaatctcatgcttctttttaataaagcaggatgttcccaaactcttcatcctcaccagtacacacacacacacacacacacacacattttctattttcatctctagcttgtttccgtgatggcacttataacttaaatttgcttatttctatgtttgcttgttgtttcttggccatcctcactggtatctccaagatgcagagggtgtgcctttcttactcatctctataaccccagttaccatagcagtgtctagcacaaatgagaaacacaataataacaaattcattctcatctaatattaatgcccaaagctctggaacatgaagcccacctactgcaataatagtcattttggggacaaatacgatttttcctgctacttgtgtttttcctctagagattatgagtatatacttttttaaattatggtaaaatacatataatcaacttttccatctgaaccattttaagggtaaaattcagtggcatcatacatattcacagtgctaagtaactatcagcactatttccaaaatcacttcacctcagatggaaactccatccccactaagcaatcactccccagttcccacttccccagtccctggtagtctttactctactttctacctccatcaacgtatctattccagatatttcatataattgaaatcatacaatatttgtcttcttgtatctagtttattttttcagtctagtgttttcagggtttatccgtgttgtggcatgtatcagacttcattccttcttaaggctaaatatgccattgtatgaatatacaggacaacattttgttcatctatttatctactgatgaacaccaagtttatttggctatcataagtaatgtttttatgaacattgatatgcaaatatttgtttgagtttctgttctcaatacttctttgagaacctaggagttctcaaatacctaggagtggaatttttgtttcatatgtaaactctacatttaactgtttgtggaaccaccaaatggtttccacagcagttacatcattttacattgtgatgggtatagttttgattggctttctttctttagctgaggctgtgaagagggagtgaattagacaaaaacctgaacaattctcaaacatatatgtttagactatatatgtctaagattgtcaaatggttagacaaagaggaatatcctatatggtttgaatcagcagcacttttaagcaagaacatgataaaccatacatttaaaatgtatttcaagcaagaatccagtaggtgaaatgtctattcacgtcaatatatagccatagaaatgggctcaatacttaaaaacacacaatgtagaacgtattttttttttgtttcagataaagtcctaaaatatgcaacccaaaatccaagaaatattttaaaattgctggtctctatcccttttcagtagctagagaatgggaacaaaaacaaatccaaagttctcctgaattttaaggtttaaatcttttattgaaatgctctaaaataacaagcgaatgcgtccagtcatgtttggaaaaaaaatgttgctttgtaaataagaatatattttttcctagtcacttcttgatttttccatgcaagtcacgtgttcccaaaagatgaaaaagattaaatatttaccatagaacatctaaaaacaataaaaaaagggactagtccccactgtatataaagctctgctccaggcagaaggataactagttggagtctctgggcactcataagagaacagattcatttttaacaagtccttcgcctacacagaactgtaattgcatagcttgtgtggtgtctgtatctttatcattttctatttattcatctatcctgtgtttcctgttcatttcctgtgaaaaatgaataattaaataagctaacaaattaaacaaatttaacaaattaaaacaaacaaatgagaaagcatatagattttttgtactcaacagtgacactttccctcactgttggaatactctaaacacctttctatccatatgatgggtagtatatttaattcgtgtaccacccaggtagcatagtgtatagaaaacagcattagggttcacagactttgtttttatcctggctctacttctaataagctgtttgactttgaatatgtcactaaacctctttaggctatgtttccttattcgtaaattgagcaagttgaaccagatcactggtttacacattgtgttgcctcagaagctaaaattggagatgagggggaagtaaattagtagggctctgtgctcactgtgcttactttaaatacagtggttttactttcatttgccttatgcatttggcatctgtgcacagttttatttgggaagaagaaaaagtccctcttttggaaatggtggtggggaacctagaaatatgaactagtcagtaacaattctttgctacccaagtacgaaattttttattgtcttaatatacaaccagtaaaaataacagcatctaaccagttggggtgttgatgagaagtcacaaataagtattgtacaatactgtaagtattggcgaagttcagaggaacgtgtatctgtataacttcctaaaatgaccaaatgaagagtattagagcattcaaaaattgagattgtgaagcaggagtattgcttcaaaaataacattgttatttttcaataggtattccgcatcaagataatacatttttaaaaatgtacatactttggtataactaaaataatgataatgcaacatttttcaatttactgccatcaaacaaattgatgtttgttactttcttaaaggggctgacttatcctaaggaactttattctctcatatttcatggaaataacattagactagaaaacaaggctctcatctggtcttggcttcctaaagtgcacaggtaaaggcttgcatttgccctctatgcatttgatttgctctctctttctctgcattgtcacacttttgccatggagatcattatatactgtgtatgtatatgcatgcatgtgtatgtgttggtgggaggggggagggctcaggctaacctgtccataatgaagaataatatctcagttcataagtttttaaaaaatgtcagatttctccatcttcagagttgaaagcatccataatagtcattttgtccaacatccttgttaatgttcaatctttctatagtatctcttaaagattttccagtaatagaaactatattccattatgaaacagctgaacttattttaaaacaaacaaacaaaagcacttgataaaattccattccttggatgtgagttttactctcttaagacacagactattctttacctattgacctgttgtcctcatgccagtcccttaaatgcctgatggaggctgacatgttcccaggtctacatacatgagcatggaacttgggattgcaaatttgagtagcaatatgcttgattcaatcctccctgttgctattttaatattcttaataacttttgaacaaatgctccctgatttttattttgcagtgggccttgcaaattatgtagccagttatgcataatccttaaatcatctatcctcaagcttaataaccccagttcctacagtatctgttcatgatcattggtattaaataggtttgtttgtcaatgaccatgttagaaggtaatggccagaattgagcacagtgctctaggtgtggtctgatcagtgagaaaatcagaggcatgattatatcccatggtgatatctcctgtgcctctctattctcacccgctcaagatccagtctctcgacaattctctgccctgctctgagcccaagaaggcaaactcatgcagagggtagcagttgagatcccttcctgtctggcatccagctgggttaatggaaggcaataggggatggcaatgtagaagagagaattcagggtatttccttcccctcccctgtctcagagctgcatccctctctgtggtaaaaactgcatccctctctgatgagaattcctactggttggtccctcttttacagttccatatcttctttttttttccttctctctctctcttttttttttttttttttaggtggagtcgtgctttgtcacccaggctggagtgcagtggcacagtctcggctcactccaacctctgcctcccaggttcaagcaatcctcctgcctcagcttcccaaatacatgagattaccagcatgtgctcccatgccaggctaatttttgtatttttagtagatatgggatatcaccatgttggccaggctggtctcgaactcctgacttcaagtgttttacatacctcggcctcccaaagtgctagaattacaggtgtgagccatgtggcctacagttccatatctcactggtcacacaatactgttttctctccttgttccttcagccctagtgggtattaatggtttcctgctgcttctgctcctttaatcctgatcacataccatatgcattcctttcgtagaaccatcttcatttgaatcatatggggtaaattctgtaccttgccaatgctctgataaatcactcagcatgttggtgtcatatgtctcttaatgtctccagttagcatacattttggacatttctctagaaggatgaagttgacattctttgcttcactgagtcactgatctagggtctccttccacacttccaatcaccttctgaagagtgacagagggtgctcaaatttctatctttgagacatcatgcttccagaatataattaattcaaaaatatgaagaaatagttcctacacatcaagcattctctctcccaagaactggagatatagtagtgaccaatcacatcaagttctctatcctaatggagtttagtgagattcttgtgagagatcaaagatataaaccagaggcctctaagaagctaaataacatgactggcctaatttagaagttttactctggttgctgtattcagaatacactgccagaatccaggagaggcagcaagaacagttagaataatacaagtgaggagacatggcagcttggactaaggcagtggcagcaggtggtaaggttattctgtgactcagcacacatccttgctgccctgtttctctgttccattgaatcccaaggtaggatccatatcttatcctgtactttaccagcttactacaaacaatttgtgaataactgcatagtgaattaaaggtcaacaatatccactttactttcaaggaaaataattttcctttttcttagcaatcataataggtatttttcttcttttctcaaacgtaaagaaaaatgttgtaatattcctggggactatgaaagaaattaaaagtcaaatgaaagtgctcattgaattattcatagaaaattatctaaaatgaaatgaaaaaggggattatcatcttcaatttgcctcaatattcaggtatgggtaagaaaatactcagaaaattaaggtttccttaacaagatttttaatggttttgttagtaacttttacaaaaacaaaaaggtcacattttccagaagatggaataatcaataactatactattttgagcactaggtttgactacttctgcctactctttgtagaataaaaaaaaatctaatttttagttatactgagagcaagagaaattcagtgaaggaggaggacagagaggaggaggaggagaaaagaaaacatcaataaatatactatgaagtagtaccccagaaataaagctgcccgatagagctttcctaatgtaacaagattggtggtttataaaacaaaatgcaaccatcttttgttgttgaattgtaagactttttttaatgtgcggcataagtttgattcaaaaaccagtgatatcgaggtcatattagaataaattagtggagagctgaaatgtaattaattgaaaataaggggaaggggataagttcttgctcccttgccccattatggagagtatctgtttctattacagctgttgtagctatccaagactaaattcaattttcttgcaaaggtcatatattctctcattatctaatcaaaaatatattattaatatataatgcattaattaatttaaaattccattaatacttatgtgacaggcttttggacctggatcttcaacagttatttgacaatccatttcttcagttcttaggaaataatctgacaatatgtatgggctgcaaacaggtttctttggaggatcttcaaagcaccactaccaacatcttctaacttcatatctgccagtcaggaagaggcttgataactagaggttttgttgtgcagacattatgttccttaagaacagttttttagtctcatggttgtctacaaaactgaaggccgaatagtcttttatcttctgaagaaaatgaagtttttacttaagtaaagaaaacaaaaactaccacagaatagtcaaacaatcctgaaaggctatggtcacaataaatttcttataagataagataataataagataaatttgagaattaggtaaataatggctgtgccatttattcttcttaattattcatttggtaggaggagaaacaagatggctgaagagaagcatccagcaattgttccccttgcaggaacaccaaattgaacaactgtctacataagaaagcatcttcataaccaaaaatcaagctagcaattacagtgtatgcctttaacctcatatcaaggaaatagatatgaaagaaggtaggaaagacagtctttacttgcgtacaccacccctcccccatcccccagttcatcacaaggcagtaggacagagaatctgtatgcttggtagaaggagagtgcattgattttgagacttcacattataactcagttctgacttgtcacaggggaaagtaatgcaaggcagaattcagccagcctccaaggaggaaggatttagaccagctctagtcaaagggaaatagcacatctgaggagtaagaacctgagccatggctagcaccaccaccatgagttaaattgccctgagatcctaaataaactagaaaggctgcctagaccacaaggactgtaattcctgggcagtcttggtgctttgctgggcttggagccagtggacttggggtgcatgtaactcagtaagaaaccagctggagcagcaaagggagtgtcatccctcccccaactctggcaacacagctcacaattctgggagaattcctccagcttgaggaaaagagagagaaaagagaactttgtcttgcaacttcggtaacagctcagccgtagtacaataaagcacaaatctaatccataaagaccccaatactaggacatagctcccagatgacatttctagactcaccctgggccagaagggaacctgcagccctgaaatgaaagacctaggcgtggcaggattcagcacctctgactaaagagcccttgagcattgaatatacagcagccatagccagacactagtcaccataggccttgggcaagacccagtactgtgctagcctcagctgtgaccaagaagagtcccagcaatggtagtcacaggagggcttgtgacaccccttctccaacttcaggcagctcagtacgaagagacatagagacactgcttgggagaaagtaagtaaagagaacaagactttacctgctaatactgggaattctcttgtatcttactgaagatcaccaaggtggcacctgtatgagtcagcaagacttaaagtgttactgggcttggggtgccccctaatgcacacagtgaccaaagatttagaacaacattcaattccctttaaatacctggaaagccctatcaagaattataggtataaataagctcagactgcaatgattagaataaactagtttttcaatgtccagacattgacaaacatccaaaagtattaagaccatctaggaaaacatgactttgccaaactaaataaggcaccaatgagcaatcccagagtgacagagatatgtgacctttcagataactcaaaatagctgttttgaagaaacgcaatgaaattcaggacattacagagaagaaattcagaattccatcagataattttaacaaagagattaaaataatcttaaaaactcaagcagaaattctggaacagccctattaactgacaaacagaaaaatgcatcagagtctctcaagagcagaatggatgaaggagaagaaaggatttgtgtgcttgaacaggctatttgaaaacacacagacagaggaaagcaataacaaaaaaaatgaagcatgcctacaagatttataaaatagcatgaaaagggaaaatctaagagttattggccttaaataggagacagaaagagagattggggtagaaagcatattgaaaaaaataacagagaactttccaaacctatagaaatatatcaatatttaagtacaacaaggttatagaacacaagcagacttaacccaaataagactaactcaggagatttaataagcaaactcccaaacatcaaaaataaagaaaggatcataaaggcagcaagaaaaaaagaaacaacatacaaaggagcaccaatacatctggcagcagacttaaagtcttgaccttacacaccaggagagagtggcatgacctatctaaaatgctgaaggaaaaaaaaaaaacaaaaacaaaccaaacaaacaaacaaaaaaatcttttatccaagaatagtatatccagtgaaaatatcctgcagacatgaaggagaaataaaaaaattcccctggcaaagaaatatacctaatgctagatgacaagttagtgggtgcagcgcaccagcatggcacatgtatacatatgtaactaacctgcacattgtgcacatgtaccctaaaacttaaagtataataataataaataaattaatttaaaaaaaaacctgagggatttcatccataccagatctttcctaaagaaagtttttaatctgaaagaaaaggacattaaggagcaataagaaatcatttgaaagtacaaaactgactggaaataagtacacagacaaatataaaatactgtaactgtaattgtggtgtgtaaactactcatatcttgagtaggaagactaaaagacaaatttatctgaaataataactccaacaacttttaaagacatacatagtataagaagatataaatagaaacaacaaaaagttaaagagcaagaagtatgaagttaaatgtagagtttttattagtttttctttgtttttgcaatcagagttaagtagtcatcaatttaaagtaatgagttatgttatttgcaagcctcatggtaacctcaaatcaaaaaacctaaaaaatataaaaacacacacacacaaaataaaaatcaaaaaattaaaacataccaccagagaaaaacactttcacaaaaagtaagacaggaaggacagaaggaagagaagactccaagacaaccagagaacaaataacaaagtggtagtagtaagtccttatttatcaataataacattaaatataataggctaaacactccaataaaaaaaatagagtggctgaatgcattaaaactaaactcaacaatatgctgccttcaagaaacacacctcacctataaagacatacactgaaaaaaaaaaagatggaaaaagatatcccacaccaatggcattcgaagaacagcaggagtagctatatatatatatatatatcggataaaatagattttaagacaataactacaaaaagaggcaaagaaagtcattatatattgataaaggggtcaattcagcaagtggatataacaattttaaatatatatgcgcctaacactagagaacacagatatataaaacaaacgttataagagctaaagagagtgatagatcccaatataataatagttggaggcttcaccatcccacttgcaggattggacagattatccagacaggaaatcaataaagaaatatcagacttaataggcactatagatcaaatggatctaatagatatttacagaatattttatttaacaactgcagaatatacattcttttcctcagcacatacatcatgctcaaggatagactatatgttaggccacaaaacaagactcacaaaattaaaagaaaatgagatcatatcaagtgttttctcagagaacaacagaataatattaaatagcaataacaagaggtactttggaaactataaaaacacgtggaaattaaacaaaatgttcctgaatgaccagtgggcccatgaataaattaaaacaaaagttttaaaaattcatgaagccaatgaaaatgaaaatgcaaaatcccaaaatctatgggatacagagaaagcaatgttaagaggaaagtttataccaataagtgcctacattaaaaaggcatataaattttagataaaaaacctaataacacatcttaaataactagaaaaataagggcaaggcacactcaaacttggtagaaaaaaagaaataatccacatcagagcagaagtaaatgaaattgaaacaggggaaaatacaaaacatcaatgaaatgaaaagatggttttctgaaaggataaaaaaatcaacaaacctttagccagactaaaaacaaaagagagaagatcaaaattttaaaatcagatgaaaaaggtgatattacaactgataccacagaaatccaaaggatcattgtagactactatgagcaactatatgccaataaattggaaaacctagaggaaacaggtaaattcctagacacatacaaattaccagtatcaaatgatgaagaaatctaaaacctaaatagaccaataacaagtaagaagattaaagtcataagaaaaattctcccagccaaaaaaaaaaaaaaaccaaaaaaaaaaaaacctcagggcccactggatttattgctaaattctaccaaacacttatgaggaactaatacaaatactactcaaagtgttccaatatatagaggaggagggaatatttccaaactcattggaagtactactaattctatgaggccagtaatatcctgataccaaaacaggacgaagacacatcaaaaaaacaaaaatgcaggacaatatctctgataaacatagaggcaaaaatcctcaacaaaatactagcaaaccaaattcaccaatgcattaaaaacatcattcattttactttaagttctgggatacatgtgccatgccagtttgttacacagatatacatgtgccatggtggtttgctgcacctatcaacccttgttctctgagagcccagtgacaatacctgcctcacctcacattacccaatggaaaataggaacaaatctactttgacaggaaaagtgctacataagtgtatggcattcttattttttaaaaacatatatgtgcaggttataatggctttcaaagctggcctccttataagtgaatgagatatcagcaaattaatagaatctattgtaccctcagtcctgaaaatatcttaatattccacacttaaaagaccactgcgtttttttttaataaagtgaaatctcactgtgttaaaaatagtgtgattaaaaacaatattgttaaaaaaaatcattcaccatgaccaagtggaatttatcccagggatacaaggatggttcaacatacacaaatcaatcaatgtgatacatcatatcaacagaatgaaggataaaacaatatgatcatcttaatcaatgctgaaaaggcatttgataaaattcagcattcttttatggtaaaaatcttcaaaatactgggcttaggccaggcgcagtggctcatgcctgtaatcctagcactttgggaggccgaggcggacagatcacaaggttaggagattgagaccatcctggctaacacggtgaaaccccgtctctagtaaaaaacaacaacaaaaaaaattagctgggcatggtggcgggcacctgtagtcccagctactctggaggctatggcaggagaatggtgggaacccgggaggctgagcttgcagtgagctgagatcatgccactgcactccagcctgggagacagagtgagactccatttaaaaaaaaaaatactgggcttagaaggaacataacaacaactgaaagccttggatctaagatttggaacaagataaggatgcctactgtccctactgttattcagcataattctggaagtcctagtaagagccatcaatagaaagaagtaaatggcttctaaattgtaaaagaaaaaatcaaattatctgcatttgtagatgataacttatatttagaaactcctaatgatgccatcaaaaaccttttagaataaattcagtaaagtttcagaataccaaataaaaatacaaaaaaaaccgtatttctatatgccaacagtgaaaaatatgaaaaagaaatcaagaaagtaatcccatttacattagctacaaataaaataaaatcccaaggaaaaaaccaaaaaagtgaaagatctctacaatgaaaactaaaaagcattgatgcaagatattgaagatgatacaaaaaaggtgaaaatattttatatttatggattggaagatttaacattgttaaaatgcccataacacccaaagcaatctgcgattcaaagaaatttctatcaaaataccatttaccttctcacataagtagaaaaagtattctaaaatttatgtggaaccacaaaagactcagaacagccaacgctatcctgagcaaaaggaacaaaactggaggaatgacattacctccagttatactacagagctataataaacaaaacagcatggtgatggcacaaaaacagacacatagaccaatgtaacaaaatagataacacagaaataaatccatatatcaacagtgaactcatttttgactaaagagtcaagaaaatacattagggaaaggacagtctctacaattaatggtgtttggaaaactgggtatccatatgcagaagaataaaactatactcttttcttgccgtatacaaaaatcaaatcaaaatggattcaagactgaaatctgagaccttaagctacaaaactactaaaagaaaacatctgggaaaggctctaaggcatgagtttgggcaaatatttattgagtaacacccaacaactacaagcaaccaaagcaaacatggacaaaggggatcatatcaagttaaaaatctccttcacagcaaaggaaatgatcaacaaagtgaagagacaacccatagaatgggaaaaatgttagcaaactctacatctgacaagggattaataaccagaatatataagaagctcaagcaactcaatggtaaaaaatctgataatccagtttaaaatgggcaaaatatctgaatacacattcctcaaaagaagttatacaaatggcaaatgagtaaatgaaaggtttctcaatatcattgatcatcagagaaatgtgaatcaaaactacaatatgatttcatctcacccatttaaaatggctcttatccaaaagacaggaaataacaaatgctggcaagtatataaaagactgggaatataaattactaccaccactatggagaacagtgtggagggtcctcagaaaactacaagtaaaaccaccatatgattcagaaattttactggtatgtacccaaaaggaaggaaaacagtacattgaagagatacctagactcccatgtttactgcaacattattgaaaataaccaagatttgtaagcaaaccgaagtgttcatcagtagatgaatggataaggcaaatgtagcgcatatacacaagatagcactattcaggcataaaaaaatgagaccctgtcatgttcaacagcgtggatggaactggaagacattatgttaagtgaaataagccaagcacagaaagacaaactcatgttctcactcatttgcaggggcaaaaaattgaaataattgaattcatagagtagacagtagaatgatggttaccagaagctgggaagtgtagtggggagtagaggaaaaggggggtggttaataagtccaaaaatatagttagatagaatgaataatatctagtatttgatagcatagcagggtgactacactcaacaatttattgtacatttttaaataacaaaaagagtatagttggaatgcccataacaccaagaaaggataaatgcctgaggtgatgaatatctcatttactctgatttgattattatgcattgtatccatgtatcaaaatatctcatgtaccccatgaatatatatattcgtatacctgaatatatatattcatatatattcgtatttatgtgagtatacatatgaatatatattcacatacatattaatatatatacctactatatacccataaaaattaaaataaaaaaattaaagggaaaaataaataaatactaaaaatgggcaaaaggtctgaatagacgtttttctaaggaagacatacaaattgtcaacagacacatgacaagatgtttaatgtcactaatcatcagggaaatgaaaatcaaagccacagtgagatatcacctcacacctgttagtatagctataatcaaaaaaaaaaaataagaaataatcattgttagccagggtgtggagaataggtaactcatgtacactgtttctgagaatgtaaattggtacaaccattttggaaaatagtttggagcttccttaaaattttaaaatataactactataaaaccagcaatacctctgctaggtatctatgtaaaggaaatgaagtcagcaccttgtagaaagatctacattcccatgtttattgcagcatcatgcacagtaacaaaggtatgaaaacaactcaagtgtccatcagtggataaataaattgttattttatatatacatacaaatgaatactattcagccttgaaaaagaaggcaatcctgccatttgcaacaatataatgaatctgaaagacattatactaagtcaaataagccagacacaggaaaatagatactgcatgatctcacttacatgtcgattgtaagaaatagtcaaatatatggaaacagaaagtagaacactagttaccagggacacagaggaagagaaaatggggagatgtaagtcaaaaatgtacaaacttgcagctacgtaaaatgaataagtttagatatctaatattataatgtacagcattataatattattaactacagttaataatattgtattatataattaaatttgctaagaaagtagattttaggaactctcaccacacataagtcacctatggaaagtgatgggtatactaatttgcttatctatagtaagcatttcactatgtatatgtttatcaaaatatcattttgtatatattaactatacacaataaaaataaatttaaaaaaatcattttgggggagggaagctgtaaatatctcacagatgttttacttcagctaggaaaaaacctgaagagttataaggatcatgtgtttttattaaaattatgtagttatatataactacacgtgttgttgaaacatagatagataccaaagcaaagaaatgatcgattggcctcaagatagacaggaaggatttaattagctcaacagtgtcatgatttaaataaaaataataatgataaaataactgacacttataaaatggccactgtgtctctatgtgattttagtgcccaagaaaagagctattactctttcagagttgaggaaaagatcagagatactgactactttttgctgctttatttttttccttttccttagaaactagcttcatctcccaaagtcccacctcatcctctgcctttactttgtactatgcttggccccattagcaacttaattgctgacccgtcatgtatttctctctgatatttgacatatcacatccttacaacataaccttattcaccatcaggggttcctaatccaaatttcaaggcatagataatagtttactgagtcaattgtaatgtattacacgggtttaaacacttacctaaaaatcaaaaagcacctcaagagtgttctaagatgtggcactggccgggtgctggggtggctcatgcccataatcccagcaatttggaaggctgaagcaagcagatcacttgaggccaagagttgaagaccagcctggccaagatgacaaaaccacaactctactaaaaatacaaaaattacctgggtgtggtacatgcctgtaatcctagctcctctggaggctgaggcatgagaatagcttgaacctgaaaggcagaggttacagtgagccgagattgtgccactgcacgctagactgggtgacagagcaacactcagtctcaaaaaaaataaaaaagtgaggcacatttcttcttttcctgcccattaaaactttcccttttactatatctggaggcagctaggtacactcttaaaggagccaggattaaatcaagcacatgaaatccaaattctggtcctgtaaatacaaatgtccagccactgattgaccagctattatatgcacaacactatgttaggtgcctcctgcaccttttcccatttgattccctaaactctcaatgaatacattacttctgtgtcttacagataaggtcacaagcagcagtctgcagagcccatattcaaaaccaaatccttctaaaatcaaaaaccaggctgactcccctggatgctattctaaagtcaaatttcaaattatactttgttttctacagtgtgagttgtgaaaagtagtacaaattcactgtgattaccactagcatgttgaaagataacattttatgggtaaaataagtacttattgctttaaaatgatagccacagatatcatccaggcattaagtttatatctacagagagtgttcatacaaaacttacgtatatatctactgatggtgttcatataaaacttgacctttccatccattcagtctttatctcttcacatatacctttgtatttgcttaaagactactttgtctatttagcaactcaacttttggttcattggagctagaattttcacctgtatctctacaaatctatattaattttatttcaaaatgactgtttttgatttgttttcccagatcttacagtatgctccattggaactagacttctaaatcatagagaaatctatttcttaaatgacatcaatctaagatccaccaaaatgttaaccctatgagggcagttctgtgttctgttcattgtttatcgcacacctagaatggctctttacatctatgggagctactcagcaaatacttgttcaatgattgagtgaatctagtccatctattttgactacataaattaattatttgataattatatttcaactatttaactaacagttaaatatttacatttcaactatttacatgtttgaactattcacaggaaaatgctatgaccaatttcttttcttgtagcctttcttttcaggagactaaaacttcaatgcatgcaatgctaatttgttgtcagcctcatgacatcttaaataaagaaaaccctctttatcctggggtggtttggatgaacttagcggaatgctcaaaaactaaaggtgaaccaaaaagaaggaagtcaatatagttcaggaagctccctcctcctgttggccttatttcgattcttctagggctatttacacgtagccaaataccccagaatttaaaattaaagcctttggaatgtctggcagaaagaatatattctagaagtaaaacctcagacttagattcttttgactgtttggcatcattattttgaatttgcaatgtgaatgagaaacaaacaaatgaaaaagataaagtaaaagaaaaccctcaatttcaaagttgcacatatttgtcattatttaaaaagaagagtacatgttaaaggcctaaatattttaaataaacattttctaccacaaaagatagcattttatcataaaattggcaatttttagaccattgaacttaatttgaatggactaaactttgtctcttggcaaccagaatccacacaaattggtaggcactttctctggaggaagatcatgcttctcaatacttatgaactccaagctaaaggctggctttactactgaaaacatcacaaagttaagccaccagtatagacaggaaggattttaagtttctattttctcttgtttgtgtgtgtgttcaattaattttaaagaaataacagtgagattcagatttcttaaaaatattttttaggacattattaatagctcaaataaagccattaatacatgcacgttatgatgatcaagtgatcctggttaaaattaagggaaaggtacactttaaaaatatgatttaaaaagcccccccagtcacttaacttcagaagcagggcccggtagcccaccctgtccttggtttttaacatagaaattaaggtggtagcttcggcaggtgttattaccaggggctcatgagtagaccctaaaaggtttgtgaaccctcttaggattatgtgcagcgtttcacatggatgggcacatatgcatttccctggggtaaaaggcatctgattctcaaaggagatatcaacaaaattgatgagaaattttggtgtagggaaaagtacgtaagaccaacatttaggaattctgggttttaattgtaataaggtgcttaccagttatataattgtaggcgaatcatttctctgggccccagttacttcatctgtggttactgtgggccccagttacttcactgtggttccacacttgtgggttgcgataactgcaactccaaagagtagttgtgggtctgtgaatccataagtgtaccaagtttcatctatggattgacaatctatcatatgtgtgtgtgtgtgtgtgtatatatatatatatatatgtatatatgtatatatatatatgtactattaattcataatgagtggtgatgttactgtgatttacaagaacacaaaagcattttaaaatatccttaaatttattgtagtttttggtcactacatgttttctgaatcaatcactgataaaatgacaattataagttttgccaaaacacattggaaggactagttcaaacaattctaagctgtgtccagctcaataagtgtaatgtttagatattttattaaatattccaaacgtgggtctgtgattttatgttttaatttataagtttctgtgtaacatataccaacatatttttaaaatgtacactgtttgttatcagtgcagtaaatggatagtaagaaatatggatgaaatttttttcccttattggtttgtacctatgtgtatgtgtatatacacacacacacacacacacacacacacacacacacactcaagagtttatttctttggtactttggctgctgaatatgagatttagttttagacaattttaagttgataacattgctctttctctcaccaaaaaagtggtcaagtaaattgacatatctaaattcaaattcatcatgtgaaattggaataataataaccaaatcatggcactactgttgctcaaaaattagagcctacaatctacctctgataggtccttggttctggcttattggtcagcctgcactcccatggataggtgtacccaactaagactaaagaaagttcttcaattatcatttaaagaaaattatttattaaactattaaactagttaaatattaataagcccaataataaaaatatgctttgtaaagcaagatttaaacaattaacaacatacaatttacttttcatctttattattaaacatgaatgaaatacataaattaaaaatacatttaatatgtttaattgggaaatttagtttttcatatttaaactatcctatatatatccaaaagcaagataaaaactctaaggcaattctaatttatcatgaaaagcttttgttcagtctaatggcctatttaatactaacgaaaagtccggcaacagaatttgggtttcttaatgttcctttacatgactaagcattttgtgttattattcaaaggtattttattatcttgtaaacttaagtttatgtttgtcaatgagacccccaaattcttcatttttaaaataggtaacaatatgaaattaaatgcatttattacttattagtgaagctctatatgtggcttctaattacatatgaatagtttggtcaagagaggcctcaaaaaaatgagaacaagttttcccagttcatctggactgaatcactatatgcataagtgatacatgttttattctcaaacacttgggttttgtttaagcacaccaaggattctagtttggctgtttcccaagtttgctttaaagtaagattattggatcagactggtgtttcaaagaaataaatcaaaatgtacacagtcaaatttgttaggcagaaaaaaactgtcatctctccaaacgttttttggtgcctatgtttctcaagctcaaagaaaataagacatgccaaaaaaggagcatctgtcttaatgtaagtaaagaaaagtgataaaaaataatttgtgctgggtgcagtgacctgtaataccaatgacttgggaggcggaagagaaaggattgcttgaggacaggagattgagaccaacctgagcagcatagtgagacccagtgttcaccaaaattaaaaaaaaaaaattagtttggcatagtgaagaatgcctgtagtcccagctactcaggaggctgaggcaggacaattgcttgagctcaggagctggaggctgcaatgagctgtgtttgtaccactgtattccagcccgggcaacagaagtaacatcccatctctaataaatacataaataagtaagtaaattatctgatgcattattcaaggaaaaaaggaaagcaacttttatcatgtggccctcaaatacaactttacctcatattgccaacttctttgtttttttgagatgggagtttcgctcttgttgcctaggctggagtgcaatggtgagatcactgcaacctcactgcaacctctggttgctcactgcaacctctgcctcctgggttcaagcaattctcctgcctcagcttcctgagtagctgggattacaggcatccgccaccacgcccagctaattttttgtatttttagtagagatggggtttcactatgttggccaggctggtctcaaattcctgacctcaggcaatccacccaccttggcctccaacagtgctgggattacaggcatgaatgagtcaccacactcggcctcatattgccaactccttaatggtagagaacaaaagtaaatagatttatgaaccatttcaattctagatgaagggaagtgtagtaggtctttctttaaaaaaaaatgggagattgtagttgctgattttattatttctagaggtggaaagtatacaaagcatgctttatacaattatattttatatacaggtatataaaaatggaggacattcttttaatgagagtttttttaaatgctattatatgtgctataggtaaatacatgactattttcaaatgaaaagcttaaaacttctcctgaaaataattcagtgtcatttttagtgattctccaatgagtttcaaatactatatgctatctgaaaagcattacaaataaaacacttcatcttacttattcaacaaatattttatgtactttgccagtcactgtaatattgagttctgattatgctacataattgagtaaaatatataccactttaaggaatatgcataaaaatgagagaaatgactttattaacacctaaccatgcaaaattaaaatgaacacaaagatagagaaagcatattgaaagaaccaaagtaaaaaaaaaaaatcatcctaattagagagattaaggaaggtgcaaacagacactagcctttgatctgggtcccattgataagtacaatgtaaacaggcaaagaagaaaccaaaagcagggctggaaaaccatgttgaggaactagcatgagcaaagacagagacttgtgaatttctagccccacacagggctctaaaagagataaaatacagttgttattgttgttgtttttcctttgtaccggctctatatcataaactgagaattattttattgtggatgatgtcacatctcaccttatttcttatttatattgccatttgttatttctgtatatgaagaaagtgggctgaaatatttttgaggctttttcatggttcacctttgaactaaaatgatagtattatttatatcttcgctactgtctctgatatataaacacattatatatgtcatgaaaacacactgcatggttcatcaattaagatatcctaatatttgatctcatctattaggagaaagagtagcaattgagtgcatccataaataaaataaacctgactgtttttaagattgacccgtctcatcaaagactaaaacacataaaaccagagtcagcaaggatgtagggaaggaagtctcacaaagttttattgggtgtatagaccagcatgggattactgagtttatagttcaacaatccatttcaaaaacctccctgttttctattttttatcttttgatacaacagctaaataatgaaatttcaaaggaacatgtaaatgttttggtttgagtattatacttctgacaatttatcctgacataataaatttggatgcacaaattaaaaagaatcttatgttagtatatataaacacaaatatttggaaattacataaatgcctaacaacagtttattggctaaaaaagttataatcatataataacacactatgcagctatcaaaacttacagtgtatatgcacatagttagctagtgatatggaaattttcataatatgtgtaagtgatgcttagcctagttcctcatatatagtgagcacttaatccagtttagttattatatctgctgttgtgtctgttattaataagatgttatataaatatataaaaaataagcaggttttatatctgtaaatacagaatggtcacagagagataaatagctatatatgtaacaacttattaagagttgtcatatttaggacatgatattttggtaatttaaaaatcattttttatgaataagaaggggttctgtagacattttccaaggttaccaatatttctatatcacattggctcacttcaaattaaaattcactctagacaaaacagtgtaacatggaagcttcagttccctgttgattcattaaataaagtctctaatgtttgatgttgccgaaatgcctggtaggatttcattaaagaccgcctaaactgtaaacattttatttgaaattagttatcttctctccttgacccacatatctctaaatcatgtgtatgaccttttaaaaaatcaattttatttggaaaacacactatctgagattcttttaaatcatctcagagacaagtcttccaaatgggcaattcagaaaggtcactcataagtaatttacatttaaactttatattactttctatcttttaataaactccaaaaaattgagaggttttcagaaaatacctcaggtctgcaattcaaatatttggggcattttttttttttttttttttgctaagcatatgtttgatttgccagtggaacagaattgtgttatccttctcctcaagtaacatctaactaagtgcagagttcataattaaaaaataataataacagcaatgaaggtgtaagtgaaagtacataagctggagttcctctattggtgaaaggtctttgctgcatcagctgggactctcctgacttactgttcattgctaaacttcaaactgatgtattgagaccaaattaaaagcaatctcaactgctcatatattctatcttatctctcaaaatctatgaatgtgctactctttggacagatttcttcaatttttaaaagtttaaatactttcagtagtgttctcaatttatcactccatgtcacatattcaatttagtcttacttgtaagacctatttcgtttgagtcgtaaatcaatctaacaccacacaattgcataagtcaacttttactatcttaattctatccattacttactgctgctctagattcaaatcaatgaaaccaagaaatcacacatgtttgagaatgttacttaattcattcatttgctttcacataggctacctaaatcactccaaggggtaaaaataaagtatcttttaaaatattctgcagataataaaattactcctttcttcagtaaagggcttggaacatctcttacatatgtttgacactgaaggaaatataaaagtgaaccagacctgggcctattaaaattaaaacttaccctaagaaactagcaaaaagaaaagtacttttaaggacagataataagatctgtctttatcttgctgataattttctttctttgtaaaagggattcaacatcataaaagtaaaaagaaaaaaaaagcaaacaaaaaatcttcatttcacactgccacacaactcacttctctaatttttactattttgataagtcacaatcatcaaaacaattactagaggccttcttcttgattcctgtattggtcttttaatacagaaagattttcaagctgtgatctctattttttgataatagagttcacaatgagctctaagaatgtgtcaaactgtcaattgatttcaaagataacctaacaaggttaataactcttatcttccggatgataacctaataactaagtattgcacatctttagtgcccaaagctgctctatttgtcatgttatttttcaggaaaatacaaatggctattcaaaatttacatgatgcatttgcaccaggtgagggttaaatcataccaggacccaatgctgaaataaaaaatttgaataatttaagtgaaaagagactcaagtcaccacataacatggtgaggtagaagcacgatgaatgcaaaagtatatccagtactacattcagttgtacatcgtgatttaatttcagaaagataacatcctcaatcacattaacttaatgattttatttgaattttattttattttaattgtattcaaaccttatttgaaaatttgctctggtcttataattgaatatacattataaatattagggtctaattcataatgcaatggttttatattttaaatattattataataaaaatgcataagttagtggcaggatttcaggcaaatgtttttcttttaaaaggagttgaaagttaagtctgaaaaacactggactatagaaacaggccgtcaatagacaataaggtttgccaaattctatgatctaaagctttcgtgaagcaacaggaaagggcaaattaatacctgtcaattgcctactgtgggcctattatatctcaagcactgtgctaggtactgttgtgattagcaatttcatttaattctcacatgaacactataaatctgctatcaaactgttaatgtccccataccatgggagaaaaattaggacatataaggatttggtgacttcaccaagctttcaacttcactaacaacaaagctgagatttttagaccctgattttagttttctccacaaccccatgttctcttccaaagcaattgtgttggctgtcaattttcaggttagaaagtgacaaaaataaaaggaatgtataaggtgacaagaatgtttagaatagtgaagaaagatcacatagatgaagacaaaaaaatagtgtgtgtatgtgtgtgtgtgtataatttatatataaataaaaatcatcactcttccaattactgacttcctattttgcatataaggaaatgaggctgagcaagttacattgctaaaaaggggcagagaaggaatgatcaatcttgcttgcttaggcccaaaggtagtgccctagttaatatgagcaactgtgattctaaatagagatttctttaggaaaatccatgagcaaggtgtaaacttcccccattaggaagagtgtgatggtcaaaagtccctcactacaacaaaaggcagcttggcacaggataagactcgtgttccagcctcactccttcaacggatgaatgaaaagggaaatactctttttgaagaccttcaaaggaatacatattttacaggatggatatccttcatttataaaccacacattttaggttgttcatatattatttcccgttaattatattttttgttaaaagatttttaaaaagatacagtcaaacatttctgaaaagagaatattgcctcattagtacagaatttatttggggtaacactaattaaaaattaaactaaatacaatcccaactaatcctagtccctttgacaacatttagatgacatcaagaataaatctattttaatgcttttgtcacatattattctacaaagtaaatcccacagttcatttttctaattattaatagagagccaagaggagaagctgatgattaatggagtcaggtacaagactacaggcaggtgtgaaaagtgtgtcagaaagacttgcgctcagatcttgtctcagccaacagcagctatgtgacttgatcaagataattaaattccctaagatttaggttgctaatctgactagcatcttccttgcaggatggttgtaagagatttaaaataacaacataaatatttaaataaaggcctagaattggcaagaagtcaatgtatggtgagtattattattagccagatgaccatattgttttaagcctaagtgaaaacttaacaaataaaaacatttattaaaggaaaaaagaggtttgactattaggccaataccagtaagatttatctgggtcatcaagctttttctcattataatctctcatactttcttctgtttactagtatgtttactactatgtcaaataaagaaaagctgtgaaaacatggaaaacaatgtgaaataaagtatcttttaacataaaccaaggaaagctgataaaactaaacaagacacatggtaagaacaaatacttgatatgaaggatggaaatattaattggataaaaagctaagtttaaaatacctacctgtaatatttttaaactgataactttaaacagtcattatgaacgttaataaaaatatcattaacccatttattcataaacaaacaccaagatataagggcattgaaaaagcccaatcactttaccctttcagttagttttgtttggaccaattgaaatattaaaattgaacagcccaacattgagaaaggagcaaagcctggacatagtttatgaaatagtaatcactttgaatgctaatggtattttaggcttagctgttttagtttttgaagtataggaagtggaggatggaaagattagaagctggaagattcccaaagagaagttccaatattggctatggtataatttacaatttattatagaacaaataagtagcattgttgagagtaatttaaaaaaactcactacaactcaaagtgatctataacaagttcatttgagtctggaatctttaagaaaggtgagtattgagcttaatttgagctcagagggaccaactgggtttgaccttaacatgtggaaatgttctcatcatttcttggataaaacatgctaccacatatactggcgtttatggtacttaaagtcaaataaatagtaaatgatattagtaatgatattctctgtatagagtatgaaaaacttatagtttgagaagtagataaagtaatacagtatttatatttgctttacttgtcttctttcaacatttataatgactttgaaatctgacagatttctcattttctaaacaatgacaacacagccttcatcctttctgctaacaatttgcatagcttcatttatcagtagtattataacatattaaccaaataagaacaattatagtaaagtttctcttacccagcattcacatggctggatatttacacaaaatacagtcttttaactagaaggaaacaaaatgtttccaaacaaattctgtaacacaagtttgttggactctgcatgtctttttcaagagagtccaccaggccctcaaatacagtagaggatcttttattttatagacaaattttaaagcaaattcagtcctccagtttccaagatgactgcagaatagaagcagaaaattagaagaggtgtttgttatattcacatactaatacctgtgagcaaagccagtggatatgtgggcaaacaggagaagtaatgcatgaaattgtatctcacactatcactgtcattttctaaagaggcaaacagttgtaatgattcaataactttagatagcacagttgaattaaaataaaatgtgattacaaatattcataatgagcatgatgcctagagctgaaaataatgtattatatacttgaaaattgctataagattagatcttaaatattctcacgaccaacaaggaaaatgattatgtgaggtgatggatatgtcaattaacttgatttattcatttcacaatgtgtacatatatcaatatatcaaaacatcatgttatacactaaatacataaaattttatttgtcagttgtatgtcaagaaagctgggaggaaccaaatatttataatgagaagtgtgctggataagaagctcttagccttatcacattttactcctcttaggaagagaagaaagtatttagtatgactttgatttttgtgttttaaagcaatacattgttattttaaatgggagagacatcttttatatttttcatacacgaaggactatatatccattatttagaaaatttacttaagaaacagagcctgacattcaacaagaaaaagaaaaagataattattgggtctgtatttagtgttaaacattgtactaattctttttatatacttttaattcgcacaatatttttatgaggtattacttcattttttttttttaaagaagaaggtacaccccagagaagtcaagtaatttgtataaagttacatattcagcaagcagtagaaccaaatccagtcattctcattcactgggtcctctgcacaaacactgtttatctactcactgtcttctcatctcacctccacataacagggttcaagtaaaagtaggtcattcatttgaatgtctttttttaacgaatattaaaattggattatgtttttacatctatatatcagcaccaaatttagaaaagcttacatatatttttgatttcctaagttatataaggtttgcatctttcaagatggtatcaaacaaactgtctccattaacatgttccaggatggattctagtccatattctcttttctctccataactgtgaatttgtactgttttctgcactactgatatttgcctaaaatgttcttgattgcagtatattttaaattcacaattgctctattttttatcttctgcaataattttcctttttctttgcatattctatatttttagtttatgactaattcatctgtggatgactcaagaattctgttttattctggcacatctgaaataatttctcttctcttgagatcaccaaatatatattcaaattttattctctaaatttcaccactgaaggcctaattgtttactcaattttgttttgtttttaactaccagaactttggtacccggtgtgcttactttaaaataatacttttataatgcaaaataatttttaatcaagtgatacaagggtgcccacattaatcatattttcatgaaacccaaacataccagatgcaccaacattatcctatcatggctcctgaagataacagtagagaaaaataggccaaatgaagcaaaaaacttttaaaagttgtaatgtgtgtattttagctgcatatgtgggcaacaaaggaagaaatcatgatcatttttctttagtaattctcacttggccttttaacgatatttaccggataactccatgtacagcattatcctaaaccaagtagctcacattttaaaaacagataagcgaacacaacactagattagaataataattccaatatgattagaataataatattctaatacgtatgtgtgcgcgtgtttggcgaaacaatatgagcacacctgacatttagtacataatgaataaacaaatgttgagaaatagaaaagggaaagaagtacctgatgtctaaaaaaaacttctattaagaagtagtagcttcctagttgaaaaaataagtcagaggagcattgcaaacaatggctaaaagtacagaagtgagaagcagcagaccatgtgcaaataactgtacataggctggggtggcagtagttgaaagatcaaagtatataacatgaagagtgaagaattcagtaataaaaggaatcagattgtagaatgtcttttatattatgtgttatcttgctcaaatatcattcaatgaagcttactgatttctctcacaccttagtggcctagttttaaacgtcagggttcttaacacaaaattaaatacgcctgcccaaatgaatcagattcagtcttctattagtgcccaggccttaggtgatatattccataactctgaagaagaaaccaattttaattttctttgtgttctagcatctatttgcaacattatttaagtggcccatttttttcctgatttgaaatcatctcacatagtgtgatctcatcccaggttcatggttttttttttttttggaagaccttttaaaagcaattcagcctccagggacaattttttttttctttttttctttttttcttttttttgtcatttgcttggggaaaagaagactttttaatgggaatggtgatgggagaaagcgctcccattatacagttttatcttttgaacaataatgtcttactactcaaaattaatataaaaaataaaactgaaatttaataaaaataaatacagataatcctaatatgatgcaaaatagtaacatatggaaaatttaatggaacattaaattccataaacatatggaaaaaataattcaagtaactctgaaatacatcatgttgactataaacctatggaaagtatagcataaaaataaaaactgaaaaaatattgaactttgattagttgatttcccgataatagtcttggtgatgcaattctgaagctactctgagtatattgaaaaaaagtgactaaacgtacatattttgataaataagaatattcactatagaaacagagaaatacaaatatcaaatggcagaagatgagaaacaaaaccttgtaatgctgaatttcatttgaggcaatcagtatgaacacacttacatgtgcactcatatgtgacaatgtgttaagtgcatacgcacagttttccccctaactctatcatcaaaagggccaaagcacaatgaaacaaccaagaggcaataaacactccaaacttagatctttgtttctaaacaaagatcttttatactaattttaattagtataagtcattttatactaataagaagcaaagtttttctgaaaattgcttatttcatactgaggcaaataaaagtacaaggtgagcctgaagcaccttaatgtgccagaaaataaagaaatgctcaaagtctaatggggacatgtgaaaaagacacagaggtcagtttaaaggcgaccccattaacaaaactggaacactctgaatatcaaaaataatcatgaaactaatggaacataacacatttgaacttaaagaaataagccatatatatacataataatgagagagagaaagagaagaggagaagagaagaggggagaagaggagaagagacgagaataggggagaagaggggagaagagaagagaagagaagaggggaggggagaggaggggagaggaggggagaggaggggagaggagagaggaggggagaggaggaggaggagagaggaggaggaggagaggaggagaggaggagagggaaggggaggggaggggagggaaagcgggaaaaagcttccttacaaaaaagaatgccaactgtaaatgtagaacaactatagtcaattatttggcctaacaaatgttagggaacataatataaattttaattttacaaagtttaaaaattcctttacaatggagatatttgatggtcagaatcttaaccaaataatggcacatatatacctactgatgcgatgatgtgggagacatacaacatcaccaatagcatattcttgcttgaaatcttaggtgtaagtttatctcattagaagataggcctttctatactataagatattctgcaggacaacggaccaggacttttcaaataattcaatgttacacaaaaaaattcacatgaggaagacagttgcttcatgaagggtgactaggaagaaataatgcaaatatatacaccttaattggattttagacataaaaacaaaaacaaaacacagaaatgcaaagacaaagcataaaacacagccataaaggacatcttttagataactggggaaatttgtatggcctgtgtataatgatagtaaattaatgttgacttgtgctgtaagtattctcaggctgtgtcagaaaattttatcattctgaaaatatacacattttaatatttattgatgaaatgtcatgacatttatagtgtattttcaaatgatttggcaagagggaagtgtgtggtaagatgttaacaaatggtgagcttggtgagggatatatgagtatatattgtaccattctttcaacttttctagtgtaatttgtctgtttcaaactaaaaacaaatagaacagcaggaaatacaatttgacgagtctcattcatcctaaatcccagataagtgcatccattccttcttctgggcatgaaaattgcagtggggactggcttcctgcttcctgccaacaccagtttctagtctgatggccctcaaaggttttcctaaaattatatattcataaattaaacataagcctctcacacaagaatactttcaatggttctattgccctatgggaaaacttttaagcttagtaaagcatttaagagctttcatttgataatataatgacctagatttgtcattttccctgtaaaatgacagtgtttaaattaaaaaaaaaatgggacacaactgaagtttgaaattaccttgaagttttgagttgaattgattttaacaatattttatttgcttttatagaacctcaacaaatatgttttaacatcattgttatctcagatctatcacttttattttgttctaataaactacaggatacaaagtagaatgccagaccaaaagttttggaacacaacatctatcaagcaagcaacttcaattgttcccccaatatggcaccatttctttattccttccaatcccctaggaagcccaaggacaagtggtcccatatgagtacattattgctgttgttattaataactgttgttactctgaggcttagagagattaactgatgaactctgcctaacagggcttcatataggtgtcgttaggaaagaaccactgaactctaagaccaacattatgtcttctgtcatgtgttaggcaattccttttgatgtctatgcagttttacaatttaaagtagtcatttaatcaaacataactttcatttgtgaagactgtattccagaacatttctccagacatctagaaatcatcacaaaatttatccaagtctctcttctatacattagcttcacaattagcagcaatcagataatctttttcagataatcattttcaccatttcttctacatagaaatgctcccaattctgaaatgtgaaagtctaggtctgactgtaatggctaattttctattgtacatatctatggaagcatattgctgctactcactcataacattccaaaacaaaaacaaagcttatggtcctctcctaaaaattcgccttcttctgtaatttccttataagttaatgatgtacaccaagctcccaagtgggaactcttgatgccttgtaggactttaccctttccttcccaccagcaacaaaaagtagttttagtataggagaaatagcaaaagaacaggagttgatcttaataacattgaatttgcttttacctcaacatataggtttcaatatcattcatatatccagatttctctctttttgttctaataaactacagtatgcaatgtagaggtccatatataggggtcttggcatccatagctacaaattcacattttcactacatgttcaaccaaccgagcacagacccttaatagttttggccctcagttttgtttctcttttctgaaatggagatgtctagccttacctcgagaagttgtaaatagtaaacatgaataatcagtgtcaaatgcttggcactttaatagtgtttggcagcaaatagatgatcctaaagttgtgttgcctaaagcgagatgcatttgagctgcatcttgaaggataagttggttgttgctatgacctcatgaaaggactttattaggcgggggaaatgagaattttactctgaaagaataaatgatgtagacgcaaacaggctaaacttgaagccagaaaaatagagagaagccagattataaggaatttcctatgacaaactaaggagtttggatgctagagaaccaataaatgttcataagtaagagagaaacataatggagctttgtgtgtgtgcatgagtgtgtttgggtcacagtgggagaattaaatagttgttaaattattcctttattttattgaatatattccaagtttaaaacatgatattttgatatatatatttacatagtaaaatgattactatagccaagctaataacatatccatcatctcatatagttaccctttgtgtgtgtatggcaaaattacctaaaacctacgtgccttttttttcaaatttctggtttatgactcaattttattaactataattctcatgcagtacattagatctccagataacctgtttttttaaagaaagacagttgtgtgcagcttataaaaaatacactggattacaaagggcttaaaacaaacactgaaattcaccaggatgcttaaaatttgtcaattatccagctatgacaaaaccaccgccaacaatatactgaatcagcaaagcctggaaatatccccctagagaactagaacaagacaaggattcccagtctcaccaatcatattcaatacagaatggagtgctagctagagcaacaaggcaacagagaaaaataaaaggcatccaaataagaaaataagaactcaaactattattctttgtggatgagatgatcctatgtctagaaaaccataaagactccaccaaacggctcctgggactgataaataacttcagtaaagtttcaggatacaaaatcactgtacaaaaatcaggaacatttttacacatgaataacattcaagctgaaatccaaatcaagaatgcaatttcatttacaatagacacacacacacatacacacacacacacacacatacacacaaaatgcctaggaatacatctaaccaaggaggtgaaagacctctacagggacaactacttcaaaacactgttaaaagaaatcatagatgacacaaaacaaatgaaaaaacatttcatgttcattaattaaaagaataaatattattaaaatggacatactgctcaaagcaatctatagattcaatgttactcttatcaaattaccaatgtcatttttcacagaactagaaaaatgtaatgtagcattcatatggaacaaaaaaagagcctgaatacccaaagcaactctaaccaaaaagaacaaagccagatacatcacatcttctgacttcaaactatactacaatgctacagtaaccaaaacagcatggtacttgtacaaacacagggagatagaccaacggaacagaactcagaaataaagctgcacacctacaaccatctaatcttcaacaaaattgacaaaaataagcaatcaggtaaggaatgtctattcaatcaatgttgctggatcagctggctagccatatgcaaaagaatgaaactggactcctaccttttaccatattcaaaaattaaccaagattgtttaaagatttaaatgtaagacctcaaactataaggatcctagaaaaaagcctagaacaaaccgttctggacatcaaacttgggaaagaatttatgactaagtccttaaaaacaattgcaacaaaaacaaaaattgacaagtcagatctagttaaacaaaagagcttctgcacaacaaaagaaatgatcaaccaagtaaacagacagcctgtcagaatggaagaaaatatctacaaactatgcatctgacaaaagtctagtatccagaagctataaggaatgtaaacagttcaacaagcataaatgaataaccccattaaaaagtgagtgaatgacattaacagacactcctaaaaagaaaacatacaagaggccaacaaacatgaaaaaaattatcatcgctaatcttcagagaaatgcaactcaaaatcacaaagagatgtcatctcataccagttagaactgctattattaaaaagtcaaaaagcaaaagatgctggcaaggatgcagagaaaaggcaattattatatactgtcggtgagaatggaaattagttcagccactgtggaaagcagtttggtgatttctcaaagaactttaaacagagctatcattcgacctagccctcccattactaggtatatatccaaaacaaaaccaatctttctacccaaaagacatatgcacttgaatgttctttgcatcactattcacactagcaaagatatagaatcaatccaggtgcccattaaaattatgttctttgcagcatcatggatgcagctagatgctattatcctaagcaaattaatgcaaacagagaaaatcaaatattgcatgttttcacttacaagtaggagctaaacattgagtacccactgacataacgatggcgataatagaaacagaggactactagagtaggggtgaatgggagaaacagttgaaaaattttctatgtcctctcttctggatctgtccatgcaaagtaatcaattattttagagaccaaattacgttttgcgtttttgacattttcagaaattctttcttttgtgggggttacttattcaatctggcctccctacagggttcagggagaaaatgagaacaggatggcattcacattactgacagaacaccagtcaatgaaacattatctcctggagccattctctaactgctttattatttttgtgctttaatcaatgagaatgtttacctatggggaaaatctttgcataggtagactcactgaggaatctaacaagtctatcagtagaaagctttttggctttaaaaatggattgaacatattgaattttttaaacaaagaactaggaaacatattagagaccaaatttttaataatgtaagtaaatgagaggttgcaatgagaattgtgaaaaaaaagattcccttttactgtatcacttattaggcctcacatgacttaaataatttccccattttatcctacctcctgcattaatattttgctgttcttgcatgttaatgtttatagaaatttctattttggtatgctcatttttttctgttgaaatatttgctgagttaactctggttactttaaacaacatttccaaaaagcatatttacttgcctgccaatgccttccacatagggataaatgcaaaatcctcactaggacaataaagtcacccacaagcttcacctcctgactcaaatgttgtacttacaaatacacatcatggaggtttaggtacctaaaacgtgttctttttaccattgcgtccttgcattgttagttttttttttttccctattatccctctctaatctttgcctggtgaactcattattcaaacaccatctctggctttaagtattatatttgctaactacccacttatctgttggtatagatttagttgattaataaaataatataatccattatgactggaagaaataatccactttactgggttggggaagaggggtcaccagggcttctctcccctttttgaacaaccttgttcagagctaaaggaaaagcagtaaataaatatctactatgtttaaagttcaagaagtcttatcatctttcctcatactactattaataatataaataatttccacagtgtaaagatgtcccttggaaacaactgtttacttgtaagaacaagctctggagtcagaagtcgcaaattggatagtgtagcggttggctttcaaatgtgatgagcagaaacagagctttcatggaaatgcctgagaggtgattgggagagtggcaggaaaatggaggccaaaaggataggtggaggagaagggaggggagcttgggacaacctaacctaatctcagccagagaagtcccgattttatctgttttacatattggctttctgtatgaccgtccttttcttaaaagaaagaaaacaaaaaagctgcttttctgtatgttaattgaaaactactggtataaacattcttactgcccatattagtgttttaaagcattaagaactttattctgcaattaatgaatcagctattggtattcaaaccagtttgagtcaggtgcaggttcctttaattaagctcccagtgtggttcacaaaagacaggtggctacagtttcactgctttgctcaaggatggcatgctgctttcagtttccactgttatctaatgactagaaataaatttttaccaacgatactgaaaaatgaaatggtcacattatatccttcttttacacctttatgaaattcacctaacagaagaaagcattatgtttcccagttaacttaggtctaacctggcgaaatgcaagggttcaagtttgagaattcataaaattcgtagaagttttatgacggtacatggagatcattcctgttttcctgtattctgtccagctaacatgcacacaccctttttattttcattgttagaaataaactaatttccaaaagaaaatatgaaatcaagaaagctattgctctcctattatgtgcaaatattagtttccaaagaaataaagttaattatgaaaacaattcaaaatgcacaataaaaggataagatatggacctaagaaagtaatacaaataaggaagaagagcaattaaaggcaagtgcaaataaagtaatacaagagcagaaatgaagagcaattgtgttcaaaagaggcaacagatgagaaacaaaaaatggtcacttcctaattttacatctggaaagatattactgtgtgccccaactaaacatgaagcccagaatggcttgctttgtttcctctttactgtctagatagaaggttgatgtgcagatacttgattttctgattgtgctctgaagccactcccctagatgaacaagcagtttctgaccactaagagtaggattatgtaataaaagtacagtgcctaaggcatcaaaccctgattttagtccaggtgttgtccagagggagccaactttgtttcaccatgagctcacattcttccaattgtttcacctttattgttgtgctcttctacttttgtgctcccacagctctggatatcttccatcaatagaatcctcacactatactgcacttgcctgttcagtatgtctctttcattactgtaattcttatgaaggcaatacattgttctacttgattcccattacatacccattgtgtgtcgttttgaaatacagtaggtatactaaatatttgttaagtgaacatattttaccataaaacatacaaccatgaaatattatcctagttgaagaaacacttcaagtaattgaccagattaatgattgagactgaggcagtgttccatgggcaatttatgaagtaagagtttagttgttaaaatataccaaatgtaaaaataataacgcatagatttttaaagaaagttaaagcaaaacgtaaggaaatctttgaaatatattattttgaacattattatgaatgcataaaaagtgttatctacaaagatactcattgcaatatttttaaatagcaaaaactttattcaatacccatactatacaataagaatacaatcattagaaacagtattttaggagccaaaaatgatatatacatcaatgtaatcaatatgcaatacttttattttttcaggtggggtcttgctctgttgcccaggctggagtgcagtggcacagtctcagctcactgcaacctctggctcctgggctcaagtgattatcctgcctcaacctcccgagtagctgggactacaggtacatgccaccaagcctggctaatttttttttttttttttgtattttagtagaggtggggtttcaccgtgttagccaggatggtctcgatctcctgacctcgtgatccgcctgcctcagcctcccaaagtgctgggattacaggcgtgagccaccacgcccggccgaatttccttgttatctattagacaccattaagggcaactactctttattatttacattttgtatctgtgtttagaaaaataccaggaatatgttctatgctgtactgttaattgaaaaaaaataggtaaatgaaaatatttctaaacagaacctattaagagatatttgtgagataagtgtgtgtgtgtgtgtgtgtgtgtgtgtgtaacatatgcacagagagggaaataagtcaaaaagagcaagacaataccaatggtattctctgggaaaattttagtttttgttttcactcagaaataccttcttaaatttttgcactaaaatgttaatgataagaataaaaaaaaacagaactagaaataatgtgaaaactattgaaaataatacaagtttctataaagtgagatgctttgacatgtgacaattcattattagaatggcaaaaagaagtgcaagactaagaaattagaaaaaatacttcaaaaagctgtcagggagtcctcccagatattccaaaatattatcctctccttattgcaagaaaacgctctccttctgtcattatttgctgtgagagtagctacccaaaaagctattttgtagcaaaaccagttttattgttatcattgaaaagaatttttgcctcacatgtctgacccaaattccagtgtgattctaattcacaggtttgtcgttaggatcaagggagatactacttgtgagagaaattgtaaatgtataaatgtataaatcaaatgcagttatactccagttttatgagaccatcagtgttgggaaaaaccaagactagaaaccagaaaatgaatttatttagcagagaaaaatcagtctaggaatttttacttgacaatttctttttctcaaatggcagattagagtgtgtgtgtgtgtgtgtatctgtgtgtgacagagagtatatgcattagtttttaaagcaatgaacagaggtctatgtatttcatttctgctatgcaggaaaaactgtgctgaattgaaacctgaaagagagtggttaacattttcagaatcaactccatttccagaacagtctctgcttttacaatgttttactgtaagaactatgaggtaagaacaaagattgaagtaaaagaaaattattctagggttaaatgggatattgacaaattagattttgggagatatgagaagttaaaggggaagaactttcgcataccgggaagctctgggcctccttgcaagtgtgcaggttatatggcctgtctgccactgagcctgctgaactctctattttgtgttggacggtaagagctgatgtgtcctgtgtttgcttttccaatttatcaatctcaacaatggctcatattattcccttgggttgacagttcaatagagaaagagcatagtatggtagacacagtgtgagttttcgttcagagaaatattgtctatttaacagaggagaaacagtagcaacttgcttatcccctctgagtctcagttttctttctataaattgtaaacaacaacgtctatagtgcaaggatgttgtgaggctaaagatattttaagtacaattgttggcacatattaagtgcataataaatgtcatcatagttactaatgactgattctggcatggatgtctgtttgcatgtgtatgtatgtgtgcaatgtgtatttatacattattaaagaaactatgcattacttcacttctcaagcacgggtttcattcagtctatttgcttttgactgctctatattgactgttctggtcactgttttgtttatgatacaaagaagatacttcaggcagaattatctttctgaaatgcagttctgttcctgccactcttctccatataactcatgtcccagccaacttctcaggtgtcagctctcagcaaagtctcgctctcttccaccatgtgcacatacaaacaaacacacacacacacacacacattgctataatgcacaatgttctctgcgttttctttaagctaactcacaccctgtccccatttcctgggatacccagtctctgccacttttctgaaaatctcctatacatctttcaggtttcctcactgaaacgtttttatgacttcctggactctctaatgtgcccatatagctctctgaacttccaactgttactcagtagcattgtatagattgtaatccctgttaattggtatgtctcatacactagcctgaaggctgcacaagagtggggtttttctccctctttcactgtctcattgctggtaaattgtagagtaaatggtattggtatgcattcaatgagtattggttgaatgttctgatgcaaaattcataccccaaaacgtaaagaaaaatttctaccattaacttctcagtaccgcctactacctcttgtaaattccatagtaagttaaaaaggtgaatgcagaaagagagcttttttttttaatccccaggaatgctaatgtggaaagtcacagggtttttgatgatgtcagtatttttatttttctctcaatatgtatgtatagaggaaatcaaacaatgggtatccattttaaaaataaatcagaacaatttattttcagccttgggcaatcatttccatttcttaaatgagaaaaaaagagaaaataaaacaggaacagatgtctatttccatccattatcccataattgtttttatctgtaaaacatcttctaaaaggaatatagagaagacagtaagaaaaataaaaatttaatagttattatatttgagcgtttggataatggaggattttcccctctcttttctaaactttctataatgttaaactatctttaatgcaatgaataaaatgaatagagagtgaagaaagcaatcatgtttctgaattaccttcatttatccttctgcaaagatagtgaaataaaaaccctgatgttctagatcaaatttattgcagcctattacagtaccttgcaatttgtaagactcgtgtttattgtttgcggattgagggttttgaggaaagagaaaggatcaagacacaattatcaacattccactttttaaaaattcatgcattcattgtagtgtatacacatctacacacacttatatgcatacacacacatctatgccagtagattaaaatcccataccatagaattgggcaggtaataggctctcagaataagacctggagaatgactaatttgtttctttaaatttcaacagcctactttatcatgtttttttctttcttaagtcagtatcttcaaagaagcaaaagaaggtacacgaagcagaaatgtaagccaaatatatacactctgatggcctgttaaagtcacataggctgacctcttctaaactataaaaccacatgagcctccaccttcatttgtttcctctgtccttgccataggcactaccacagtgctccatggggcgctgtggccagtcgctatcagaaaagcacatctccttggtatccacaatatcaacattgcctatgttggatacttaattctaatatccatgctgctgaatcatgtaatttatggtgaaaaaaatcaaaatgtcatttaatggagaaagaaaaattgtgaaagaatcacacaattgagtgctttatgatgctaaagatatttcaagcagtcattttcatatgacttttgtaatgtagcaactcgtcttacaatgttttaagagaagtattttacctaaatgtgcatgtcttctgaccattgcatggagaataagcttctgtaaacaccactgaaagaacatattatgttttatgttaacacgttatatttcatgtcagtcttttggttcataaatggtgtagataaaattactgttcaaagaatggttatcaacctgctgttctcctttcattaaaattaggttcatattctggtcatttcttagcagttttattcaatgttaagtccataggttagctaaaatgctgtttcttcccagtggaagagttgggaaagcacaataccagtcatgtggtgccttctacatcaacagtatcaaaactgttccacctaagatggaaatgctgcatatcttaaagaaaattagttaagaattcaaaagcttttcattgacctcatgagccctccaaaaataatacagagatacctgacattttgtagtgttcttctagagagaatgctaaagtgtttttgcttaacatttgtgtgctccctaaggtaagtaaagtgaatgttattattcttatcacatgttgtataaagaaaaacaagaccagagagactaaaggataaacgtttatttaacaatttagtaatataatcaggtctaacatgagagcccagcactgctcaatagaactttctgcagtgatagaaatggtctataaatctaagctgtttgataccagtggctattgagtacttgaaatgtggctggtgcaacagagaaactgcatttttaatttatttaattttaattaattttaatttaagaaaccacatgtggctagtagccactgtagtagacagcacagctctagtcatttcccctgtgttctgtcctgtaatcacctggctgattttgttaccattgttggcatgataaagtaggctgcttgctgttaattgttctaaccttaaagcctggtggtaggcatggtacattgtggaacaggtgctcggatgggtgaatgtagaaaggcttcaatggcaagggctaaggattaaaatttaaaagactgaatgtaaaagacttttagatttatctttccaaaataataaaatacatggggatactttcccatttactaagttcctgaaaaatgatatggacaatttctataatgatttatggcctgtccaacgctttcacgtgttttttttcccccattggcattaatagtggtaacacaaagccaacaagcaagtaattttgtgttgtttgtatacacacacaatcaaaagcaaagataaggtgagtaacttgttcagttacagaaccagaaggagtttactgttatcattcttcaagaataaaaagagctgggacaattcttttcaatctactacataaaatatttcaaacagttcagcttatgttttagagtcatacattaatcactaatgtgtataaacaatgacactaaaagatcttatggtgattattcaggttcaatggtaacagttaatgatgattacgtatgccttactataacctcttgaaaattggtaaattttgcaaaccatgtatgttaactcttgatgaaggcacagataataaaactcatgtaattataaaattaacaaaaaatgtacatttccacagcatacagaaaataatttgccatatttatttctccactctcaacttcttcgttagcttaaaatgctttttttctatctaatttcttcacatttcatctacactctgatcataccttgttccgtccttgtcccaaatgtatcctgaactttcttgcttcttttccattgtgtgtggagttctgttcattcagagtgcccttcccacttgtccacctactaaaccttaacatttttcagcatctagatcaaatgcctcccactacagaaagtcttttctctcatcagaattcatcactccttgttcagtattttcttagcaattctgatcttgatctcacactttgcacaatagatatttatctgaaagccttgttattagttagtagtctgaatgtaccatgagttgaagaccatttgaatctctttaaagttcctataagataggttcttaaataatgctggttacaaattatttttttaaaaattcaattgtgaaacagcatttgtattttgtcttgctaacgtcagatcagcttcacaaaacagcatcagaaactcaaacctctattcaggcattcctgatactattcacaagtgagaatctgaaagtgcaaagcttagagtagcagattggcacagaatcccctcagcttgaaaattttgtcggaataaataatcacctaacactctgccttcacactctttgcacgtaaaagctaaagtgttcagaatgcaaatcccttaacaaaattccaaagtagagcagtcagagaataacattaaaatcttagtgatagacgatatttatcatggtacactgattctaattaagtgaattattttgttgcaagtattttattcacttattcaagaaatatttattaagcatacatcatacgctaggcactctgctaggctagagattgaatacaaatattacattgttcctattctcaagaattcatagtctcctaggaaaggcacagtatgtagtatattaaaaagaaaaactgggcgggcgcggtggctcacgcctgtaaacccagcactttcggcggccgaggcgggcagatcacgaggtcaggaaatcgagaccatcctggctaacacggtgaaaccccgtctctactaaaaatacaaaaaattagccgggcgcggtggcgggggcctgtagtcccagctcctcgagaggctgaggcaggagaaaggcgtgaacccggaaggcggaacttgcagtgagccgagattgcgccactgcagtccggcctgggcgaaagaatgagactccgtcaaaagaaaaaaagaaaaagaaaagcgtcggtacaataacttctattttgttctcagcttgatcaactaatctgagcctatttcttcatctgtaaaatggagacactaaaattacataccttactgggttattgtgagaacttaggaaggtaatgtatgcaaatacatgaagtatttagtccattgtttgtaatttaataaattctcagtaattatcagtaataataattgcagttcaaggtgaaaagtgctatgaacaaggaaaatagaatatactatgcaaatgtgaaaggatgggacctcattctgtcaacgtaagttggagaagccttctcagaggaggattgttgaaagacttgaacgatgagtaggaattttccaggtgacatcactaagaaaggaatggatgcttccgatgaaaaaacacatcctcagaagaatatattcaagagaattgtaagcagcacagtatggctaaagcagaaggcggatggagaagagactaaagaacatgacaaagagatctcataaacattcagaagaggaggactgtggatgtatttccattttaccaaaagcaatgtgggatgaaatacactttagagtgctgaagcattaagtgagaaaacaagctgtaagtttatctcaacagttccaggacatagatgacaagatcttgaacttagttctaaacaacggggatgaagataagaaaaaaatgaggttgtcttgaaatggtgtaatgattggtaatggagattgagacatcactataaaatcacagaagaaagtatgttcctgttttttcaccaacttactataatgaaaatggacatataaatatatttcatttattgctggaaaactaacaggatcatatcagaaagaatgaagataatttctctctattacattgaagaatattgcaggattagttcatgctttaaaatgatcttcccccatagagacaatattttttatttttactttaaataatcttaatatttcattcattttaaaatgtaaatagagtttacaaaaaaagtatccaaatttatcccacaaaagcagaaagggaagattagaaatctctaactgtgcatagtgttctaatttttaaattctaattgtgttttatcctatctcaaattgtagaatctttttaagaactatttttaattttagaaacttatattttttatactaccaaagattgaagttgacaaggtatagaatttttcaacacctaaaattatcaaaataattaacttccaggacaacactttaactcaactacttccccaacctatgccctccagccaccagaaagaagccttcaggagtccctacagcacccacacaggtcctctccagttttccccctcccttcctgatgctgtgaaaaccacagaataaatgtttatcactttcaaaaatattttatatatatatatataatgtatatgaatttttctttttactgcacataatatagtatcctgttcacctctcagataaataaatcataattatcattttctgcttttaaataccctgaaaatataatataaaaattacataaaatcaattttttgaaacataaaaaaattaaaagaattacaaaaacaacttgttcaataaattttgtcttataaaatatctgccaaagaaaatattctaaagagaataaaaatgattgttcctctaaggcttaggcttaaatattcacacatttcaatataaaatataactaaagacatctttcatttagcataaattgttctgatacctattagataaatcagtatttgcagtgaaggtattttaagataaaccattatagtttacaatagcaattctcaaactttctaagtttcataacacctttgcactcctaagaagtactgaatgctccaaatgacttttgtttatgtgggcaatatccactggtatttactatattaaaaactaaaacacaaatttaaatattcattgatcttaaataacctattacatgttaacgcaaatatttttattgaaaattgtatatttccatagaaaatatagaaatatttttagtgtgaagggtggcatttttagtgtgaagggtggcattttttcttactttatttttaaaaagtttgcaaagtgtcagacttcatagaagatagttggatttttatagctatcgcatttaaaatgctgtgataccatgtgtcagaaagcctacagaaaattcgatcatatattcataagagaatgagaaatagagatatatggcattttaatactatataaaaatagttttgacctcacaggacctgtgaaaggattctgaatctccaggtgtctttggatcacatattagtaatttctgctcttcaggaaaatgtcaattggaagtgtaaacaatttaaattttagtaactgaaaatacaaatgttaagatgattgtagcaaatttatagaaaaaataaaaactgtgatgtcatgttgaaataaatatattcataaaaataccagtggctccatcagagacagatatgtctaagaaattaatattatgcaaattttaactaataatccagattttgtcatttttaatgttcagatgctgaacataaaatataaacatattataattaattttatatacattaatatacgtaaagtttctaaataactttatttttatctgcattttagattttaaaatgtcaaattctaaagtaaacatagttctacaggtataaattgataaaaatatactaatcatctgacagttatagctctttttaaagcagttttgagatactctatttcaagaacaaataagagactactaacacccttccttccctgctccacataacagtttcacctcttatttgagagaatgttcagatattgaccttagttgagtcagccagagacacagagctctgggttagaaccactgcctagccaggaagagggaaatgtgataagaggtcagtgtattgctaaaaatcacactcctatctatgtttagatgagatggaataaatcatgaaggcaaacaaagtcttcttgacagaagaaagtatatatacagctagactttggaaagattttcttttcttgttttccatagaacattttaaactcagtttaacatatggtgtttagcaaagtcatcgctgataagatgacatttgagtagacatctggatgaagggaggaagcaagccatgcagactccgggtaaagcatgttctcagcggaggaaactgcacttggaaaggatctgaggcagacttgtgcttagaatgtttgagaaagagcaaggagaccatttggccagagtaagatggatgaatggggcaagtgaaaggcatgcagtcagagaagtagtagggaactgattatgtaggtctatttatatttagaatgaatgaatttgggaatgactggaaggctgtaaaaagaacagagacattatccaataattaacacatattacaattactgtgtgtcaggctctattctaagtactttatataagcttgtgtcatcctcacaaaaaaaaaactatgaagtaggcacataaaggatattgctaaatattaaaagggctttgtgaaattcttcagattgactttctaaaccacctttgggcaaagacaaatatttcctaggaaggaacatccattgctaactaaagttgagtgagtgctggttaatgcttggtgcaacagacctaatatctgatttaaaagaatcacattagatagtcttaagaatagatagtagtagggcaagtgtggaagcaggaagatgagttgggaagcttacaatacccagaaattttaggaaacttggaaaaatgtgtgagatgaacatgtttgagctgatttatcctagattccccatcactgctggtgacctagtagagttagttgcagttgacagaaatggaagtaaaggagaccactaaaataacatcacagatctgaaaccaaatgaccgtaagatattttccttagtataaacagtaagccaaaaatgaattcaggtgaagtcaaccattatttctgattacattatatataaaaaatattctagatgaagcggtttttaacagatattagcactcccatgatattgataagaaaacaagttcagaaagaagcatgtatactgaagaacacatagctaataactggtagagtctggatttcaatccaatggtgttcaactttggggcctaaaataactgctagattatatcactggctctttaatttatagttgctaggggtactgtgaatctctaggtgagaaattcttcaagaatagcctaaataattcaaggaggtttaactggatccaagtggggtaaaaggagaacaccaaaagtaggcaccatatatgaactcactgttttagaatattgttcttagcatctagacaggtgggtaaacaaatgggtgcaatgtacaagcagctcagctgttcccagtgatttgtgttttgtcaaaataactcagccaagttgtcctcagtaaaaatgttacagcattttttttttttttgcttgttttaaaaacactggcgaacccaaagagacacagcagccaagaattgaggctgccatttgcaactgtgccagggtcaaagtcactgtctgtccttgggccattcattcaaatgttttgagacctcatttgtctcacagataaatggaactcttgctacttatccatttttcctttgagatccttcagataatttgcaatttaatgagaagtatgggcaagatattatcaccttctctctgctaattaaattcttcctttctttacttcccaaacttcaacataacattccaagacttacttgactattcatgatcctcttctttttcaattttatcataaatttgtcatctggcattgagcattcccttcattttaatggtgataatccttttatgcatgtggcctgtctacccagagttactaggagatcctagaaggcagaaccaagattacatatatatttccatgtacacccggtgatcagtgaaatgctgtgcaggaaattagaactggctgagaattcgatgatggtaatgatgactgtaatagcagttactgtttatggagcacatactttgtgccagtcacattatataatgtcttattttatccccacaaaaacttgcaaggcatttattataatatgaatttagaatcaaggaaactgagatgcatagataaactgagatgcataagtagtgcataaaaatcagaaagtcagtggcagaggtatgataaaaatccacactgttctaactctcaaatcagtgcagaatggcagaagtgtcatttcagttatatatgtatgtaggatccattcgccatgcactcaccaatacacttatgcatcagtttatccatcagtttaataatttagccatccacccacctttcctccaaatatccactcttccatccacacactcatttgttcttatattcacgtagccattcttcaattcttccattcacttaccttgtcttccattccaccactctcttcatgcattcaactaaccattcactcatacactaaataattcattcatatatctactcatccaattattttctaactcatccatttattccctaacatatctgtatattgaaaccattaccaatctgttgatttattcatttagtcactgattcattcatttattaatttaataattcctgacatctatccattaattctatcacctattcaactgtttattaaaatatatgcatttattaccattattaagtatcttctttgtagcaaacccttactagatacaaggaacactaaaatgagtaagacgtactctaacctacagtatcttacagtctgattcaaataatctagaaaaaaataatgtgaggcaaaggagaaaatatctttgttgtgtggagagaagcagttcaataaaaacttaccatcccagcacggtagttcacgcctgaaatcccagcactttgggaggccaaggctggcagatcacgaggtcaagagatagacaccatcctggccaacatggtgaaacctcgtctctactaaaaatacaaaaattagccaggcatggcggcacacgcctgtagtcccaactactcaggaggctgaggcaggagaattgtttgaacccaggaggcagaggttgcagtgagctgagatcatgccactgcacactccagcctggtgacagaacaaggctctgtctcaaaacaaacaaaaaacaaacaaacaaaaaaaacttaccaaaggaggtgatatacaaatgcaggcttaaaagaaacagagaggtttacaagttggaaaacaaaggaaacatttcagacaatgggaaatggtaaagcagatgcaaatttacattaaataacaggatatatgtggcatactgttggtcattccccaatatttattatgcctttctaatagtaataaaattacgaattaaaagctaggcaaaatagttgcccagaatcaaatttactttttcagcctcactaaccatacagttagttaggtattgccatttatgttagttttgatcactgaatgtgagcagaagtagtgtttgcaacatctgtgttatgtttcaaaaggagaagaagtaataaacttgccatcccttttatcttccttctggctgaaatacagttatgctatttagccatgttggaccatgtagataaagcaacctggtagaggtggcagaattataggatggaaaaattctagaccccatgacattgtgccggtcaacctcttctagctttggcttttactttttttatcttgtttaaaccacttgtaatttcttaatttggatgttttatggtatgtgaccctttattctatacaatggactgtttcacgaaacgaatataaaatacgtggcattctctttgagacagtaagagaggctgtgaagatacagatatcacatcttggaaagctgaaaactctcagtacattatggccaatatttggtaaaacttgtcctaatacttggaaagaaaactccttcctgtgagagtctatgctcaagaggaaaggtttagaaatattcttattcttattttatgttttagtaaaggcccacaagagatgaaggacactaggatggagatttagtttacacagattggagactctacagatcagtgcagggacacactctttatgtgcaatttgtaatctaggttgactgaaaattttataatttggggccttatatattcaaaaagtgaattgattttgtaacttaggttgaaaaataatagtaggcagccctgaaaaagtactttacctggagaatagaatatggcaccaagtgtttttaattaaaaattgttagtgagacattggagccaccacaatagcaaaaatcgaattaaggatgttaccttcccatccaaacatattattttagatgactcaaaagatagccttcattttatttttctgagagtaacagtagaataggcagggcacagagggttttttttttaaagactagactctccagacttaaaactattttaaattctatattttgctcagtagttttgagaactagaacatgcacatttttaaaaagccaggcaaacagcaagttcacaaattttattgagcccatctgagtgctgtggtcacaggacagccaactgtccaccaataaacaaatagacagacacctgcagggagaagtgaaacatagtaattttccaaaattattgactgacaacaaagcatgtatccaagaagttgagaacaaaaagcacaatacatatcaaaagtgctgtaacttggcacatcatattcaagctactgagaaccaaagacagagagaagttcttcaagatagccaaagaatgaggtcaaattatacacagtgaaataagaataggaattatatccattctcagcaatagacttggcctacttttgtatattaaaaaagaattatatcgaattatttaagacttctcagaaactgtgcaaattgaaagataatagaatgacatctttaaagtgctgaaagaaaaactgtgaaaattgcattaaaaagttgctaagttaactcaagtggtcagaaaaagaacaataaaacaacatattgaacaaatacaatatacctagcagatctgtatattataatccaactacatcaataatagcattttctataggtgttataaacacaccaattacaaaattgttagactgaataaaaatctaaggcatatagttatattctatctacaagaaacgtacttgttttattcagttcaggctgcttttacaaataccttagacagggtggcttataaactttagaaatttatttttcacagttctggaggctggaagtataagatcagtttgccagtgtgttgatttctggtgagaggcctcttgcaaggttgcagacttcccattctatcctcacatggaggaaagagggctagctcactctctggccttttcttctaagggcactaattccattcatgaattaggtcatgaactccatgctcatgacctaatttccttctaaaaaccctacctccaaataccattacattgagattaggatttcaacatattaatttgggttgacataaacattcagtccattgtactacattaaatatatagccttatgtatgataaaagtaaaaggatggaaagagatttgacaaacacacaaaccaaacaaaggaaagctggagtagcaatattaataacagacaaggtagaattcagaaccaggtatatatcatcaggagtaaaaaggtacacaatcaggtcatttctctaagaaggtatttttaaaatcttaatttggtatgtagccagcaacatatgtaaatacataaaatctgttggtacataaaggagacatatacaaacacacaattgtagtggatttggaggcatcaacactcctcagtaattcacagaacaaggagacaaaaagtgaggaagcttacagaagtcttcaaaaatattagctactacttgatctaagtgacattttatgcaatagtttactgaagaacagcagaatatgcattgttccctcaagcatacatgaaactttcatcatgacagaacacagaataggaaattcaacagactttaaatttacgaaagtaaaaatcatacaaagtatattagaccgtaacataatttaaatagaaagaaataatagaaatatatctgggaaacctttaagtacttggaaattaaacaacacatttctaagtaacacagaggtcaaagaagtctcaaggtaaaaatattgaactgaatgaaaatggaaataagacatcaaaatttgtaagacacagctaaataaatatttagagagaatgctatagcattaaatgcttatgaaagaataaagaccttaaatcaatactcaagttctagcttaacaaattagagaatgaagagacaaactcaaagcaagcaaatcgaaaaactaggagcataaatcaatgaaattaaaaacagaaaagcagtttaaaaaaaagctgtgtttttggaaaaaataaaactctagtcatactggcaaccaaaaatgagaaaagacataaataccaatatcaggaattgaataagggacatcattacataccttcacagacacaaaaataacaagggaaaattgtgagcaactctatatccacaaatttgacaagtcagatggacattttagtgtggttatactgttcctactctactgttgcgttttgggtatgttataggccactggatcatgaagaaccatagatagacctaataaaggtgagtactcataacctcaagttcatggacttcaatggactttcatgaatgagactttgaagtctcccccctgggtatgagatgaatacgttctctatgtggaaggaagtgtacacaaatgattggctgaccaaggcgcatactatggcagataattctggttttcctttaatatcaagtgttttctcctctcatggaataaacatgaagcataatctttagcagtgtgtatggccctccggaataaagactgcattttccaccatctttcaaagctagctgtggccatgcagctaggccaagagaaatgcaaaatgtatgtgtggaattcaatgtcatacaccctatcgggcatagtacatctaataaaatttgagaccaatctaagtgtttcaatcagatgatattttatagaagacatttttacacagtgacagacaatccaagaagccaagcataatgaattccttaatagccacaatttaccaaactcactaaagaagatatatgtgtgtgtgtgtgtgtgtatatatgtgtgtgtatgtatatatatatatacacatatatatatatatatatatatatatataaaatcttctgaagagtatttcatctattaaagattaaaaacaaaatgatgcccctaccacttatagggatagagggatatctcagtccattgtatgttgctgtaacagaaaaccacggataaattataatgaacagaaatttatttcttatactttggcacctgggaagtctgaagctatggggcctacatctagcaagtcgttcttgccatgtaatcctacagctgaaattcaagagtgcatgcatgagagagcaagcaataaaggggctcagctaattctttataaggacactactcctgcaataacggcattaatccattcatgagggcaaagtcctagtgttctaataatcttttaaaggtcctacctatcaacactctttagggattaaatttcaacatgagtttcagagggcatattcaagtcatagcaacagataatatgatgagtccaaaagctaaagctccctgctgatggatgcatgttgagaattgagtgatgagagtatgggccatttgtctgaggctagaggcacagagaaaaggcagcttctatggaagatgcacccaagacagaccaagaggaaggaaatacctaacctaccaaggtcatccattggatgatacaacagaaaaggaaaaagtgaagactacacctaagagcaaaaatagagtgaccatcaaatttacaggtgagtcatgtttaggccttccccttcctttgaattcgaatttggatgtgatgtctattgatagtggagcaacagaattgagagatttaggactgctaaaaatttaatgaagaattttatgtgaaaaagcccaattcaggcttatacaaaaagaaatacatgtcatattaaaatcattgttaattttgaatgtccaatacagtagtcaatctgtatcttaattaaaattaatacagtatgttacaattagatctggtcagctggaagaatatgaaagatggagttacaaaagagagaaggcttaaacaggcaggaatatattgtataatttcatttacgtgaaatgtacagaataggcaaatctagagagacagaaagtagaatagtggtttccaggaactaggggtagttactgctaaagggttcaaggactgagcatggtggttcatgcttgtaatcccgactgtttgggaggccaacttaggaggattacttgaagctggaagcttgagaccagcctgggaaacaaagagagacttcatctctaccaaaaataaaaataaaaaacttagctgggtgtggtgacttgcacctgtagtcccagctacttaggaagatcgcttgaggccaggagtttggggctgcagtgaaccataaatgtaccactgtactgcagcctgggagacagagtaagtccctgtctctaaaaaataaaaaataacacaaagtgttcaagatttttttagggtgataacaatgttctaatattagacagtataagtaatttcaaactttgaaaataccctaaaaagccactgaattgtatacttaaaaaataaaaaccaaactaaaaaataagtatgtaagagtcagataatcaaagggtttagatgatatgacaagaaatctttaattatttctcttggctgtggatagccaggatcgggttttttagatgtagtaacaataagattagattttttaaaagaaaacttcagcatcagtgtggaaggtgtattatagacagcaaaggacaatcctgaaagtacgacaattatttagcatagacaggaggaaataagggcctgaacaagagcaatagcaatgaatacagaatggaagtaatgaacaacaggtgaggagaaaactaagtggataatataagaatgcatttcagtcatttaacttttgttcccatcaattgtgcattctaagagatgacctaaaacacctatgctttaaaaaattttcatattttttctgtcactgattatatatatatgtatatatttacttgctggaaaaataagatgcaagtatccaagcatgtgagaaacactacccaatgcttggggacagtatttttataccccaaactaaaccttctgcaggtagttttaggtaccaaattaccctctaaattaagatctaactgcttcttgcggaatgcatcaaatctaatttccccatcaaaagaacatctttatgtcagtgatttctttactgaaaccaatcagtgatctcttggaactcctattaagaaaatgctcctgggtactaacaaaatagagtatagcaaatgagctgaaattacttttaactttatcaaatatgtgatataaaggtgttaatgtttattaacatggcttcatgttaatagctccatcaaggatcagatgtttatagcagtaagaattctgtatgattattttacatcttttgctttagacatgagaccatcattaacagggaagaaataaactgatgtcaaaaagaaagaatatgtatatactttgcattttccattaaaatgctaaatttcgtgcacagaaagaaattcagcatgacatatatagctttatatttccatgactgtcttcatacattttgagttatagtcatatcaagaaacttgacttcccttaaacacaatatccactgcctcatttgccgtacttttatacatgatgttatctctaatgggaacataatcttatttcctgcttctttaattaatacttattttttccaatactcaagtaggtattacctcctgtgggaaacgtttcttgattttcttccgtatctaacatgtattaagtgaccttattcagtgtacatataatatactatgcataactattcaacaggtataatattataaagataatattagtttaagatgttgtgtgtgtttgtgtaacttgaataagcttctgtaacaaatagatcataggaggtatagtggcttcaagataaatggatgcttttttctcacctacctaatagttcaacgtgggtggctctgcttcacatagcataacttacgaagctctgcttcttccatcctatggcccctgcttcccctagattttcactgaaatctgcatccatcaggcaagagtgaagaggtagtgaaggagatatagcttcttcttaaacgtctttgtctggaaatggcacatatcacttctacttgcattccagtggttaaaacatcatcatttggcctcaagtagctaaaaaggaagctgaaatggagccttactctgtacataggaagaagaaacattgatttatcttggacagctagcagcaacattaaactgaaagtaattaaactactacattagtcaagctttgggtaggcatgcccagtggggacagagaacagcatgtcagggcccactttgggccaacgcattggtatgatgagtgtcacatatctggaatcaacagttctaactgataaatttgtcttcctttttctctttccctttttgaaagttcagctttcaggtgttgtacacaatatgtaggcagtgggaagtgggcagtgggcagtggtatgtaggggcccagctatgagccagcatattaatacagggaaatgaaattttggggttgtgctttctaaatgtccttttcttcacccttctttctgccctcttttaccttcttcctttccctacttctccccttcctttgtgtgagcttttagccagtacacccaatatggatgtgagtcaaggacactgctttctgctgtcatggtgaggagtttgttaacaacggcaggactgaataaattaggaaattcatttagggtagtggaaaacatatttctcattgttgaaaatgggacttatgaatatggaaaggagatagttttggaatgcaagtagaagcaccagtgtgcacaatgatcaaatatgatagagctccagttaaaattaaaatataaaaacatatagatatacacatatgtgcatattatttgtatacatagatttgcttttttaaatttaactgtttttaacttttattttaggttcaccggcacatgtgcgggtttgacatataggtaaattgtgtgctgtgggagtttggtgtacagattatttcatcgctcagatgatgagcatagaagctaatagttttttgatcttcaccctcctcccactctccactctcaagtaggccccagtgacttttttccccttctttgcatccatatgtacttaatatttagcccccacttataagtgagaacatgtggcatttagttttctattcctgtgttagtccacttaggataatggcatccagttccacccatgttgctgtgaagggcacgatcattttatattttatggttgcatagtattccatggtgcatatgtaccactttttttaaaatccagtttattgttaatgggcatttaggttgattccatatctttttcactgtgaatagtgcataaatagattttttttatctgactctctttagaggacatacatgtaattacaccgcagttatgaggagcacatatagtgtcctattatttgtttctagatactagggagccagagcttcctggggaagagtacctgactccagggctgaggcagggaaaatacaagatgatctggtaacatcctgttgtgccagaggtactctaggggcatgtgcaaaagacataagaaccagttgaaggagcttccactagtcaagtctgggacaaattcaaataagtgataattgacacggcaggagcatcgccatcttggacaagcactgccatcttaaagttccccttgatcaaaaactgcctaaatccaaagggcatcagcctaatggctaaggttagcatgaccataaaccataaatgacatctccgaccagaaacattcgaaccgtaatataaacctctccccaaccagagacatgccagccctgagataacctcccttccaaccagagacattccaaccctgacataaaacttctcccccacacagaaacatttcaagtctgtaataagttccctcaccctaaaaccaatacatactcttagtctataagagagagcactcctgactgaaattggccagaagcccctctcaggtttattctccaaaataaacctgtctttgactgttgagccactttttgtgtttcttttctctttaactcttaacaataataatgaccagttataatattttgagtaaaataagaatttatgagattttactaacataaatggatacatatataaattgggggtggtgctggaattggaagggaattcttccaggccaactaattaatctacaaagaattatggaattaggagattaccacttgataatcatcagtgaaaactcattcaggcagaattcatcaatgaatgccaaatctggtgtgtaaaagactgatgaaaaatggagtattcacatagtctcaaagtaactttccatcaatgcataatgattatttattgataacatacttattaactttctagtgtagaaatctcacaggcaccattaattaaataataaatgttaccatcatcaataatgaaacaaaatcagcatgtataccttctgatatacacactgcaaagagctcagcatcacttctgtggtattcttgccagaaacatacaaatcttaaatataacaaacattacaaatggagtcacattctacacagtaactaggctaatttttaaaaatgttaggaccattaaagacaaagaaaaaataaggaactattccagattgaaaggtattaaagagatatgacaatgaataaaaccactgattatggattggctagtgggcctaaaaagggtatatctgggataattaggaaaatgtaagtggggtctgtggaccagaaaataatattgcatcaatacttatttcctgattttgatggaaacattgtggctatgtggcaaaatgttcttgtgcataggaaatatatattgtagaattaagaggtatggtaggaagaataatagcccctaaaggtatcaggttctgaaacctacacctgtttaagtgttgtcatataacaaataaggttctttgcagatgtgagtaagttaatgattttgagactgggagattatcttggattgttcaggtgggccctaaaataccaccacaagtgctcttatcagagagaggcaaggcgatacttaatccagacagaagaggaaaagaaagtgttaagatggaggcagaaattgggttaatatggaggcaagccaagaaacattgataaccaacattagttgaaagaagcaaggaacagatctctctctggaggagacccccatcctgccaataccctgatttcaatccaatgaggctaattttggatttctggtctccagaaccatgaaagaataaatttctgttgtttaaatccaccaagtttgttgtaatttgttaatgcagccacaggaaactaatacaaggagtaatggggtatcataactgaaacttactcttaacatttttgaaacaagagaaatgttaacaaggaaatctgggtgaaagttatacaacaggtccctatattttttcaatttctatgtaaattttaaattaccgaataatgcttttaagaatttaaaaattagaagattaagtaaaggttaaaagctattgcctggataacatgaaatgggaggaagatcaacactttctagagggattcagacattcaatattctactattttatcctctcaaaatgttggcctttatcctaaagctatttatttcctagttctaaagtggctatagtatctacagatatcatatttgttttcaagatcagaaagagaatagagaaagatgataaaggttcatgccagttgaacctgtgtcttttttatcaagaaagcagatgttgttttaggtatctccagaaaatatttgtttaaatcttggtagccagaactatacccaactgtgagggaagctgtgaaggtgggcatttgccttcccagcttctggagtagatatgaaaatggagaaaaagattgaaaaacatctgttgagttggctaacaaacagtgttatctccctggcaatagagatagatagatagatagatagatagatagatagatagatagatagataatctgtatttagagagcctagcacaatgctttaaatatatgttcaataaatgcttataatattaattggtgtatgtatgaatgaatcataaatggatgaattaaagaatcttatattccaagtttatattagccatgtgaataaatgtcagctttattagagcatagtccccaatatagaatcatttcagaataccttaacaccctaggccatcatttgtgtttcagtttgtaagttttacattctatcatgattttttgtcttagattttcttttgtgtgcccaattttatggtattacattaaaaccgtatcaacttttagcatgaattgttacaaaaatctcttatctctcatctctttaatgtcttctctctcaccccattaaatgaggtaagtaagtaggaacatactagaaagaaaaataggaaagacaaaacttggtaaataattaggtgtaagaagtgattcataagaagtagtcaatcaatattctgaagaccttgtcttagataattgcagtggatgggaatatcaaacacagaaagataattgagaagacttatcatgtaaaactgatgagtgctgttttagacataaggagtctgatgtgtcaatgggacatacttgtgcagataaatatgtatttgagaattagacgtttaggacttaaattaagagaagttagaacaagagatataagtttggtattcttctgcaggtaggtgctagttaaagcttgtgaatagataaaatttctcaaatatatcatataaagtataaagaaagaggactatgaataaaatcttgacgtttcacaaaccgtgatggcagccaattccagcactgggagaaacaatctggtatagaggaagggagtgagaagacatcatttctttttctgatacaaattcaatatgcaatttacattaatgcttctcaaactgtagtgtgaacaaaaattatcttgaagtcttgttaaaacacagattttcaggtcctatttccagatattctaattcaaggggtttgaaaggatgccagggagtttgaatttctaacaaactctcacatcatgctgatgcctcccacctaggaccacccttcattatatctcaaagctctaaattaaaccttcttactcacagtgtggcccatgggccagaaacattggcatcacctgggagcttgatggaaatgtaaaatcctaggctccaacccagatctactgactcagaaactgccttttaacattatccccagttgactcatatgggcatgaatgtttgtgaagcactgccatctaaatgtattatataacatgttgtttcatttctgttaaaatgacaatgttggtctcattttgattccaacatactatgaggtaaaaaattaggctttgaagccaaacattggtaagtcaattgtgcctccactaaccttagtttccccatgtataaaatggagatcataatagtgtcctcccttggttataacaagaatgaaataatgttatgaatataatgtgcctagcttccatttgaacagagagctatggtctcacgttggttttacactttcacatgaatattcaggttgcagctagcacatggctgcttgtgaaattgcttatttgttatgttggttccacctatttgattagttaatttgataaatttaatgatgctttaagtgaaatgattccagttaatgattattgattttaacctcaagaagaggaaaataaaattgattcctaggtaattacaacttaaaatacatagagtgtgtgcagatactgactgattaaatataatgaatatttaaaaactgatataaaattgtgaccaagttggagagaatcggattgtggttgtgacagtaattaaaacaaaaattgagacctggctggagtgtacttcggtctcgtgaatcttgcgaatctaccatttcctctcctttcttcaatgtcactttttttatttctcaaatagaactatggtagcctgaatcttatcttccaaaggttttgtttctttatccaataaatagatataatatatctaatacatggggttgttgtaagaaaatttaaaaatccaagtgctgaacacagggcttggcaaaaaaaaaaaatgaattaataattgctgttattatgtaaattttacccataatagatttgaggaggaggttgatgatgctgagtttttcaacactgtattctttaggattagtagcactctattatatacagaagcaacactcaataattgtttgctgaattgagcatccagagtaagtttttatattgtggtagttgcaattaagcagtaaatctgacacacacacaaattgttttttcagagataaaaatggaagttcttttatgctgctagtgaagacttaacttcctccaactcttttctataaatacaaaaaaaaaatacttagatatgctattttttcctgtatacttagcatattccccttaaataatactgttggaaagagaaaaaatgaataatgtcatccctagtaaactagtcaatattgagggagaaactctcagtttaattttctaatagatcatataaaactctatttctcatgtggggagatttagagtctagcaagattttattctcaaataatagattcatttgaagagattaaaacaagtctttgtcaaaatgaaggaacatttttaaatgaatttgagaaattcatcccaggtgatttaacataaaatatttttgtttctatttttattttatattatattattttattttattttatttttttgagatggagtctcgctctgtcacccaggctggactgcagtggcacgatctcagctcactgcaagctccgattcccaagttcactccattctcctgcttcagcctcctgagcagctgggaccacaggcgcccgccaccacacccagctaatttttgtatttttagtagagacggggtttcacagtgctagccaggatggtctcgatctcctgaccttgtgatccgcccacctcggcctcccaaagtgctgggattacaggcgtgagccaaagtctttaaaaaactgagttcattaacaaaaataaagttccattcggaacgcagaaatttaaatttccaaagtattatctacttgctatcagctatgaaggtcttaaatatttgaagtggtgtcatatacaagaatttgagactagctcaaaataagtgaccacagcaggtaagaagcacatttctgcaagtgaaagattaagattttaattcaagatttcatattttgttgccctggatattcaaggagaagccacttgctatagagggaaagacagatgcaacatgcatagaattacctcaaaattctgtgctgcttatgacaattgacatgaatgttatttggcatcacaatgccctggtaaatataggtagagagaacaattactttctcttgcacatcaacacacctcccttgtcaacacatacaaactcatagtaatcttgcacaaaattgttttattaccctttcattcagcatttctgcttatacatccttaagtatatcatctactttattgggtatcatatagaaaactgcgcattttcatttgtagtagatcagtttctgctccacttgaagccaaccttcctcacaattagcctgctctaaaatacaagataaataagtcctaggtatttactgtacaaatatagtgcctgtagttaatgttgtattgtacatttaaacacttgcaaagagggtagatcttatgttaattgttctgtcacaaaaagtaataataataaacaagaaagctggaagaaacttttgcaaatgatggatatatttatggcattggttgtgctgatggtttcatgggtgtatatttacctccaaactcatcaagttgtatccattaattatgtacagcaggggtgtctactcttttggcttccctgggccacactggaagaagaattgtcttggaccacacatcaaatacagtaacattaacaacagcagatgagcttaaaaaaaaaaaaaaaaaaaaaaaaaaaaaaaaaaaaaaaaaacctcataatgtcttaagaaagtttatgaatttgtgttggggagcatttaaagccatcctgggctgcagtcgcatgtggcttacaaggataagggttggacaagcttgatgtacagtattttgtatgtcaagaaattaaattttaaaaatgttgaaaatataaaatgttgatgttggagagaaaaaaaaaagcagctaatattttgagcaccttgcatgtgccagtaaccatagaaaaagctttctgttacgtcatagaatcctcccattctctattaggtatctattatctccattttgctaatgaggtaactgatgctcagagtagggaacttgtcaaagacacacattcagtgagtggaagagccgagattgaacgcaggattcctaacttcaatttgtatttctttaagattgcactctttactgtgtgagaaaagacataaatactatagagtgtatcaaaatccttcatacacctcctaccgtctttaaaacagacctagttttaagaaaaattcatttcacaaagagccataatttttcatcttcttgttcagcaatgcagtttcattcctgatgctgctattaactcttaaataatctaaacctaatgaataatgggaaagtcacaggcaggtgaaaggagaattggggccttggaattctcctgtgatgagtaattagtttatcctgagaaaaaccagtcttttaaaacaacagtagcctctcaagtcatggagggtctaactagtctcactatcatgatttcataacgccgggagggtttattgaacttttgattccaaaatgtaaacaaaatgattttttgaaacactggaaccaaatatttcctggaataagaaaatgcacatttattctctaacttacatattaatacatatatcaagtgacaaatgttctgtgagtctgacataaatttccaagtcattacgttacaggtattacaaaaatattaatcctttctaggagactatcttatttgtgtcaagactctttagagatgtctgattattgctgatctgttttgtgagtataccatgccatttgctttttttcagggcccatcttactatttgtagaaaagccttcagctttgcccaaagttgtcttttgcctcatctgtttaatattctggttctgactttctctgtgcttaggtctgatgcttctgtgaattcctgtctgtggctctcctgtgctgcagtagagagaggagtactttatactcctttctttgtggaaaaaaaaaatcacttcctaataggggcttgagccgaaatcaatgagtaactgagcagacatgtgagacagacattaacattttttttttaaacactgttgctgttgagtcacggtctttctaattcccagattcttattgaagacctcacattggcctaaccagggcaaaaagcttggaaatctaaggcattttattgcatgggctatttacccaataaaggactatacaattttaaatgttggaggtaaagaaatgtgggagattctgaagatatgatcattgggagataaatagagtcttagtgtgcggaggttggattttgcagacttctatccacagactaattcttcagtgcatatttttagaattgcctcctagttttataattgaaaaaacacagctgaaaattttggaaatattaatcagaaatacaatatctctattacctactcaattaaaatggctaaaaataagcattcaaattttggtaaatgtgttctgagtagttaacaaaaaataaattatatctaggcaatgtttgttaatgaaattaagagagtcctaagtgaatgtggtttctgaacattaagcaggagagagaactattgatgtcctcaacctaatcactacctcatgttggtgaaatatctaaaatctaagaaagagctaagaaatgcactcctaaaaagttagtttaattaaataaaagtgttcttattttttctagtagtttttccattataaaaatgatataacctggccgggtgcggtggctcacaactgtaatcccaacactttgggaggcagaggtgggtggatcaccaggtcaggagatctagaccatcctggctaacatggtgagcccccgtctctactaaaaaacacaaaaagttagtcgggcgtggtggcaggtgcctgtagtcccagctacttgggaggctgatgcaggagaatggcatgaacccgggaggcagagcttgcagtgagccgaaatctcaccactgcactccagcctgggcaacacagtgagactctgtctcaaaaaaaataaataaataaaaataaaaggatataacctgacctgtagtagttcagttaatagtatcataccaattgtttggacaaatggtgatgtaaaatatcattaaggaaaactgaggtaaggatatatagaaattatctgtactatttctacaacttttcttaaaactaaaatagtccctaatcagaaaaaaaaaatgagttttttaaaaaaatctatggttaggaactattttttgcctatattctcttctcaaagataaagatgttaatctaggcatacaaggtactctgtgatctctgcctcttcaacctcatttcatcaatgctttctttcatttggcttcatcaatatatgcacgtgtttgttctatgccatacactttgttaatattttagataggccactgcattcaaacattatatgaacctttttacccaaatattaaacatgaggaaactgaagctcagagacattaggtaatttatctagtgttacatatattcaatgaaacatcaatatgtacaagtctgtgacttccaaacctagactcaaaactgtccagattaaaataataataatgaatcagtataaagttaaatttttaaatggcaaaaatttcacatggaagcttaatctagttaattgtgatctttatgctatttacagacaaaacattggaatggattaccaaaggattgctctccaaactatgagtcaaggagagacagtcattcgttctggctgatttagacatttattagtcagaaatagtatacacaaaaaaaattatttctctaccccccaccttgccataaacaactgggttcttagtttcagattataaaattgaaatacctaattgatgtttaagtgaaaagaacacagaatcaggagtcattgaactgaagttcgtatctcagctctgccctcaaattctggttaccttctatagccctcactttcttcatctgaagaattagaataagtccttatatcacagacagctataagggttaaattagatcaggcaaataaattgcctacaggagaaattggcatctaggaggctgaattaactttgaacctgagctgtatcttaatattgatcagccatgttagttttttcttcccttttgtattcctacaatgcaagataacttgaattttctatcctcaatttattatgatgtattgctccaacatgtaaaaaaccttagggaaagcaaagtgacatttcaaaatcctgctgttggtattgggtaaccaatatttttgcaagtcaaatagattccaattttttgtttctatcaaaattgaaggaaaattcaacagatgatcagctggtcactaaaattattttctcatgttcatcatgtgatttttggaaaatagaaagaattaaaaacattcaatgtcactgcaatagaatttcttctagcctacttgttcatttatgtgaacagtatttcatagcccttacatttataatacaatctaaaaaatacaaataagtgatatataaacctttagcttacataagtctcaattctaataggaagtaataattatctatggatccatgaatcatttggaaaaagaactccacccatcttataaaaatttgtcattgccaaattattttatctgtaataattcttttaatttgtaatatagttataatgttttgatcaatttaatactaaattatttatgagaataatactgttcaggtttttaaaatacagggaaatagacacacacatatatacatgcacctgtacacacaatttatctattttttgttttatacacacacaataaatctttaaaagtatatcttaaattataattaaattttgtgaaagaaatgtaatgaaaatacaaattatagaggaatattaatttttaactgttaaaatcagtacatttgtactgatttccatcttatatagaagttggccgggtgcagtggctcatgcctttaatcccagcattttgggaggccgaagcgagtggatctcctgaggtcagaagtttgagaccagcctgaccaacatggagaaaccccgtctctactaaaagtacaaaattagctgggcatgatggcacacgcctgtaatctcagctactcaggaagctgaagctggagaattgcttgaacctgggaggcggaggttgcagtgagctgagatcacgccactgcactccagcctgggcaacgagagcgaaactccgtcacacacacaaacacaaaatttagctaatctttacaggcatgatatagcctcctttttcaatgtttctttggtcaggtattcaaattcacattttttaagtgtatgctataacaataacagacaaatctggactactgacataaatctgttggattatatcattacaattttttcttcctcatagcaattctcttactactttacattcacacacaaataaaactctattgtctccttagttgtttctcaaatttatcttaattggcacctaaagagttcatgtgcatagtaactacagttatgcaccacctattgccagaatgttttggtcaacaagaaatcatatatgcaaaggtgatcccataagattataatgaagccgaaacattcgtattgcctagtgatgtcatagttattataatgtcatagtgcacctcatcactggtgtttgtggtgatgctggtgtacaaacctcctgtgctgccagtctcacaaaagtcttttttataatatctcataaaatctaacacatacagttacatacagtacctaacactcattaatgacaataaatcactatgttactaatttatgtacttctgataatatactttatactttttatcattattttagaatatactccttctgcttgtgaaaaaagttacctgtaaaacagccccaggcaatctatcaggacgtattccagaataaggcatttttaccataggaggtaatgcccccatgcacattattgcccctaaagattttacagtgagaaaagtggaagacagtgatatttacaggtcctgattctttgtagaccgaagctaatgtgtgtgtttctatctcagtttttaacaaaaagttaaaaaataaaaacttttaaaaatattaaaaagcatatagaaaaggaatataaagaaaataattgtgcacagctcttcaatatgtttgtgtttaaagctgttattatgataataaaaaacttaaagtttataaagtaaaaaagttacagtaagtttattattgtaaaaaggtgtcttaataaatttagtatggcttaagtttactgtgtttataaagtccacagtagtacagagtaatgtcctaggtcttcacattcacttgccactcaccaactcaccagagtaacttctaatctttcaagcttcattcatggtaaatgacctatacgggtgtaccattttttatcttttatattgtatttttactgtaccttttctatgtttatatatgtaaacacttatcattttgttacaattgcctatagttttcactacagtaataggctgtacagatttgtagcgtaggagcaataggccataccacatagcacaagtgtagcgtaggctatcccatctaggtttatgtaagtacactctatgatgttcacaggatgaaactgcctaatgttgcatttttcagaaagtatttccactgttaagtgacatatgactataaatgtatattatgcagctaattagcaatatctttattatcttaactctgagaattaccttcctaaatttaaataaagattataaaattagaataaatgatattcactttaaacttgtaagacctatatatttttaatcaaaaagggttaaaagtttatgtaacattcaaacggtttattaaagctataggagaaagaaaggtatttatttgaattacagcactgctggggaaacagagagacagcacttggatgttttcattttccagggcatcatatactaaagaatcattccatctaatttcttcaaatctcaagaacacacacctggcaaatcatgaaaataaattttatgttgttatcaatgatatttttaaatgccattttaataatttgactcactttttttctaatcacagtattatgtgtatcatcaatctggtactcaattttactccattccacttaatcatttattaagtcctttgatacaggtacagtctaagaaataaatacacaagagccataaatcccactctaaaggaataaagcctgccattccactctcacacccagttctcttaatctcaccatgttttttaagatttggttgcagtatcatcatttctctggaaaaactattttcatacccacaatcctaaaggttagatgccataactcatgctcctacatatataaccaattttgtttatttatttttccccagactctggcaaattttaggtacataataaaaatcctttgaatgatttcattttagtcacaattaagagaatggaaaaaattataggtgattcttctgagtataaactaagagtcaagctattagagaagcattccctaaagcaatcaagataactaaaggcacaatttattgtctgtggatcacagttgagcttaccccatgagtcctcgtatactgatctcatgaaaactcatgtatgcttcggactatgttttaataaacaacactttctgacataaaaaaaattattaattaaaatgaagtcctaatcataccaagaacaccaaatgtttcacttttccatattaagtttaaattcagcagttttcaaacatggccaaggatgcctttggtgtccccaagacactttcagaagatttgcaatgtcagtattattatcatagcaacactaaagcattttttgtccttttctactgtatggatgcttgcagatgcaagtatgcacatcaatctatgtcaaatagggttagctaacaaaataatacaagtgaaaatcagggtaagttatcaaaacataactgctagtgtgtctaaaatgcaaaattacaatatcaatcatttatatattgctgatagtagtataaaatagtatgtccaactctggaaaacattttggcagtttcttaacaataataaataataaataaacattccaccactatacaacccaccaattgcaatcctgggcatttatcctaaaaaatgaaaaattatatttacatataaatgtgtacacaaatgattatggcaggcttattacagatatccttaaatggatgaacgtttaaatgaccatggtacatccatctcatggagtactattaggtaacaaaaaagaacaacctattgatactaatatatacaacaactaatataatctctagagagttatgctaagtgaaaaagccaaaggtcatatattgtatggttcaatttatataacattcttgaaatgacaatactatagagatggagaacagattggtggttgacaaggttcagaaaaaagagaaaatggaggaagtggtgtggctataaaaggataacatgaggtttcctagtggtgatggaacacttctctttcttaactgtattaatgtcaatatcctggtggtgattttatactataattttgcatttgtatattttctttggaaagaagtctttgggaaaaaatgtttattcaactcttttgctcatttttatttgggttacttgttttttgctactaagttgtatgggtcccttacacatttttggtattaaacccttcctagatatgtggtttgcaaatatcctcttccaagccataggttgcctttttattttgttgcttgtttcctttgctgtacagaaattttggtttaatatagtcagatgagtttatttttgcttttttttttttttttttttgcactcttggtatcatatcctcccccaaaaatcactgggaagaccaatttcaagaatctttccttctagttttcctatagaagttttatgttttcacatctcacatttaagtctttaatccacttctagttaatttttgtatgtaagacaagagtccaggcctggcatggtggctcatgcctgtaatcccatcactttgggaggctgaggtgggtggatcaagaggtcagatcaagatcatcctatcgggggaaggagccaagatggccgaataggaacagctccggtctacagctcccagcgtgagcaaggcagaagacgggtgatttctgcatttccatctgaggtaccgggttcatctcactagggagtgccagacagtgggcgcaggtcagtgggtgcgcgcaccgtgcacaagccgaagcagggtgaggcattgcctcactcgggaagtgcaaggggtcagggatttccctttcctagtcaaagaaaggggtgacccacggcacctggaaaatcgggtcactcccacccaaatactgcgcttttccgacgggcttaaaaaacggcacaccacgagattatatcccccagctggctcggagggtcctacgcccacggagtctcactgattgctagcacagcagtctgagatcaaactgcaaggcggcagcgaggttgggggaggggcgcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccttgtctgacagctttgaagagagcagtggttctcccagcacgcagctggagatctgagaatgggcagactgcctcctcaagtggatccctgacccctgacccccgagcagcctaactgggaggcaccccccagcaggggcacactgacacctcacacggcagggtactccaacagacctgcagctgagggtcctgtctgttagaaggaaaactaacaaacagaaaggacatgcacaccaaaaacccatctgtacatcaccatcatcaaagaccaaaagtagataaaaccacaaagatggggaaaaaacagaacagaaaaactggaaactctaaaaagcagagggcctctcctcctccaaaggaatgcagttcctcaccagcaacggaacaaagctggacggagaacgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgcgaagaatgcagaagcctcagtagccgatgcaatcaactggaagaaagggtaccagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatctaacaaggcaggccaacattcagactcaggaaatacagagaacgccacaaagatactcctcgagaagagcaactccaagacacataactgtcagattcaccaaagttgaaatgaaggaaaaaatgttaagggcagccagagagaaaggtcgggttaccctcaaagggaagcccatcagactaacagcggatctctcggcagaaaccctacaagccagaagagagtggaggccaatactcaacattcttaaagaaaagaattttcaaccaagaatttcatatccagccaaactaagcttcataagtgaaggagaaataaaatcctttacagacaagcaaatgctgagagactttgtcaccaccaggcctgccctaaaagagctcctgaaggaagtgctaaacatggaaaggaacaaccggtaccagccgctgcaaaatcatgccaaaatgtaaagaccatcgagactaggaagaaactgcatcaactaatgagcaaaataaccagctaacatcataatgacaggatcaaattcacacataacaatattaactttaaatgtaaatggactaaatgctccaattaaaagacacagactgacaaattggatgaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgatgaaacagactttaaaccaacaaagatcaaaagagacaaagaaggccattacataatggtaaagggatcaattcaacaagaagagctaactatcctaaatatatatgcacccaatacagtagcacccagattcataaatcaagtcctgagtgacctacaaagagacttagactaccacacattaataatgggagactttaacaccccactgtcaacattagacagatcaacaagacagaaagtcaacaaggatacccaggaattgaactcagctctgcaccaagcggacctaatagacatctacagaactctccatcccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgctttgagggaaatttatagcactaaatgcccacaagagaaagcaggaaagatccaaaattgacaccctaacatcacaattaaaagaactagaaaagcaagagcaaacacattcaaaagctagcagaaggcaagaaataattaaaatcagagcagaactgaaggaagtagagacacaaaaaactcttcaaaaaattaatgaatccaggagctggttttttgaaaggatcaacaaaattgatagactgctagcaagactaataaagaaaaaaagagagaagaatcaaatagatgcaataaaaaatgataaaggggatatcaccaccgatcccacagaaatacaaactaccatcagagaatactacaaacacctctatgcaaataaactcgaaaatctagaagaaatggataaattcctcgacccatacactttcccaagactaaaccaggaagaagttgaatctctgaatagaccaataacaggatctgaaattgtggcaataatcaatagcttaccaaccaaaaagagtccaggaccagatggattcacagctgaattctaccagaggtacaaggaggaactggtaccattccttctgaaattattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaacgtaatccagcatataaacagagccaaagacaaaaaccacatgattatctcaatagatgcagaaaaggcctttgacaaaattcaacaacccttcatgctaaaaactctcaataaattaggtattgatgggacatatttcaaaataataagagctatctatgacaaacccacagccaatatcgtactgaatgggcaaaaactggaagcattccctttgaaaactggcacaagacagagatgccctctctcaccactcctattcaacatagtgttggaaattctggccagggcaattaggcaggagaaggaaataaagggtattcaattaggaaaagaggaagtctgattgtccctctttgcagacgacatgattgtgtatctagacaaccccattgtctcagcccaaaatctccttaagctgataagcaacttcagcaaagtctcaggatacaaaatcaatgtacaaaaatcacaagcattcttatacaccaacaacagacaaacagagagtcaaatcatgagtgaactcccattcacaattgcttcaaaggaataaaatacctaggaatccaacttacaagggatgtgaaggacctcttcaaggagaactacaaaccactgctcaaggaaataaaagaggatacaaacaaatggaataacattccatgctcatgggtaggaagaatcaatatcgtgaaaacggccatactgcccaaggtaatttatagattcaatgccatccccatcaagctaccaatgcctttcttcacagaattggaaaaaactactttaaagttcatatggaaccaaaaaagagcctgcatcaccaactcaatcctaagccaaaagaacaaagctggaggcatcacactacctgacttcaaactatactacaaggctacagtaaccaaaacagcatggtactggtaccaaaacagaaatatagatcaatggaacagaacagagccctcagaaataacgccgcatatctacaactatgtgatctttgacaaacctgacaaaaacaagaaatggggaaaggattccctatttaataaatggtgctgggaaaactggctagccatatgtagaaagctgaaactagatcccttccttacaccttatacaaaaatcaattcaagatggattaaagacttaaacgttagacctaaaaccataaaaaccctagaagaaaacccaggcagtaccattcaggacataggcatgggcaaggacttcatgtctaaaacaccaaaagcaatggcaacaaaagacaaaattgacaaatgggatctaattaaactaaagagcttctgtacagcaaaagaaactaccatcagagtgaacaggcaacctacagaatgggagaaaatttttgcaacctactcatctgacaaagggctaataatatccagaacctacaatgaactcaaacaaatttacaagaaagaaacaaacaactccatcaaaaagtgggtgaaggatatgaacagacacttctcaaaagaagacatttatgcagccaaaaaacacatgaaaaatttctcatcatcactggccatcagagaaatgtaaatgaaaaccacaatgagataccatctcataccagttagaatggtgatcattaaaaagtcaggaaacagcaggtgctggagaggatgtggaaaaataggaacacttttacactgttggtgggactgtaaactagttcaaccattgtggaagtcagtgtggtgactcctcagggatctagaactagaaattccatttgacccagccaacccattactgggtatatacccgaaggattataaatcatgctgctataaagacacatgcacatgtatgtttattgtggcactattcacaatagcaaagacttggaaccaacccaaatgtccaacagtgatagactagattaagaaaatgtgtcacatatacaccatggaatactatgcagccataaaaaatgatgagttcatgtcctttgtagggacatggatgaagctggaaaccatcattctcagcaaactatcgcaaggacaaaaaaccaagcaccacgtgttctcactcataggtgtggattgaacaatgagaacacttggacatagcaaggggaacatcacacaccggggcctgtcgtggggtgggggaggggggagggatagcagtagaagatataccgaatgtaaatgacgagttaatgggtgtagcacaccaacatggcacatgtatacatatgtaacaaacctgcacgttgtgcacatgtaccctagaacttaaagtataataaataaaataaataaaataataaaaaaataaaaaataaataaaaaaaaagatcatcctatctaacatagtgaaacccacctctactgaaaatacaaaaaaattagctgggcatcctggcgggcgcctgtagtcctagctcctccgtaggctaaggcagaagaagggcgtgagtccaggaggcagagcttgcagtgagccgagattgtgccactgcactccagcctggaggacagagtgagactctgtctcaaaaaaaaaaaaaaaaaagacaagtgtccagtttcattcttttatatatggatatccatttttcccagtggcagttattgaggagacttttcttccatcattgtgtgttcttggtacccttattaaagattagttgaccatatatgtgtgtttaactctgggctctctattttgtgctattagtaaatacgtctgttttgaactgagtaccatactttctaaattatagtagctttgtaatatagtttgaaatcaaggaatgtgatgcctccagctttgatctttctcaaaattgctttggctattcagagtcttttttggttctcaaagacaaactgtttctgtgtaaaggtaatgtaatattatatatagaaaaccctaaagaccccactgaaaagatatgagaactataaatgaattcagtaaattttttttctggttttatttctggtgtttttagtttgtttgttttttgagacagggtctcactctgttgtccaggctggagtgcagtgatgtaatcatggctcgctgtagccctgagatgcagtgatgaagtgatcctctcaccttagcctcctgagtacgtggaatgacaggcttgagccaccatacccaactagttgttttgactttttgtagttacctccatatgttgcccaggctggtctcaagctcctaggctcaagcaactctctcgctttggcctccgaaagtactgggattactgatacaaagcactgtaccaacctcagtaaagttttataatataaaagcaatatacaaaaatcagcagcattcagttactaacaatgaaccatcccccccaaaaaaaataagaatataatcttatttaaaatagaataaactataaaaagaattaaatgcttgggaatatatttaaccaaggaggtagaagatacatacaaggaaaacaatgagacactgatgaaagatatttaaaaaagacacaaataaattaacagatatcctgagttcatggattagaagaattaatattgttaaaatgttaatattactcaaagcaatctacacattaaatgcaatccctatcaaaattccaatagcatttttcacaaaaagagagaaagtatttttaagtacctggtagggtgcctgacacaaaaacccattattattatttatcactttaactgattatatatatatatatatatatatatatatatatatatatattacaattgctgcaaagtattgatatgacaataatatagacattgtgaatcctctgagagaatcttggagacagcagagttagccatggtcattctttgaaagccactgaattaaagcattacagaaaaaaaaaaaaaaaaacagtaaaacactttgttggtgttcctgggatgatttggatttaactcagattaagattttaatttactttatatcagaaagttctttttgttttgttttgtttttttacaaaatcattgtctcaagtatgtatgaggttccataagatcaagatccaaggactggtgggggttgaagttctattgatatctatagagcttccctgttactgtacattatggttttagttatcttaattgttttagggaatgcttcacctatagcttgcttcttagtttatcctcataacatttacctatgctttcattccttcccataaccataactaaaatgaaattatttaaagaatgtttattacttacctataaattgccaaaccctggagataaagaaatgagcaaaatggtctagctgtagagctcctaaactttgagaattgtgagcatgagcctggttagaaaaattcccagaacaatgatgatactgaaactaagctttaaaaatcatagagtaatttgaggagagaataggagacagttattatagcatccacatgtaacaagatatgaaataagagatccagcaagaattggttgtacagagcaaaagtgaacatatgagttaaaataaggccagtgaccaggcacggtggagcatgcctgtaatcccagcacttcgggaggccaagggaggtggatcacaaggtcaggagatcaagactatcctggccaacatgatgaaaccccatctctactaaaatacaaaaaattagccgggcgtgtttgcaggcacctgtagtcccagctactagggaggccgaggcagaagaatcacttgaacccgggaggtagaggttgcaatgagctgagatcatgccactgcactccagcctggcaacaagagcgagactccatctcaaaaaaaaaaaaaaaaaaaaaaaaaaggccagtgaagtacatggtataaggtactgaagtggtgtgcaccaatgttgtagaatatattcttgggcaaggacaattaaagattctctggacttgacaactatgatggctgctgcaatctgtaggatgtaaatcatttgacattttctaaatatcagttctcatttctaatgatatgattgaaaaatggtatataggttgtatcagacatgtgaagggtacccagcaaaactcaaatcttgaaattccaaataaaatatctacaaatgtataagaagaatgattacatattggggctctgggcatggaaagaggaagaaccatatggctgctttcctcacctgaatccttcatccaaagactttccagaaattgacatctccctcagaaatggtcatcaaaaccataaccaaagaaagaaaaaagaaaagaaaaaaaaaagaaaaacctcacagagaaacaagagtatatagctgctagtcaaagtaaatgtatgcttgtatgagatcttacagcttcacgttttttaggacagttttaattatcacccaacgtattagtttcacagttcaactcagcatgataaaccctgtgggataattttactacaaaatggcctattttccatacacacaatttgattacagctgtgtctttatctctgaaatccatgagaaatatgttcttcctttggagaagaacaatactgataaacttccaaaggacatctctgagcacttctgaagagaagaaatggtatttggtgtacttgggcttcataagccatgcaacacaaatcaagttataacaattctgacactatctatggctgcaactaattacttgtcaaatttgaatgatgatacatcaggtcattatactacagaatgataaaaaagaggacaacccaatcctaaagttatatgcaaccaacaacaaatcttctagtaatgtgaagcaaaagctgatacaatttaaaagaaaaagggacaaaaccacattttagtggggtacttccatgccacgctctcaaaaattgacagaactagacataaaatcagtaaggatatagacaaacatatctagtaaaacatctaattggcatttatagaacattccatccaagagaagaatacgttcttctttttcacgtgcctttggaacatacactaagatagaaaacaaaccacaacaaacttgaaagacttgaaatcatgcagaatgtgttgtttgaccacaatggaatcaaaacataatcagtaacagaaagataccaagaaaatctcaaacacataaatattaaacaatacactgctaaataatctacatgctaaaaaggaagtatcaagatagaacttttttaaatcattgaactaagttgacaatataacaaaatttgtggaacacagctaacacagtgctgagaaatgaatagcattaaatgattttattagaaaagaagaaaatctctggatgggtgcagtggctcacacctgtaatcccagcagtttgggaggctgaggcaggtagatcacctgaggtcaggagttcaagaccagcctggccaacatggagaaaccccagctctactaaaaatacaaaaaaattagctgggctttgtggcaggtgcctgtaatcccagctacttgggaggctgaggcaggagaatcacttgaacccaagaggcggaggttgcactgagccaagattgcgccactgtactccagcctgggcaacaagagtgaaactctgtctcaaaattaaaaaaaaaaaaaaaaagaatgaaagaagagaaaaatcttaaatcagtagcatgactttccacctcaaaagaaagagcaaaataaatgcaaagcaaacagaaagaaaataataaatataataacaaaaattaataaacttgaaaataaaaaatagagaaaatcagttacttcatttaaaaaaatcagtaaaattgacaatcctctaagaagactgaaaaaaatgagacagagagagagaggacatgaattcatgaattaccaccatcatgactgaaatgtgcaacatcaatacagagccttcaaatattaaaggaatagtaaggggatactacaaatagcgctacaaacacatacttgaaaactttgaggaaattaatcaattccatgaaatgcatagacaatcacaatttactcaaatacttaaatataaatagataacttcaacatcctataactattaataacattgactttataatgtaaactcaaaaaagtcatctccaggccaggatgatttccctggagaaatttatcaagcattaaggaagagttcaaatatattttatacattctctttcagaaaagagaagagtagggagtacttctcaatatgctttatgaatatagtacattcatgataccaaaaccaaagaaagtattccctggtatgaaaactaataacaaaaaaaaatgagagggggcaggagaagaaaaatatgagaggcggagagagaagaaaaatagtaaagagagagagaggagaagcgagcagtaaagaaggaaggaaggaaggaagagggggagggagggagaaactaccttgcaaatataaccacaaaagtttttaacaaaatattattaggtagaattcagcagtacataaaaacgaattcagcagtttatacaccatgaccaagtggtgtttattccagggatgcgaggttggagtgatatttgaaaatcaatcaatgtaatataccatatgacatgatcatatcaatgaacgcagagataccatttgataaaaatcaacataaattcattgatttaaaaaacccaactctcaggaatataggaatagagagaaattactcagcttgatgcttgataaagagcatctccaaaaaaccagcagtaaatgttatacttcatgttgaaagaccaaatgctttagtctaagattaggaacaaggcaaggctgaccaatcttcccattattcaaaatagcactagatgttctagccagtgcaacaggcaatataagtaaataagaggtaaaactaagattagagatgaagcaataaaactgtttccattaggagatggcatggcagtctaaatagataatcccaaggaatctacaaaaatactcctaaaactgacaagtgagttcagcaaagcttcagtattcatgataaacataaaaatcaaatgtatttttatatactagcaatgagcatatggacattgaaaataaaaaattaccatttacaatcactaaaaaatggtgtataaatctacaaagtatacaggctttttctatatatagacaagattattctaaaatgcatatggaaaggtaaaggaactagaatgccgcatgtctacaactatccgatctttgacaaacctgacaaaaacaagaaatggggaaaggattccctatttaataaatggtgctgggaaaactggctagccatatgtagaaagctgaaactggatcccttccttacaccttatacaaaaatcaattcaagacggattaaagacttacatgttagacctaaaaccatcaaaaccctagaagaaaacctaggcaatatcattcaggacataggcatgggcaaagacttcatgtctaaaacaccaaaagcaatggcaacaaaagacaaaattgacaaatggaatctaattaaactaaagagcttctgcacagcaaaagaaactaccatcagagtgaacaggcaacctacagaatgggagaaaatttttgcaacctactcatcttacaaagggctaacaatatccagaacctacaatgaactcaaacaaatttacaagaaagaaacaactccatcaaaaagtgggtgaaggatatgaacagacacttctcaaaagaagacatttatgcagccaaaaaacacatgaaaaatttctcatcatcactggccatcagagaaatgtaaatgaaaaccacaatgagataccatctcataccagttagaatggtgatcattaaaaagtcaggaaacagcaggtgctggagaggatgtggaaaaataggaacacttttacactgttggtgggactgtaaactagttcaaccattgtggaagtcagtgtggcgactcctcagggatctagaactagaaattccatttgacccagccatcccattactgggtatatacccgaaggatcataaatcatgctgctataaagacacatgcacatgtatgtttattgtggcactattcacaatagcaaagacttggaaccaacccaaatgtccaacaatgatagactagattaagaaaatgtgtcacatatacaccatggaatactatgcagccataaaaaatgatgagttcatgtcctttgtagggacatggatgaagctggaaaccatcattctcagcaaactatcgcaaggacaaaaaaccaaacactgcatgttctcattcacaggtgggaattgaacaatgagaacacatggacacaggaaggggaacatcacacactggggcctgttgtggggtgaggggaagggggagggatagcattaggagagatacctaatgctaaatgaggagttaatgggtgcagcacaccaacatggcacatgtatacatatgtaacaaacctgcatgttgtgcacacgtaccctaaaacttaaagtataacaataattaaaaaacggaactagactagctaaacaattttgaaaaggaaaaataagtcagtctccctggtttcaagttttattatataattacaatagtccacaatatgttatactggcagaggaacagacacaggtcaatggaatggaacaaaaaactcagaaacaaaaccacataaatatgcccaactgatttttgacaaaggtattaaaacaattcaattcatagcctttttaataagtgatattggagtaagtcatcatcagtgggcaaagaaaaaagaaacgaatctcaatctaaacctcataattcaagctggatcatggacttaaatgtacaacttgaaattattttaaaattttaggaaaaaatagaacaaagttttcatgactttggactaggcaaagagcacttaaatttgacaccaaatacaagattaataaaaggaaaaaaattgtaaatagagcttcaacaaaattaaaaactgctctgtacaagaccctaaaagaattaaagaaaatcaacaaaaaataagctacagactgggagaagatatttgcaaaccacgtattgaacaaaggattactatctagaatatagaaagacttaaaactcaatgtttaaaaagaatgctcattagtatatgggcaaagtcctggtcagacatttcactgaagggaatatactgatgaaaaaaaagcacataaaaaaattccaacattattggccaccagggaaatgcaaattaaaaccacagtgagatagcactatacccttagcaggatggctaaaatgagaacataaataaataaataaataaaaccaccaccagtcatttatacattattcatgaaaatgtaaaataacctgctaggttattttacataactccaggagacaatgttaaggtttcttggtggaaaaaaaaattgccaaactacattttccactatcatacaatacagcaatcactctcctgggcatttatcctagagaaatgaaaacttctgcttgcacacacaaaaagtgctagaatgttcacagcagaattatttgtcataatcaaaaaccagaatcagatcaggcatccttcaattggtcaatgtttaaacttcagtggatggtatatccatatcaggggacagagatattgatacagccaacaacctatataaatcaccagagaataatgctaagtgaaaaagccaaacccggaaagtcatatttgtatagttccatttatagaacattcttgaagtgacaaatttataggaatggagaacaggttagtggttgtcaggggtcagggacgtagtgggtagggaagtgaatgctctaaaaagtaaacatgaaggatctttgtggtggtggagctgctctgttcttgactgtattagtgtcactacactggctataatttgtacatagttttgtaaaaggttaccatttgaggaaaaactggtaaagagtatttgagacctctctatatatttctcacaattgcatgtgagtctacaattatctcaaaataaagggtttactataaaagggtcctaacatcagcaacctggcttattaaaaatgtcatccgaagactgtcatatcacattaatcataattatgtcaacaaaaacaaggtacatatattttaaacagactgtcatttttaaaacaaaaatactaaatcttatttgttcttaatgctctaactgaagcgtaatttttacttatactaaaacaaaaagcacctacatttcttatatgtgagctattttctccccctagagagctggaaatatggttgataacaacattttaaaaggcatgtggaaggacataaagtgaatgcctggagctcatattgtcttctaagattcttggattgaacatatttctattttaagtttaactatttttggcatgttttccaaacagtatctaggctaagaaaaatgtaacatgccaaagtaatggtaattaataattccagaggattatgctttaaataaagtcataacaaagagctaacatgcttttattaaaatgtgtaagttatttgcatcaaggaaagagctagtggatatatttagcaaaccggatatgcactgattttgttattcaagaacattagataaagtgcacagaagaatcctgtttgggagctctggcttcctaaaaaaaactcaaaaataagaggctgccaaagctaataactagatttgttgcccctgattcccacataaagacaagcctcttttgtaatgaatcctgataggttatccccttggcaacctgtcattcaagttcattagttcatttattcatctactaaatatgttatctgcaacaagggcaacttttactttgcatgggtcacttactactaaagcacagaaccagtagagatgagtgtttaataatctattgcaggacattttaccactgattatattctcctgtattttcacttgtgtattttaacataaatcagagaacctcatccttccgttcaaaaccctccaaaggcttccatttttatgaaggatgccacactattcccactgctcagaatgcttcccccccagagagccacctagggagcaccttcatctctttcagatcattgctctaaagtcctcttctcagtaaggctcacccagagaaccttatctaatattcaatttagcctatcttgctctaacacattttagggttcatttacttttcttagtgtccatctttacatttcctttataggattttttttgtgttcttgttcactgcactatcccaaaaatttttctcatgacaagaacagaatatatgctcaacaaaaacatgttaaatggaagaacttacgtttttcttggtttgctatgctttctacaaacacttgcttactatttataatgtaccaggcataattctagcagtggaatcaactacatgctacacaacccttgctctcacaggtctcactgtggaggaaaatattgcagttggggtgagaggaaggtattaaaaccggacggataaccgcagtacaatatgggatatagtgccgggcttcttgaaaaaccccgggatataaaaacaaacaaaacacagcacagtccttgaaactcttatccttaggaatctaattacctaatgagggaatgccatttaaaagagagagcagggtgaggggggaagataaataaacagaaaaacttttaaaagcaatgtaatatagcatgcattgagatgaatgcaaaaaatggggattcttaaagcatggaaaaaggactagctagatggcctggagaactctaagaataacaatgaaccaagtcttaaaagattaatggcaaatttttaaaggtgctttttaaattataaaactaggatgagttttaaaggaaatctgctaagaccccgtctttgaacatttaaacaacttattattattattttggagagtgggagagtaaattgatgaataaaatgtagttgtggtattggccagaagtaaattgaagctatataaggtttgtgataataaatttaagtaaagccagtcagtagtgttttgtgtttgatccagccctgttgagtggcccaggcacaggtgtaaattaggcagacaggtagaattagccaaagctggagttgctccagtcaagtatggtggcaggtacatgtacaagggaatatagagatatcccaataagtgattctaaagctgaactggaaatataagctgaataaggtcggagtgaaggcttaagaaggataatgaacattgaagggtaggcaagatcaatagtgagttgtagatccttttgagatcaaagaattattggagttcagggtgttgaagaggtataattcaaaataaatcaaatagcagaggtcttcgcaaattaataggtactaaatgctatgttttcaaatgaatacttaacaactttctcttaaatgcaagaggctggaccaaatgatctattatcctctatgataaattataagagagatgtctaaggtaggtttttcatttcattcaagtttaaattgtttgctgtatgattttattgggggtagattattaaacacaaataatattttaaaagtctctaatattgacatttatatgctggaatttaaatgacattgaacttctcaaattattatagatttgattatctctgtcaaaaatctcttatacttggatcaaagagctttccttctttaaaatactttcttactaagcaggattggggaccactggtgagtacaaagtttgggcacattatataaggaaagcttatggaatttgagaatgcttaacctgaaacaaaaagaaaaaatttagcagtcctaagatgttgaaagtgggcatgcacaaggtaagatctaaatagttccgaatttaggctctggaatcatttagatctacatttgaaatgtagctttgtgacttgggcaagttacttatcttactaaaaattattttcctctttctgaagcatttctgaggaagtcatttgcaaggttggtgagaaagggaatttgattacatgaacttaaatctacaattatttaatcccatatgcaaatagatgaaatatttatgtttttgagactagaagcctgtcttctatttaaagacactgtccttcaaacagagctcttcttcgttcctcagtctaatcaagaactctaaaaccaggaaaaacagcatatgggttacatgcaattgaaaactcaatgattccacctccaaaactggaatacattttggcagaccagactgcctctaggcttaggacattactgacttctctgactatgggatttcacagctgggagcaggaccaacttagcaaaactcttacatagatgaaatctatctttggatttatgctgacaagtaagattctgcaactggtttttaaaatattttactaaattttatgtgtttaaatgtaagtatgaaagaaagaaatttgaagttgtcagagcttgttgaaagactccttatttaagcagaagttgacaaatttattacattgtgtaataaaagcaggctatacatttcatatcgggaaggaattggaaagagcagaaataacaggagtcaggaagaaccacttgcttgtattagtttggcttggcttggagaaaatatccaatttgtcaagctagggtcaggaaagtcaaggtgtaattttccgtctaacaatggatagttataaagggccaaacaaaggtaacagtaatgggaatggatatattataatctacatcgaatatctctggattcagaatgcctttaatgttgaattctggagtatgttaccttagataagttactcggtttttcctcagctataatatatctatttttagagattctgcgagtattaaatatggcaaattagtaagtatttatatctgtgcctggcatttaggaggtgatcagtaaggtattaccagtaatgtaacggtggatgccttcagtgatcattggccagaaatgttgtacgaaggatacagggaatgtttgagggcttgatttaaatggttatcacaagcattcatttaatttaaattttgttgctcacctaccatattgttgtcattttgctaggtattggaactatacaaataaaagccctattccttgtatttaagagtgcagtctagtagagaaagaataaaacaacaggataacaaaatgtgctatgaaagcacaaaggacagatattagcaaagaccggaagcataaaggggcagtcgttgaaaaaggcgtccaggggtttgaaacaatggaagcgtatttcaagttgagaaaaaagcaaatgaaaagttataacatgtaaaaagcacagtgttgcagaatacggaaagagaacagtatagcagaaagaggacgtaatttataattaaagaacctggtttccgtggcctggctatgccatatactgccacaggactaagcaaattgatacaacttatctaagtttcaaagtactgatctgaaaagtgagattcataatatctaccctgccatagttgtgaggcttaaatgagataagttatgcatttacttcagaaaagtatttctttttatacccactatttccaaatgagctgacagtcttcctttcttttggactctagtcattaactctaactctctccctgcttccacctggacccctgctcctaacccattctccaccatccaggctgaagaacctaaatgcacaccagatcaagtcacatccccacttaaaagcccccaatgacttcccattgctcctaaaaccaaattattaatgatgggctaacagatcattcatgatttgtcccctgactgtctcactaaagtcattttcacgccttgctttcctcactctctgtgcaccagccactttggccttctttgagtttacacatatccatgccccttcctgctatttgtattttgcatattacctttaccttgtccttgtcctcctctttctcccactttgcctatataatttcaaatcttttttgttttgttttgttttgctttgttttgttttgttttgagacagattctctctgtcacccaggctggagtgcagtggcgcaatctcggctcactgcaagctccgcctcccgggttcacgccgttctcctgcccaagcctcctgagtagctgggactacaggcgcccgccaccacacccggctaattttttgtatttttagtagagacggggtttcaccatgttagccaggatggtctccatctcctgacctcgtgatctgcccgtcttggcctcccaaagtgctgggattacaggcgtgagccacggcgcccggcccaaatcatttttaaaatcttgcatcaagtgtgcctatcccacccttatttattaggccacatgcccctatcataggatctcccaggacttgcttcctttactttttagcacacaacaaagacaaaattttgcatttgttaagtgataatttgcatccttccaaccagaccatgaccccaggagagtagtgaatatttgctttttcttgtactataacaccactgttcttttcatgtcagcatatctctctgctaagtttagtgccaagtatatagtatgtgttcaggggcatcttttgagtggaggaatagatgaaacttcaaatccagtgattggtcacattattaataatcaatcaacaagagtgattttcattactgccattatcattctgctgctattttatgtttagggtttttataaatagagcatagatgcaagacaagaagggagaaaagtgatgctgggggaagtacaaagagactagataggtaataaaggtttatttgttttataccttgttaggtcatacgggttttatccaagtgtataagaggaagaattaaaggggcttaagcagaagggcatgatgaatagctcaatgtttaagaacctctggtagcagaatgcaaaattaattacaactatgaagtgaaggcagggagggcagttagaagactcttatgaaatcaaggtgagaagtaaaagaaagtactgaatgaagactgtgaatcctcagtttctgtagttttctaatcttcctgtgtttaatgctgtgtcattaataatttcacatgattggtgaaagtggcaacctttcattccttgtttaatcactcacaatattaatgtatctataatataacttcaaataaagaaacacagtcctggataatacttaaaatttgaattccaaacttcaataccattgtatgtactcagaaagaaactatctttgttgtaagaggagaaatatgtaatacaattatatgttttttttctgagtcttgatttaaaaggaaactgtgaaaaaacagtatggcataaagatgaaaaaagtctctttggaccaaaatttcttctttgaaaacctatgctggaaagaattcgtatgcagtgctgacatgtaaattcaaggatatataatgtttactacttaaaccatttactttactaaccaaaataaaagacatggttagctggattatcaagcaaatattcaaaataaaattaaatttaagtatgctcagatctctatcataaatcataaatttcctctggtgttatttctctccattatatgtaaatagacaaggactattcctgcaaaattgttttaccacacagtctgtatttatgcatctaaaatgttattcttcatggctatgtttctatagacatcaaggttatctaaatttgattttgataatagtatatatatccaaaactatgataagtgatggttcactagttgttagtacttttgttataattgaactcaaagaacacaatcatgttgttactggtttcatcgtaaggttaagttctccagtataaaatttcattactaggcacttatgtgggagaaaatagtttggtctactctactgtctttatatactctgctatttctaattcaaactcatgaaaaaaatgtttcttcacattacactacaaatacgattaccatccataagtaatgatttacagtaaaaggcaatcaagaaaaatcatgtttagaagatagaaggaacaataaatatgcataagtttttgaagaatattcttgcattttcatttgcctctgttattcctttagtttgtttcttaattaagggcattttagcataattttaaaaacataactgacaagtgataactttttacttacaactaattaggagcctaatttacctttagccctattgttttacacacctcataaaagataacatcaatgtctgatccctcttacgcatctcttccttctttgtccctctacctaaaaataaaaataaaaaaccttaagatgtataagataagcaaaggttttataagttaattttaagtgtataaatgaataaatttgttaacacaaaggtaagttgacatattagcataccaagatgtaatgtcactaaattgtaaatcaagtaattacacagagtttattcatacctcttttccttctttggtattccttaaccttttcaagtttaatgagctaatttcaattttgaaaaaaggaattgaaaattagataattacatccagctttattttaaccactaattgacctaagtttcttagcagaccattgagaaaattaaagctcagagaaacagaggaatttacccaagattatcaagttaacagatgagaaaactaggactcacatattggccattatattcattaagtaatataataaagtatgtatgaaattgtgcagaatacaaaaagtgtttaagatctaaaagcaatgatctctaagccataaaataaaaacacaaaatcaggccgggcgcggtggctcacgcctgtaatcccagcactttgggaggccgaggcgggcggatcacgaggtcaggagatcgagaccatcctggctaacacggtgaaaccccgtctctactaaaaaaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaacacacacaaaatcaaaatgtttacaattgtaataaatatatttaaattgaaacatcaattagctacaaactccacatatgtatatacacacatattatatataatatagttatatattatatgtatacatgtatattaacatatatatatgtacacatgtatatggccatatacattacaaaggattgaggcaaatattgagcaaatgattattaaatgtaaattttcaaagtcttaagatcatggcctattatacacgattatatgcaataaaagcatgcccacagaatactctcccttaaagttagagtgtgaatatatgacgtaaccatgatttgcattgagatcttttggattccaaagtctaagattttatcatgacactaccctataaacatggcccacagaaactgtgtaacttggtcaaatcttacagcaaattcagagctagagaatgtgtaaaatatacataacccctgcttcccaataaaccctatgagtataagctatttgagaaggaatttaaatgcccaaggatcacagaattatgaaggtatcatgtggccacctagattagggtccttagcctagaattcatgcaactgtaagggatttagggtggcacagaattgttaaaatgatatatagctgtattttgtgaaaatttcatgtttatgccaattaaaattatagacaacatgttattcttaaagggagttataattgttaaaagtttaaaaattattgatataaacaactttttagatgactaagtggaaacacagagagccaaagtgactgtggagaaccatacaactggataatgggagaatagttattagaacgtaggtttcttccttcctttccctcctcaactgaccatgtcatggtgccatatgtattaagccacaccatgagcttgcaaaagcaaagctaatatctgcagaggatggcacatgattatgagaaaatgagaagccttagtggtctgaggcatcctgatggactctaggtaacttactcctttgctttccaaaagagtaataagaaaagctatatttaatttaatgtggttccatttgtagagagaaataatatctgcttctttattaacttatggtgcaaggataactcaggccattttctaaggaaactcaatgagttagaatctgctaacctcagtaaacaaaacctcagttagctgtaattaatgttcatagtgcatctgcttaattttcctaatgcactagcccttttttctttcgttttcttttttttcttttaaaacttctgtaattcttcatgagctttactttcagtaacttatggggaggtttcttaatcttattttaacatggtattgcaatattaatttgaatttttttgatggtggagggattttaagaaacaattttaaaacaaataggtctattcatcaaaatgttcaggctaaaacagttgtgaatatcgtgggaataacttataagggagacgacatcttcattattagttcagtggtgtctagttgaaaatgtctatattacagagaagttggcaggagctgctaaagaatgcttcagcttgtccacaagtaagaattaatcctaactgattactgaaaaccagagctttgcacaaaattgccttttcattcatagtggcatctcaacactgattacgtgaaatctgcaatgtactttcaaagaaactgagatgatatacttgataaggcataaaaattgatctctgccaccaccaccaaccatgaagcagcctacagcatcttgaccattaaatgaattgattattaggggccagacagtctgctaaatacattgcatacattattttatgtaaccttcatgggattgctattatatagatgcaattactcttaatctatctacattatagcaatgttatttcatagatgttttcatagatgaataaatttgcatttaaggagaattaaaaatttgatcgtttcacagaatgattaagggaagaaattctggatttgacctcaaattaccttgattccaaagctagttccattaactatcaagttacatcctttcccattctgatagcaataatgcataggctaatggatacattttttataatgatcaaaaaattacaatgaaagaaaaaaagggtgggaaaaagagagaatggagggagtgagtgaagaatggaagagacaaaagaagaaacaaataatttagaagcagaaaatcgacaatcagaggagaagacattgaagataaaaataaacagcaaagtaagagtagactttttgttgccatggagatttcggaaatgaaggtaaaatgtatctgcatataatacttgcaaataaagatctgtaggggtagcaggaattcctcatgccaatgaagtaggtgcccagcaggaggaagctgactcgcactccttacatcagagcatcctggcctaatccagcgaattctgacatcaagctcccgtgagcagagtctgaaccatttaacctagcatggtgagagagtctatttggtcatctttattgttgcaaataggggtattttttgggaaaatgtatgatgcgtaaaaaatataattaccttatgactctacattgaatgcatacattattctctctttaggatcaaatccactaagagaatcaagaactgctgcacagaaacctttgatagccaatgtcctaatacgaagaagaagtaaatgaacagaaggagacatagacttaaagctctcgcaaaattgaacaatatttcaaggccctacattgaccaaacattaacgttaaaagagcctcaccatgtcagcattccagccagcccaaatcgtcaaagagcaagaaagcaatgctaaagaacaatgtgaaggaatcattacataccgtttgaatagtttcctaaattcactcagtgctctatctattattagctatagcacagagaacttgtttcctattacagatggtagagaatttctagtttgcataaaatcaacatcctctaaagttctgaaaaaacatatgtttgcagacgcttacccaaagatagcaacggaacattcattattcattagctgtttcatttcaaattttttatgatctatttgccatatttcactgaatctaagatcttgcagacaaagttgataggtactccctttgtaatacagttaagatcagactttaagatagcacgtcgtgttgctacatgtaagagttctgtaagtctaatgcgatagatgacaaatattggaagctaagcatatgtgttatttttctgcatttgtcaattactattttagaggaaatatttaggctttccttgctcatgttcctgacttggtccacagagaacaaatgtccacaaataatcttgtctttatgagaatattagaaagaaacaaataacttctttttcattttatagctttaaaagcacaagaagagggagggtactacttcattctccatgtatggcttgaatcaagctggtttacggatctctgcattgcacattaggagcatcatatattggtcagaatcctgatggtgaagtcaacaatacaaattcaggcgtcaagcctcactctcacacctgacaattctgtgtattttgaagcactccgaaatctttatgagggcagacttgccccatactactatcagggaagaattatcttgcttctcagtgcaaaaatagttgtaaactgtcaaagctatttatcttctcatgtcaactccctgctcattattagaggttcagggaaatgtcatttctactgagaaatggtttttacaacccaaatccaaatccaatgctacctcttctgtgatcccttaacaattttaatcttattttagcacttatcacagcctaccagatagttattaaaattatttgagcatgcaccttgctcattgactagaagtgaatccctagtggttagagattaggtaacacttattcatgtagcctcccacttcttacaaagtacattacgtttgaaaagtatggaaagacttgaatctttaaggcttatattttttattctagttcagaagagacagtgtgcccaacatcagtaagtcaggtattctggagatatttgctacatagtcacaagtatatccattatcatatgcacacatacatatacacaaacatacatatatatgtttgtgcatgtgtcaaatacacacacaaacacataatcacaaatacaacactacaggtatcttcccttttcttttcacaattgttgctagtaactccacctctatttcttaatagaaatttagactacttaaggaaagaaaattgtagagatcatagagatctaccaagaccattagtatcacagcacatggtacagaaaacagaatttgtgttactactcaacagtgccggctcatcataaaagcacaaagacaatttgctgagctgagctgagcttggtttcaatgctattacttcaattcattttcccctaaagatagggctgttttttttgcctctttcaattgaactaatgtacatagagagtagaaaaatggttaccagaggctgggaagggaagtgggggctctgggaagtggaggcacagatgattaatgggtacaaaaacaaaatagaaagaatgaataagacctactatttgatagcacaacagggtgactatagtcaagaataacttaattgtatatttttaaataacttaaaaatgcaattggattgtttgtaactcaaaggataaatgtttgatggaatggataccccattttccaggatgtgcttattttatattgcatgcgtgtatcaaaacatctcatgtaacccataaatatatatacctactctgtacccacaaaaagtcttaaaaataattttttaaaaattttaaaagctttgcttcaattagtcttgaatgcttggttctggcaccgcctacttcttgtgggcatagtgcccactgtacgtgttcaagtgagctgcactcatccatctttcactagggctgattcatagggcggccagaaccctatttagaaccatagcttgctgcttacataaatcaatgaaatcatatgaaacacaatataacatggtttcattgaaagagcacaggtgtcaaaaggatgtgagtttacatattacataacttaatatttatttgaacttggactcgtcacttagcctggttgaacttcaaatcctttattggtgaaatgagcatccactcataaaatttcataagcctatttcaaaggattgctaccttatataattttataaactatgaattctcatacaaaagtcagtgataccagatcacacaatttaaaatttataggcagacacttcactacttttgcttcccttcactgtgaagtaacacatgctatcaccttggtggcactcgcagggtatctgttggctggctgttttattgggcttcttcctgccactcaagtgatcatgactgagaagaaatcaatgggtgtctgttggcagtgtttttaaagacatattccttaggtaatacaggtagtcactcataaaaaaaactttttttctggatattagtctgccctcgtggatatctcagggcctcatacttcatcaggcaatggccagttcatttttttaatccaaagctacacagagtgaaacactttattctgtgtgtgttttaaaagcccaggtagcactaaataccattttccaggaagtgtgccaagtactttggaggatgtacattgaacttttcattagaaaagcttcccaaatggataagagttatctgacagaaaatagtttcatatctcattatacctttgagtgtgattacacaaaccagcttggaagactaccaggcagcacctggctgttctcaccttgactctaccattagctaacaatgtgagttagggggcatgtcatttaacctcatcgcttttgttttctctcctgatctagaaggcatgatatatttgccacttgaggtcctccctgtttctaaaagtgatcaaatgtggtttttagtagagcagattgcagatattgaaacaatcaaaacccagttggaaggaaagagaagatatcagtgatctacagggaaaaaaacactagattcaaaaatttattttagtgctgagctttctagtgttaaggtaaaactaactaaacacatgtaaattatatctatatataaatatgttataaatatatagaaccattatatatgttatgtattatacatatatttatttatatataccataaaacatatttgtgcttatctataacacataacatatataatatatattcatctttcatatttattatatatacattatacatatatgtacatgttatgtgcatgggaataatggtttttcatatagacagatattttcataaaatttgtttcaaaagtaatttttatgctgacatgtctttatataaggactttgaataacaatattcttgttgtctttaataatagtcttatagaaagaaattaatattacatttccaatattttgtggtggtagtatttgctaaccaatgcataatcctttatatacactgtctgttgttatttaagtgtccctgaaaagtaattgttatctcctgtttgagaaaggatgaaattagcatttagagaagtcgagtgattttcttattgtcaattagcaagtataacagtaagccattatgatgtggctgtttctacacatctgggtgtactttagtgggcatgcttcttttgtgaggccaagtcaataaagaccatgttggctcctgaaatttagtatatgcatactaaggtctacctctagtgggataggataaaacagtcaggaagatattttcctaaagtaaatactgtttccactcagtttttcattgcaaactggataatagccatctgcagacaaaatttttgatgggagtacatgatgagagtactttaagttgtttgtagaaagaaaagctatacattttaactaccaaatacaggtagcaaggctagcactatcattaacaccaagaagctttcttcatattctctcatttatgactacacagaggtagatataagaataaatttgatgagctctcaagcccttccaaactttaacattctgtcaccatagaataaactatatataaactaagcaaacgtttgactccactaaaaatatgaaattcatcagtgcatccttgttctggtatgaccctcagaccaccaaggtttaactaatggacttctgagtattaccttggctctagtctgtagcaatgctcaatgaatagaagataagtagactcttctgttaatactagtttatgccctacaaaataaactttattgagaatgtcattcttgagacagattcattcaacaaaattaaaaaacaaacaaggcatagcataatgtacagaaattgaaagctggccttcagcacacctcctccttccaccagctactgtgttttacttctctccacagatgtaatgaaaatgcctcttaccatttatccaataaatacctactctgctctcagtacttgatacctatgacttaatccttccaacaacctttcaagagaagaatgataactcccacttacaaaaaaggaagcagaagctgaatggccaaggtaacagagctactaatggcagacccaggatttcagtccaagtgtatctgattccaagcttgaaccctttaacacaatatgcttcttctcacaagtactatatcagatgcactgttgcttcctgttatttgttgagtacccaccatagagtttctattccagaaggaaaataagagatttagaagaaaatctacagaatgtttggttttcagttcctacagagaaagggtcataagtgacccaagcatttagataaaagtctaggtcaatatgcccatcactagcactttgtttttacttcttaccacctctttctccagtacctccctcctactctttcagttatatatccactgcttggcacatgataggccctttaaataaaattacttaaactatctgcctcaatttcctcatctataaaataggataatttaaatttcaggtttgttgcatggatgaaattagtacaatacagcatctgacacaatatatggcacataattatctaataaagggtagttattgttgtcattgccattacacatttgttgaatgatttagtgaatgaagctcacatgcagggcacatgtagtgtctataggccaaatagttgtgcttaacaccaaggagtatctgtgtaccaaatccaacccccagaatagagccttgcccctcagaaacaagccacttgtcagtaattatgtcatcagtgatgcaataatatgtgaaatgtactgtggcgagatccctcagtcattgttcttttcaacatcatatcagtacaaaggcagctgatgtcacttgctgggcttaatatttctgccccttcagttactaattcattaaaaaatgcatttatttgttctaacattgatttattcaatatttttaaaaatttattctactatgtcttggacatttatctatctatctatcccaaatgctatgagaggcactgggatacggaaattaaagacctgtccttgaagaacatttagttctgtgaaaaaatggtcatacaatgcaataaggactagagaggagggctgatacaaaccatggtgatgggggatagtgggaagttatgggattataggattacataaaaggttaggcttcctaaaagagcacccagaattttgaaggataaataagaaaaataatattttaaaataaacttttcatttcagaatagttgtagatttatagaaccactgtaaatattgcacagaaagtccctatatactgcatacccacattttcctgctaacatcttgctttaatatggttcatttgtcacaaagactaaactaatattgatacattattattaactaaagcctatagttagttcagacttccttagtgtcttcctagtatccttttgcttatctgagatcacatccaggttaccacactagatttagttgtcctgcctccttaggctcctcaaaacggtgactgattgtcatgtttttattgttttagatcaccttgacagttttgaggagcacgaatcgggtattttgtagaatgtccttccattgggatttgtctgatgtttttctctcagattacattggggttgtatgttttggggaggaagatcacagaagaaagtgccattcttatttacatcatattgagggtatgtgctgtcatcatacccttatcattgtttatgttacacttgatcacctggtattagtgtttgtcagctttttccaccattccatactatctaggctttgtatagaaaaatgtcatatcaagaacaaaccctttcagctgggcatggtggctcacacctgtaatcccagtactttgagagcctaaggcaggtggatcacctgaggtcaggagttcaagaccagcctgaccaatgtgatgaaaccccatcactactaaaaatacaaaaaaaaaaaaaaattagctggtcgtggtggtgggtgcctgtaatcccagctacccaggaggttgaggcacgagaatcacttgagccccggaggtggagactgcaatgagccgagaatacactgccactgcattccagcctgggcaacagagcaaaactctgtcaaacaacaacaacaacaaacatacccttttatctccaatacttcccaaatttcggagtggaaggattatttctgatgccagaacctgtagaaaagtttctgctataaaacaggaagacaaatcagacacctttggtttaatcattcatatgattcaatgaaagaggctgtactgcctgagagatgtgacatggctctggaggcccctcttattatgattttcttcatacacacaaagagctgttttatgggctgcagctgcagcaaccattaggaagtacctcataatctcaacagtgcaaaatctgggcagggacagggtgagttcagccatgcatggtttatgcaaggtcagggaggtaagccaaagcattaccaattgttaattctcactattccaggggctgaatataccttatctaatttaatttaacccacataattaccatgtgagttaagcatttctggtcctatttatagtgtacaagtgaaagtctcagataacacaaaatagtaagtgcagaattggaatttaagcccaggtgtttggacttccaatctcatgtttatagcatcaaaagacattttaggcaacaatccaacattaataatatgtcacatccattttccaccacagattgttcagagcatgctcccttacaggaaacattcttaagctaagtcatcatctttcctgtaatgggagaaatagtagaagtccatactaagaatgtggaccacagtagaatttagtgatagactgttggaattgctaaagatcagtgggtgctgacagtcagagaattaaaactataacactgttagaggagtaaaaacaagccaaattatggccatgatggtcctcattcaattacactagtaggtagtccacttaaaaaactccatataatctggtctacatgtcctagacacagaaccggaggaaccatcgattccagcttcatgcctatctggtttttgatgaattaatgatccattatccctgtgagaccattcattacatattattctatgttaaaaataatgtgtgacatacatttatgcaatatatactatgtgccaagcatgatccttagggctgtattaatcattatctcatttaattctcaaatatccttccatgtaatcacaatgaatcttatttggcaggaaaaagaaaaaactggcttagtgagattagtgctttctaatggtggcagaattagggctcaaatccaggatattctgtttaccaaggctatttcctttccaataccctgtgagagtctccatgaagaacgataaataatacatttgaccacagtcccctcatttcaccatctaaattccaggtcatagttatctttacacaacttcattagtgaatactgaatggatttgttattacaacagtctgatactcaatattttgaagctaatgaaaaaaagaacagaagggattcagtggatatttggagtcctagaaaaaagaaaaagctttatgaagttcctcagaagtcctctgcttccctcaatgtaataaacagaaagcaaaatgtgcaggaagaaataaaaaagaaaatatcactaacaaggtcactccatcacctgcacaagcctctttaaaatcagcccacagccaaggttcctgctgtcagctcactggactggcaactcattggataactgcttccttaatcctatctttctgcttccttgattctcaaggaagtttccaaaagctggggctgtatataccagaattattgggagaacaggtggtatgtaaggttgcagtattcatttcaactcaagaaaatgattaactgcacagctcagcacaatttggagaagttttcaagtgcaggcagtcagtactaaaaaactgcagctcaaattcccgtgatcccttgaaaaaactggagacagatatgttaaaaggggaaaaatcatgtgaagatgaacggtagagctaagaaatgcaatttttagaattggaaagaattgagctttaaactctagactctatattttttgggcatgtcacttaagttgtcagagtctcagtttgtctatgatggggttataacgtcttcctcacaatgttactcactctttaagtcattcattcattcagaagtatttttttccatagatattatgtaccaggctgcccctgacatttgggatacaactgttaatatattagacaaagtctgtctcatggatttgggaaaggggcagacaataaacaagagaatgagttaaaccacatgagaatttgagatgataacaaacgttcttaacaaaacaaaacagagttttgtgatagatcatatcctgggaggggctggtgaaatatttttccccagcatatcacatggggcctggtttatagcagttattccatttacattttaactaaacacatgcctggactctagtaagtgctcatttcatgcattttctttctatgcttgtgaaagctggtttttgtagcctaaaggagccaatattcactatacacactaaccgtaacttcaactattttgatattatagaacttttactccatattcatcatataccaactacttaaatatgaatatgatccaccacaaggtagaagttatgcaagattaaaaataaaagaataggctgggcgcggtggctcacgtctgtaatcccagcactttgggaggccaaggggggcaggtcacaaggtcaggagctcgagaccagcctggccaatatggtgaaactccgtccctactaaaaatacaaaaaaaaaaaaaaaaatagacagacgttgtggcacatgcctgtaatcccagctactcaggaggcagaggtaggagaattgcttaaacctgggaggcggggattgcagtgagccgagatcgtgccactgcactctagcctgtgtgacagagggagactccatctcaaagagatagacagacagacagagagacagatagatggataaagagtattttactcttttttactttccttactagtctggcctgggaggtaaaatgtgctcaaatagaactgcaataaacgacagtgcattataaggtcctttagtataaaatgttttctgtgtcaagaagtggatcacttgtcatggggctagaggagggttcaagcaggaaatgggttttgaactaggtcttagatttaaaaatgaaaatgtaggagcaaatgctttgtaggaaatctgtttaaaatgtctcatccccagagtttctgattcacaaaatcagggatgggtcccaagaatgtgtatttctgacacgttcccaggtaattttcatgcacgtttccagctatgtttttttccaaacagtgatgtattatacttggaaagttactgtatcactgcaccctcctgtactattatggggcatgaatgaagtatatgcaaagagtgtgtgtgtgtgtgtgtgtgtgtgcgcgcgcgtgcacatgtgcgttcattgtgtgggtacatggaaaatatcagaataatgatgaagaatctttcatacaccatcaggggggtaattgttatccctttcttttgtctctgctttccatcttacacaacatgacccccaaacactcttcttctgctctcttctccatacttcccagacgcatcctacctattataatgttaaatcaatggagtattgctatcaagttgagattaaaaactgctggggtccttagaacctctgtagtctcagagtaatacagagtagatcacaaatctagtcccagacataccagggtctttccttgtccagccatgcgtgttcatcatttccttagtattttaccttacagtgggtcagttaagaaattttaaggccaggggctgtggctcacgcctgtaatcccagcactttgggaggctgaggcaggtggatcacgaggtcaggagttcaataccagcctggccaacatagcgaaaccccgtctctactaaaaataaattaaaaaaaaatattcaggcatagtggcacatgtctgcagtcccaggtacttgggaggctgaggcaggagaattgcttgaacccaggaggcggaggttgcagtgagccaagatcacaccactgcactccagcttgggcaacagagtgagacttcatctctaaataaataaataaataaataaataaataaataaataaataaataaaaataaattttaaaataatgatcttaatattaaagttgtccatcagaggccaggcacagtggctcatgcctgtaatcccagcactttgagagatggatcacctgaagtcaggaattcaagaccagcgtggccaacgtggtaaaaccccgtctgtactaaaaatacaaaaattagttgggcgtggtggtccacatctataatcccagttactcgggaggctgaggcaggacaatcatttgaacctgggaggcagaggtcgcaatgagttgatatctccacggcactccagcttggaggacagagtgagactctatcttaataaataaataataaagttattcatcagataccaagtatcttttttaatcccaaagatactcattgaaagattacataaatacaggttcagacagctagccctgccgggccagagatactgaggagactatgcctaatgatccctcaactgcaccatcactaaattatctgcagcctcctttaatttcagactcttatatcaggatcttcatagcaaaaataattctgatcatctaccaaattaatgaagaagtttattttggcattaaattcatttttaatttgcttcaaataatgtaagttttcaattgaggtagagtttattaaacataaaatactggcagggatgtttatgtatatcttatcacctctttagctcaaagatctcaagatcaaaataacagaaaatatttgtattctattataatatattatgaccaaaaatatcgggaaaacaaatattttctactttgtccaactttcaatgacatattttcaattcttatgtgtattactggaaaaaacaaatctaataccttggccaataagcttgaagtatgaatcaagctttgaaatataatattggaccttcacagtctgctaacaaattatctacaccttggcccagaattgcttcatagtagactctctaaataaccataactgactgttaaacaagtgaatatctcaaaggacaggtaatcaaatgagctctacaccactaacagacaatttttccactaaaaaagatttatttatatcttcttaatgtctgcctcaagccacaaatctatacaatgttagttagcaggagaagctgaaaattaggtgtggtaagaatgaaatctagaaagtcatcttcacgttatactggcttcattttttcttctgtatcttgtaatgtgaggatgtgggagtactggcataaggaaaaaaatgttatgaaccatccttttctagtccgaagagaaaacctccatttgtgtctctaactaccaggaagcaaccttaactctgttcaagagatatcactagactggatctgccctggtggctgacaataaattgtaagctcagtggctcagatggacagcaaacatgtttggaagttgctaaggatggcaacaagagacaacatggaaaggtaaagataggtcatattgatgaagacttcagtgagagtgaaaatatgagaaaggttaatgcagacataaggagagtagagtcaatatactctacactctttaattataaaggagcatgcaataataggaactacgcaataacctggaagtgatctatgcttacaaaatgcatcagatggaattgaaaacatgttcatgatatatcattattgttttttaaattaagtcacaaaggaaggtgcaaaaatcaatctcaatttttgttcaaatatgatttaataaaatataaagatagagagggaaggaggaaaagaaatggatggtgaaaatttatgctggcaaggttgcatagaaaaaagaatacattgctggtagggatataaatttgtttagctgctatgcaaaacagtttggtgatttctcaaagtacttaaaacagtactaccattcaacccagcaatcctgttactggttatacaaccaaaggaatataaattgttttaacataaagatacattcatgcatatgttcctcacagcactattcacaatagcaaagacatagaatcaacttagatgctcatcaactgtggagtagatttaaaaaatgcggtacatatacgcagtgaaatactacacagccataaaaaaagcaaaatcatgctctttttggcaacacacattttctaagcaaattaactcaagaatagaaaaataccacatgttctcacttgtaaggatgagctaaatattgaaagcaaatggacacaaagaagggaacaatagaccctggggactacttgagggtggagggtaggaggagggagagaataaaaatctactcactgggtactatgcacattacacaggtgacaaaataatctgtacaccaagcacccacaacacacaatttacccatgtaacaaacctgcacatgtaccccctgaacctaaagtaaaacttaaggggaaaaaatttagagaaaaattagaaaatttaatgtgaaactgccaatagtagttgactccatgagtagaattgagggtcagggtttcatatagacactttatacttctttagcatctgcatttggaacactgaatatagatagcatggtgtaatagaaagagtctttggagtgagaaacatctaaaataaaattttgtctcaagtttactgtgactttgtaatattacttattttctctgtaccttagtttccttggttcctataaaagacaattatatctgcattgtaagacaatgtgaaaataaaatgagattctatatatgaaaatactaacacatgagagtcattcagtatatgcaatctactattatttctcatattctaagccctgctggaaggaaggaaaaggaatacattaatcactctttctttacctttaaatggaatacttttaagaaaagagaactccatagggcaacagggaaagtcaccctggaaaattaatcttatgactagttatttctgtcttctcacagtatttcacaacctattgaagtcatatgttttaagtaacccatgtgacgaagtggaggtgttgaagtaaggaatggtcaaatgattgcacatgggacagaagaaaaagggcttcatcccatcttctcaagagacagagacaagttttcctttccaggtgtttgccttctcttttatattggatgcttgctcactggccacccccacaaagctgtaccacattttctttcttttttcttttctttttttttttgagatggactctccctctgttgccaggctggagtgcagtggcgcaatctcggctcactgcaacctccgcctcctgggttcaaacgattctctggcctcagcctcccaagtaactgggactacaggtgcatgccaccacatccaacaaatttttgtatttttggtagcgacagggtttcaccatgttgcacagggtggtctcaatctcttgacctcgtgatccacactcctcagactcccaaagtgctgggattatagacgtgagccactgcacctggccggcattttcttactcactcaaatatttttcaaagcctgaaggaattagttactaagttacagtgccaaacaggctactgaaacaaggaagactaggaagtttggtttattagatgaaaatagtttatgacaaagcttctgattttcacacttttacattaagtaaaaaatcctaaccctggggttgcagtactgaccaagctctcataaattagtcaccctggtctagtctacaaaataagaccgtgacatctaaatcctgaaaggaaacacttccatattatttagcatttctgttttcattaggacatgtgaacgtatttaaattcaacattgaataaatataattcagtatgtatttatttgacctccatgtactcaaaactatggcaactgctatgaacaatgtcaaagaaatttaatatcactgctatggtctgaatatcctctccaaaacacatgttgaaatttgcccttgtggtggtgttaacaggtgggactttgggaggtgatggggccatcagggctctcccatcatttgtagaattaatgccattttaaaaaaatgaattaggcccccatttgccctcttttccttggatcttctgccatgtgagatgaagtatttcttcctccaggaggacaacacagcattcaaggcactatcttagaatcatcaaatctgccagcgtcttgatactggaccttccagccaacagaattgtgagccaatacatttccgtttataaataatccagtctgtggtagtctggtatggcagcacaaaacaaactaagacaaacccttactacaagaagcccacatcctcattaattataactaacatccacgcagcacttatcccaatttttattacctgtttttttaacaatttaagtatcaaattttggcagacatggtggctcctgcctgtaatgccaacactttgggaggccaaggtaggaggatcacttgtgtccaggagtttgaggccagcctttgcaatatagtgagactatgtgtctacaaaaaatgaaaataaaaaattagccaggagtggtggtgtgcacctgtagttctagatcagggactgagaaagaggctgagacaggaagatcacttgagcctgagaggtcgaggctgctgtgagccatgatcatgcaactgtactcagcctgagtgacagaataagaccttgtcagaaagacaaaaacaaatccaaaacacatttgaagtactataatttttagccatatatcacatgacgaaagtgtttggtaacccttaataaacacacaatgtaatgatcttaaaaaggaaagatgcctcagtacatctctaaaagaattggttgatttcattttgttagtaatagaaaattaaattaaccttttctgttttttaattatactttaagttctggagtacatgtgcagaacatgaaggtttgttacataggtatacacacacgtgccatggtggtttgctgcacccgtcaacccgtcatctacattaggtatttttcctaatgctatcccttccccagtcccccacccccctacgtaccctccctgttctccttcccatgtccatgtgttctcattgatcaactcccacttatgagtgagaacatgcattgcttggttttctgttcttgtgttagtttgctgagaatgatggtttccagcatcatccatgtccctgcaaaggacgtgaactcatcttttttatgcctgcatagtattccatggtttatatgtgccacattttccttatccagtctatcattgatgggcatttttctaaccaaaacattacagaatttgtaacacaaataagcttaacatgttaatgagaaaaggaaaactacaagttatctggtagaaacactgttaaaaaattttttggattattctgtcagtataatatttgaaggaatcattcaatataataggaaataagctgtgataattagtgacataacaaagtcagataaattaactcaaccatacttagtgagaaggttgatagaaaacttaagtctccttaatactagtgctttgttcttcagattctggtataatttgatagcaggacatatacatacatatagcatatatttcaataaatctatagaatgcttttctagttttctatcaccagcactctgaacattaacattacacatgttaaaatttaagcgttgagtttattgaggctttcttcaagttttcttaacaccagaatgctgtatacttgattattccagatgcatccctaatgagattttacaggagtcattgtggttgtgcatgaaaaggatgaggcctactgaaactttttatttcctaaatgccttatattaaaaagtccttacatctcttattcaagatttcctactaaattgtttacaaaacttccttgctgaataatcacggtaaggtggttagctgggtagtagacactaaggaatgctgggtttccagggaaacagtgccacgggaagcaacaaaagagacaaccaaagctgtagatgtcatattacacaacattttattttttactactgttatattgttatactttgttattcttgctttttccttctttctgggagacattgtctctctttaagaactctaaaattgacaccaataacaacacacaaagcatgacattagtataaaatctattaaccagaattcatcttttttcaaaataatacaatgacaacgggtgcaattatgaaacgtatttttttgatcagctgaccctaatgtacttcctaaatgataaaacttggatatttgacttcttccctaattcttccagtaaaattctttttcaataaaagtgtcttcagaatgattggcctttataagagagcccaaatgctttttttcttatacaatatattgtgtctctttggctttatcagtggttacagagctttgtggtaatctcaaaatatcaacaccatccatcctggggaagtattttctccagcaaaaggagaaaaagcaagacagaaacaatcataaggccatgtgaggttgactttctccgggagcactttgataaatacgttcttttatttaatgtctttgtgccttcatttcctcatctggtaaatggtaattaaaagtacttaactcatagcattattgtaaggactaaataaaatagaaccacaatggctggaacatattaagcagttagtattagctatgacaataaaagtaatcatatatttaaagaataactctttaaaaatatataaaaacaaagtccttaagatgggttgtttgatgttctcaagttagtataaaattgagaatcttaggaacagatgatctgattcaaaattctatgatcttatgccctattatacttaagaacactgaattattggtaaaatattctaatactatggacaaacaccctatagtttacatgcgtatttgactaactagtccatggtggaagtaaaactaaacatgattctaaatataaatgtgtctaggaggggaaaatttatccaattagatgatttaaagaattattggaagagttgaaataaaaattacttgtagagttaagagtagaacttatgaagaaagattaaaggatgatttaccttagagttgaggtctaacaaaagtttagtaaaaatcttactctggatatatggacacattatatatttaaaacttcaaaattatattttgtaggacaaaaactttatttcaagaacaacttaaagtgggatatccatgggaagggataggcacaatgttttctttcttaagccagtagtaagatgagtgtttttatactaactaaactttttatgccagcaattatttatttaaaacacttacaatattgctattataagtaataaatcttaaaaactattaatatattttcaagttgtacaagaatttaatctttttgattatttttgtttttgttgttattaagttaattagattttttaaatacagagataaatatcacatatttatgttcctttatgtgctttttggaattgtgaaaaataaaaaagactctgagggctcccaaactggcaatgttgtggagaaaagacaggatattataatgccacgaataacaatgtccataaaaagtatgaataacaagagaaaatgtgctccttacaatgctcagtaaaatgaaaaaatgcaaacaaaaacatccaatattatgtatatagctgcttttttaaattgtgcataagataattagaaatgatgataaaatgttaaaaggttttatttctgttgcaatattagtgattaaaaaatttttcttctcttatttcttttctaaatgttaaataatacctagctattaaatcacttttatatttggaaatcatgtatcttttaaaatatattatttgcatcctccttattttcacttaatacatatagtttaagttgttctcagacaccagaatattaggagaataattcaaaatgcaaagaaaggactcgagaagttacagttgaaaccatggctaggccaaaacaaaaataagaaaaatagtattaacagatagcatttattgactgcctattatatactacacatcataaatattgcatacatatttttaaaaatactattaatttaatttgcataaatattttatgtttgtttaccattattttcattttctgtgacttggtttaaataaattaatgaatgcaatgtgctcagaaaactgcctggacacctgataaatttcatgtaattgttttctagcagtagcagcatcaatcattttacaattgatgaagttgagatttacaaaggttaaataagttgttcaaattctagtttatttaaccatagagtctagatctatgtccttaaacacagtgataaaaacagtaaactaaaaaaagcatataatatatatacatacatatttcaattataatagaacatacatttgttgtgagaatgagtgccttaaaataaatattatctgaatattaagcatattttcccaacagtaccctggcaccaggagcctcgttctgtgcaagcactcctactcaccagctctgtgaccttagacaagttgtttaaatttcctagacctgagtttcttttctaaaaatgaggaggttaaaaaagaacaaatactagcaggaactaacatttttgaacccttattgtgtgccaagtattacgctaaattaatgatcacaactgtcctatgagccaacaatattgataatcatcccttttttgaaatgtggtaatttaggcatagggaacttgcctcatttccacagcaaatagtgatggaccagcaaataagataacacctggtatttaaactcaagtgtatctgaattcaatgtctgcactctttcttgatgactactcagagctcccactgttagaaatctcagatctgtcccttccagatctgaaacttaatgaatattgttaattactgatggagcataaatatgtgaaaaaggagtttaacttcttcccccagccaatcaatatctcactatttttgctgttataaagacaccattaatgaagtctttgattagcacctaatttccaaagtactgtactcaatattttgtaagaaaacttaaaagcctagtccaagtgcatagatcttggcacatagtgagtgttcatttaataattaatttatcaggcagtcttacacttacaaagtgcattaactgattattcaattgaccatcataacaaaacattagtacagaaagtgcaggtacagccatctgtcatcttgcaaatgaggatctgtgtatttataaaggttaagtgagctgcccaaggtcatcccaaagtggaaaataaaatatggtttccagagcaattccaagattaatactctttccactgaccttgaaaccaaattgtttttattttataaaagtatcagaaacaaagttttacatattcaagctgaattacttcagcattaatttctgctctttcttaggaatggttaaaatttatttcatttgcctatgattagaaattgtgtacaatctacaaaactccactcatgtccactttagtatttcacatataaaatgttgaatttttaaatttttcttttttgtgtttctaaaggacatttttttatccagctaatggctcaagtgttatactctcttcagcctcttcaaatttttaaattgtatgcattaattttccatgtattgatagattgaaggtaaaagcaaaagtatgtaacaggttttgaagctaggagaaaaatttccagccaaacatactcaaattactaatctctaaagtcacaaataatgcagtctcctttaaaaaaaggtacattccaaatacgtgaaagcaattcaatccaaacatcaattatattgattattcaaaagaagagaaaaagtaaaaagctaagactcagaaaaaaacaggaataaaaataagattgagaatttcaaaaaagagacagatatcaagaaatatttgagattatgaatcaattcagtcaaagatgttaaatttataccaagaaaaatgtagcatggttaaaatataaaaagtgtttatttaagtctttccagagttccacacagataattagataattattatgaggtcgaatagtcctaaaaataaattgtttcactgttaaataagccagagaatatcttaattacttattatggattttataggttattgtttaaagttgtatgctatatctgtcagtgtggaagatttaaaatctcactcttttataaaaaaagatattaatggtgtgcaactcagacttcgtatctcaaagggaacagtactgatgatcttcatactgaatcagagccattcaatagcataaacaaaaaggaattacttactacaccatctacggtgctctaaatgatataaaataacattatattaaacaaaaacacgacacaattttttttacttcaaccaaagctatccatacatattctattcatctcttgccatatagataactttgtgagtttctgcttacatatgaacatattctttctatgaggggaaatgttctatttttatgcagccatggctttgtatatatctgagaaaactcatgtgctagcaagtgcttccagttcacttttttcacagtatctaccacagagctgagtacagagtatctacccaataaatatttgtagactaatgaataaaataatttatttgtggtagtatcacatggacctcaagctctatttggtgtgctttcatggactatatatttgcattgaaatgcaaatatctgtatttcattgaaaattatattttgtccaaaaatttctctcaaaacacaagttttaggttatttttataagttcaaaatcttgtcaaattaaagtactaccaagccctcaaatccttttttttttttttttgggagggaatgtattaggtataagaggctttgctgttatcaattttatataaatacaaagtcgtataatattgcaagcttgatttttagcatatgtattttaataaaacctatagttttaacataatatataatggaatctatagttatttacatgtttttgtatcctctgagcaaaaaattaatatcagttattctcatccaaattataagaaatgaatgaatgtattgagaattgaaaacagtagaattcaattttattacaaataatataaccagagagtataatatttctgtcttcatgtatttcctgttttatgaaatcatttccataaaaacatattgtcaacatcatttgtagcttttattatactttaagttctagagtacatgtgcactaattccataaaagtgaaattaaactgacatgtacttcagtatgtcttacttaacttttatattttttcagcttctcaaaggataaaatgctatcatatgtaattcagtaatatatttttcattaacaaaaatggcactctaactttattagggaaagtcaaggattgaaatcctaacccaaatctagtgaaggtcaaatatatgacagttgaaaagagggtatataaccaagcaatatgaagacagtttctgaagaaatcattaaaaatacaaataattatatttttattgttcttgaggaaaggaatgcagaaatatcttttcattctatttttattctatctacttttcattgcagctatgaatgagactactgactttcaggtagtattaataatatattaataacagcacgaaaatccaccttgatatcactttatagaataaaggaactttgacaatttctgaaaataaacacttcataaataagttatatattcattgttataattggaactacaacaatctggcagagcatttaatttagttttcaaactaatgcagcaattaaatgtaatctgcctatttcctagggtccatgttattttttttggttttaaactcaggcccatggcatatctcaatgtactacaacttgtttctaataacgaagtttctagttggagaagtaaaggcacataagcatgtccaatttgaaatttacaaagaagttatctatctactgcttgtacctatttttttcactataaaatttgcttatgcttgttgaaaatgtaaaaaagaattcaaaagtacttgaagtatagcgttaagtttccatctttaatcccctctagtttcatctcctacacccactcacatcaaagataaccatgttcacagctctggaactgtccaggccttgctcatcttaccacagcataatgcctctcaacatatatcaccaattggaggaggaaagcgtggggtgtatttgtacttatgccaaagcaataagcaccctacctttttcgtgcaattgcaaacttatcttctaaagtgaaaattagtaagagtctaaaattcactacatatattggtaactttcctgaccaattctccactccattatgttgtcaattataactgggcaatgatgaattgaaacatcatttatggtttttttcttcaaggccaagataaggcaagacaggttcttggcaggaaaatttagaagatacttactgaatgttttctgtgtgccaagcttgatactaagtgctttatatttagttttcaaaacaatcttatagggcaggtatttttatctcaatttgataatgaggaaattaaatgtacttgtccaaagtccctcaactggcaagactattaatcagtatttgtactcaaatttgccccaaagtccctcaactagcaagactattaatcagtatttgtactcaaatttgcctgggttcatcctactacttaaatgagaattatttcaaagcgtcaaaaaacagattccaaagatatttttgcaacaaactgtgaatttaagttattgcactgtaggttacttatttcattaaactacttttataatacttttaaaagcacactctcatatattatcatactatattttacccatagtatttggtccaagcttctcattctcaaaagaagtctaaattttagacttgagtatatatcaaatgaaattattcatataatttttgggacactcagagaatagtggaagactgccactttatatatttaaacttgtggcttattacacgtagtgcacatgtggtgcactatgacttgtttatatagccaaaaagttatcttgtaaatggcacaaatgccttatattttatgtgcttgtacctgtatgtctctgtgtatgtgtgggggggagttagaaatgttaatttgttaaatgtaaatgtttaatgtcaaaataataatatttttggcatttatttcttagtgtactacattgggatattaaaaattaaaatgctcccagcctgtctttatcattgataaaaactaggactagaaactcgcctgacctccttgtctagtatccactccattgtcctatcctgatgcgtataccatttaccaaaattataccaattatttacataattggtataattgttcaatgagtaacctacagtgcaataacttaaattcacagtttgttgcaaatatatccttggaatctgatttttcaccctttgaaataattctcatttaagtagtaggatgaacccaggcaaatttgagtacaaatactgattaatagtcttgctagttgagggactttggacaagtaaatttaatttccttattatcaaattgagataaaaatacctgccctaaaagacagttgttcaatgcttctatcatttcctaccatgggtgccttgaaatttttgctcgttttaaatgagacctaaaacccatcactccagaaaatataaattaaatgacattgtcacagaataataaattcatgtgtatcggttacatttctctagaaaagtatttaggaataacatgaaaaagagaagtagagtaagtcacttttaaacttttaattttttagcttcaagacacagaagaaatatattttaaatggtaacccacaggctatttatggctatgtgtaactaaggtgaaatttacaaaatacctaacctatgatgtaatacatgttgatatttatattttactctagtctattttaatgtattctctattaaattctgatttcaaccctctaaattggttttacaaataacttatgagttatccactatttgaaaaaaaagaaaaacaccgactagataatctctttctttagaatctcattgtgtgtgtgtgtgtgtgtgtgtgtgtgaaaatcaatgtgtaaatgtaacattgggctgaaatcacattacaaagtcccctaaaataaatgtatttgactattacacctcttgccaaaacatctcctcaattcaacatttgaatgtttgataaatctttctggagtatttgcaaatgtgccaaaatgagatttcataacccacaaccctgatgaattccaaagaattgcctttcatatataaggctacattatttaacaatatatcctccagctcttaaaaaattctgtaccatattgcttcctgctattattggcatctgaaggacagagtgtggagcctgtgatggagatgtaaatagaaataaccaagcacagtctgtgcttttcatcagactcacaaagaggtcttctgtgaggtcaacttgttaccacaggcctcctccttaatttgttttcttttcactataattaacccattccatgggaacaaggaaaggtgctgctttcaaagctagataaaaagacacaaaaatatgctcaaaagatactctcagtggagaaacaagtagggttttttgtttcccagggaaggaaaaagaaccaggtgatgtccatcctacttttccttggagccacacctactccaatgtaaaggaatgagatttagatttgtttcaaaggagttggctttggatctaaatccttgctctgccactaactttagctgcagaaaaaaatcactctttacttgtccattctactaaaatggttaccttatcagactgtgttatgaaataaacaaactaaccaaatttaaaatatagtatatatggtcaggcgcggtggctcacgtctgtgatcccagcactttggaagtccaaggcaggcagatcatgaggtcaggagatcaagaacaccctgactaacatggtgaaaccccctctctactaaaaatacaaaaaattagctgggcacggtggcacgcacctgtaatcccagctactcgggagactcaggcaggagagttgcttgaacctgggaggcggaggttgcagtgagccgagatcgcgccactgcactccagcctgggcgacaaactgagactccgtttcaaaataaaaaaaaaatatatatatatatataaagtgattatgtttcaactcacaaagtagtaagatcccaatggcaactgattgtcaacattgggaattatcagaagaacaaatagtccaacatcgttctttcctcaactgaggtttaagtccattttccagagtcctccaagtgattgtccattgcaggtttgtgcacaaggagttacagagaactaactcactatctcctaagagtggcaattcctttattgaacagttctgctaataaacaaaaaaaaaattttttaaattaaaccatactttgttactcttgtattttagtaattagctgtctctgtcaactgctggccagagtgaacctagctcttttccacctgaatttacaaatatctaaataaacaaaatatgtaaatatatcagatacctaaaggtagcagtcagggccctgctgtgtcttgtcttctctctactaaatttattctgaggatatgatttcaaattgcataaccatttgggctactctcctttgaacaggccctgcttggttgcatttgatattggtcttgccctgtcacccaggctgagtgcagtggtgcaaacttcgctcacttcagcctcaacctcttgtcctcaagtgatcctctgccacagtctcccaaggagctgggtgcacaccaccatgtctagctaatttttctttttctttctttttttttactttttgtagagatagagccttattatgttgcccaccctatgtccaacatttaatgtagcccagctgtagtctgcagaagtttgagcatagcaagtcacagaaacttagtcttgaaagaaatctgtacgaacattctttgtagtgcctgtttgtataaaaaaaaaagatgcaaggagttgaagtgactttcttggagtcacagagtaaaatccttagttctcatgtcagttatcttacttttagcacagttagtaattttaacttatttttccaactccaagatagcattaatgtaatcatcatattttatctattcactatcaaattaacaggataatgaccagacttacagaagagcctgcaaaaacaaaaacaaaacaaaacaaaaacgcttccagataaaaagagatgaggaaaaatgataaataagaaagaaagacaatgtcggttgtcgtagctcacacctgtaattccagcacttcaggaggccaaggcaggtgggagtttgagaccagcctgagaaacacaataaggcctcatctctacaaaaaattaaaaaataaaaattattcacacgtggtcacatgtgcttgtagtcccagatacttgggaggctgaaccaggaggatcgtttgagaccaagaggttgagactgcagtgatctatgaccatgccactcttcttcagcctgggcaatagagagagaccctgtctcaaagaataaaaaagagagagagaaagggagagagacaaagaaaagggaaggaggataggaaggtaagaagttataaaggaaggtaggaaggaaagagaaggaggatggaagaaaaggaggagggaaggaagaaaaaaaattctcaagatactccctctagagttttgaggatctctattcttgctttctcttacatgcttgcttagtttatgttgggcagaatttactgtgcataatttgcttttcattctgtgttttatgtgtttcaagctgtacactggaacataaacatctcacagcatgccctctcattccccagcattccttatgcagaagcaacttcaacagaagtggctgaacactataaacctagaagctaaaaggttttaatgacatctggaataagagtgaccaagggaaaacatgcatgtgtgcagctgccatccataagatgggtaaatactgaatacctgataggctacatcctaagagatgatcttcacatttaggtaagcatctgattatttagaactgtggaagtgtccacaattgcacatcaccagagatatttctgcattatgggggagcagtgcagtgaaatccgctgaaaacaaaattccttttaactcagcttagtcatcctggacatggagtatttgtgggagttttctagtattttcagcaattgatgacagcaatggtgcctaagagagaggaaggtgggaagctatcccaggcattagtctcttataggtgagccagagtctaagccagaaattgtatcattagaaatgaatctgaatatagaagaaacactgcccaaaccacatgtggatatgtcagcaagctctatatttttctctgaaagaggcaataataactctcttagaaattatttactgagtccatagactgttccttctggaagggaagaggagggaatgcccctctaaacgctctttccagagctatctgtatttttttcactgctagcaatgaagtttctgacagtgatatatgaatatgaaaaactgtttctttacaattagagttgcccactgtgtttcccagattacggatccagatccaacttactaaagaattcccctaaaagtttctgcatcttctaaattgtatatattgttaagtcagtggtaaccaatataattatacaatcaatccataatttcaaagatttctggggatctcatgttttcagaatttttgtggagcaaaggaaaatctttcagagtttccgcaaaccttcgatacgacccaggaaaaggagcacttcatctaatttacagatcaagagcaaattgatcatgctatttctcaaggctaatttttatttttattttttgagacagttttgcttttgtcacccaggctggagtgcaatggcatgatcttggctcactgcaacctccacctcccaggttcaagcaattctcctgtgaaggctaatttttagatgaattatttcatttgtggtcccttctactatttcagatagttattaacactttcagccaattgtttagaaatattggtgccactgagataaagggagagtgaataaaacaatgcaatggagaggtagaaaaatggcaaaaaggaacctgactaataatctccagcaatgttttggaaaccaagttctggacagaaatcttgagttccaagacacaactctgcaactaattatctgacaagcaaggtagagttatgtgacctttctattttagtttccttaaccgtaaaatacagaagattaaatgctggcctgagacacagtgttaacattctatggaatgaatagtaatttatgtgtctttattattaccatgatcatcccaaaatttgttttaactctcagcactgttcaattcctggagaaacaaaataaagtccttttaaaaattattcagtagcttccacagtaccatttattatttttccaaggtaaattgtcttgtgtaatgataattagtagaaatgctgagatgggaaaagtgtactcccagtttttagaagtcaaacaagcatatagactatgaatcatactgaagttccttcaatcaaagctggattgttatcacatttttaagtaaataactgatgggaagtcatattataacctgaaattgcaatctctaggttaacctgaagaccatatcttcaataatgtatgctaccagtacaatttattggtacatttttctccccagaacatcactgatttgttttttgctgtaacaaattaacattcctgtcattagacagaaataataaattcaagaaccagtgaaaacagaaaatgaagtgtagcgtgaacaggattttacaattaatcaagggagtcattttgacacctcatttttataaagaagcaaaactaaaaacttacaagtgcctgctatttatccacatactatatagtcataaatggtgagctacgtacttcactaacacaaattcctctattcagcaaatagtctttgagcacatattatatgatgggcactctaataggccctgtggatatgctgtagattttcaactaaagtcaggaaaactagtgaagtgtgaaatcttgtcaatcacccaggaagtacaatataaaatttttttttgtataaaacacaatacaataattacttttcttaatgaagttgaactagatcaaggtaaagaatataataatgaaatatattcaagcgcttaactatttgaaacattcagactttaagggaactatcacatctctagccacagaagtataggcaaagcattttaaatattctttcttgcccacagcatatattctgttttatttcatattcgaatttcaagaatattaatgcatgttatttttttttttttgcttttgaagtttaagcaatagtatctgatttgggagaagggaagttagagactaaagtgagagggatgagtatgtttatactggactccatcctgaaggcattttttattgctaacaataatagtcagctgggtaatgttgagggtttcagctgggctcaattatgtgattgcaattagctgtgggttggaaaggcaattttgttgatctgcattgcacgctctcacatgtttgaggtcaactggtctaagatgcactcatttggaaaacctgggtgctctcatacttcacagggtgacaatagggttccaacacaaactaggaagaaagttctcacgtcaaccaagtgctattggtcaaagtgtcagaaggccagtgctacatgaaagtaaaagggaattatcaagtcaaaagcaaatgatgtgaatacagaagcaccattagtagacgtcatcaatgcaatctgccacactgctaaatgggcaagcaccatcaatcctgtgtcatcgtgggcacatgtatcaaggtttgcaaaagtactaaggcaaaggaccctttacatttccttagtgcagagagagttcttactccattaaaagaagtgattttacttttcttctgagtcattgcatattcctttcctctgcccagttgaagagctagtttgatctgctctttaaaaaatgctttcttttttcttcttcttctgttttatactataaatctctttgcctagaagttccaggcataatttctgtgtaatagaacaagccacagtaaatacccagtcacacagcctactaaagccataaatcacaggaaatagcaagtgtaagagattaacatcgaagctgaaacccagttttccttgtacactcctctggaattctgtgatgacatacactttcttgaaggaacatcttgtggtacccgtgacacagtacggttaggtttaagtataaaacacataggcaattaggagaaaaaatgttttttgaaaataggaccacatcttttcacagaccttaatggttcatgtgaaagcatttggaaatttccatactcttcaagaaagagaatattgatggaacaaaggagaataattataagaatatgaagataaattatcaagtactgggattaattctcctaatgctagagaaaatcacctcaacccagtgagaggaagagactggatgataactgacactatcatttcatggaagatcccaccaagactttctgaaaaaccaagtggggaggaaaaaaaaaaaaaagcatgaccttagagagttcccacagtacccaacaaagctgtatcctgtttgactctcacttttctgatcctggaggtgagtttcaccttgtgaaaattcctaccatgccattcttgtactgataaatcataagacttaacactacataacctcgttattcacatacttgcttgggatcaaagcaagataaatatttcttgacacaaccacataaacagtaagcaaacgagtatttcttccaacctttgaatgtccaattccaaggtttgttctctcctgaatcctggtggtacaacctaaatattttgcctgaatttggcattgcaatttctattgtcttttgttttcccacaaatagaatgttttcatgtaattgttatatttcagtaggtaaattatgtatttaatatagagcttaaagtgtatgtatataaaaattatgcataaaatattccacctcatttcttaacttagatttcttctcagaagcagcaactcttagtagttttgctcttctctgagaacaattctatgaagatccaatcaaattgtttgcataaaaaccccttttagaaaaaataaaatgttatatatacagaaatgccccttgttttattcacctaagatgatcttggaaattataatcattacctagtagaatgtctcacttattttaatagctaaatgataatgcattgtttgaatacatcataacttattttattaggttattagattgttattggggtaaatttaggataaaacaacagtttaaactagtaaaagccaaaggtcatgactaagagtttcacttggggcacaattgaattagcacttgccacaccgtgaccaagcactgatcttctgaagctagaagggagtccctaataaaatgcatgatttatttgatgcaaaccaaaacatacctttacaattggccttttcaagcacatttttactttctcacctagtcatattttcttatgcttttcactgaaagccatccctgctaattttcaccaattgtcagtattcttcttgttaaatttcaattgtcaaattccatttccttctgtaagattcccaccatgacccccataaccacagaggaggaggtgatttttttctccatcaatttcctttagagtcagatttgtaacattgtgtcattttgaattatgattatgtaagtatttgtgcatgcctcatctcctttgccagattgcaatcccactgaagtctgtgatatagaaaacaaagggctatcattcacaggacggtcagagagccttgcatatgtatttgtgcataatatgtgttgcataaatatattcctaacctctgaagtggggttagtaacttaattccacattttaccagaccgaaatatttggactatattgatatgttaatgcagaattttaagaatctcaacaaatacaataattcgatgatttataaaaagtattttgtatcttcttcagtattctatagtgtttaatatacacatttttttttttctagaagaagagctgcataacaagcgagtctgcccatttgggtcacaacctctgtaggtcaaaacaaattttttccaaacagccatggtcaagaactaatgatttttaaaacaccataaaaaacaaagggctacttattattaactattataaaacatcagtcagatttttctttcctcactattcttggagcacaaagaagcaataaattttaaaacaaacatgttgaattatttaaaattatacttctcaaatatgttctatacaaggataaaattaatttattcttatctccattttggatttgaccatgaattcttctgaaaaaatagctgtaagaccaaactttttggtaattctctataacaacacacctaggttagaactggctactaccttcaatcctatgtgtatttatgtgtaccttgctttaactattagaaacaataggcacctagaacaatcgcgaaatgacaaaaatatgaggtgttcaatgaagatatagagacttgaaaacctctagtaatgaatataaaaaatcattagagtagaagtataatatagcatcagtatagcagaagtaaataatgtaattcacaatgaaaacaaaattatatttcaccaaatattggccacatacacccttctgtagtttaagtctttgtctctctagatatatgccatccagtctgttcttatagtactggtataactcggacaattcaaaatatccaaaataattaggaatagtttactcttcccaaacctgaaattgtaactgttgagtgcataataatatatactcgatgtatgcaaaggaaacttaccttctgtgtgcacggctgatacataggtccagttgtacctcttcactatgtccaccatggcccttgcctgctgagcatctgaaggcacaaccctcatgaaatatttgaacagagtcttgtcactcagatccatgctggttgctgagtaagcaatctgaggtatgttgaaaagctggagcaaattctggacctgaatggctacagaactggagccaggcccaatgacccctactatgggcttcttggagcggaaggaagaggaggagccatccacacagcgtaccaagccttcttcctcttctgaagaaatgagggaatctcttatgaactcaatgctctgctctagggccacagccgaatgccagcaggagtcccttatctcacagcccagtgtgatgttgggcaagagtgtggggtctgaattgatcctttccagggtatgcagcatggcctccactctctgaatgccatactgttcacggaccgccccacacttcctctcatgaactttgtccacagtaggctggtgatgaacagaaaagagagctccaataatgatgtcacccggcatgtgagccaccaccctcctctcactggactgtgcactcccacggacatcttctttcaaaagtaagactgacaggatcaacagaaggaccattttaggaaaggagttcaagccaataaagatagcatggtggggaaaattcaggagggttctgatagctacgaacaagcgatgtcctacgttgagtcgcaaatcaagaaattagccagcaattcagatgtattttctaaaggaccattttgtccccatgtaccatttagttagatgatccatgtggtcatgatcttctaaacctgaaaaaaaaaaaataacatgggtctttaacaaacataaatgcaactagtttggggaagttctataatccatgttagcagagaaaatattttgatgatgcagataacgaagaaaaaaaattcaaaaacgtttctgactttcctttgtctgcttcctttgtgatttgatgaagcagctgatgtagcttcttgaccctgccttgcttagattaatagtctttttttgttcacctgcaatacacaaaactaaatcttgagtgtggcaggcagaactgtattgtaatctcaggcagagatgacagagcatcctagaagcaaaactacgccatgaacagaaaacttcaagaagtatgcaccccagaatattaaacattggtgatctcttggtaatgaaagtgtggataactgttgttaaattttcattaggctttcttttcttttgaaatctttagccttgagcatgtaattaattatgcaattacaaaaataaaattatcttttcaaaaatacctcacatattctctctccaaatacaatgtcaagcaagttgaataatcttctcaggaataaataagtattgtctaattaatgtggaagatataataaaaacaaatgaagaaaggtgggtgtttcatgttaaataaactgtagaagagaaaggaaaaggttggggaattatagagtacaacatcccccaaataggctgcaaggaagagtcaaattagcaccaatttttagagaaaagaatattcacatttcaatccctgttcttatattaagaagtattagtaaactgtttaacctcttggtaccagaatttgctcacctgaaaaatggggatactatgtgctaggctgtcccttatgggaatcaatacaagatatcaacgaaataaacgctttacaagttaaaaagtgctatatatattcaaaacaacatcttgttgttattaaattttcaagggcattttgtggctaggtcatgaagacagaaaattctctggcaacctacttggtcctccagagagtcttcaaagtaattacacagtcttgcaatacatttcacagtaatcagtcctctagccctgatccagaaaaacattccacatcactaaggctcaaaggctaaaaggatgtatgtttggaactattctgccaggtagaaatttagtatagctatgaatgtcatcatctatttcaatttaaattcctgggaagaaagaaattttgtcccaaattttccatggcaaattctagcataatttgtaaaagagaattgacaaattagtgatttgatcacttaggggaattgtgtaagagacttactttgttatcaactttgccagccaaggatctcaaattattttaaagtgactaactttctaagcaccaactttcaaatacaggtgatgtttcttcaggaatgtatgtaaatatcgcacttttacaagaatactaatggtttcaaaggtcatcaaatctacaaaaagttaagtccagacacaaaatgaatgtaacttgaatcatgtttctaatcactcctaccatcattttcactatttccttctactgtttcctatggcaacagagaaagtcttcctatgtacagtgacaaaagctaaactttttaatatttcatcaaataaccagatgttccagaataactagacatttgggaatatatagaaaaaaatagttttggtacaaaagttggcattgtagatacagaggaagaaatgaagactgttagatttttcattggcaagtcatttgaatattaccaaacctttctttcactttccttagacccaagcttaaaataattattctcatggtcatgtgaattctgctgcagacaaaaagaaatatctaaagttaaagaaagcacaatttcttattaaatcagaatgttagcgagtgaacaaataacaaaacacgactcattttttatgtaagaacatcaaagtgatatgagagacctggtgtcctgtcaggctcgtgtggctgaaatatcaatcccatgcattttattcatttaagttgttttatgaaacccctacatattgagatacagtatacatgttaaaacactaagatattgccttttgaaggtatgcgaagtttgttacttatttaacaaaaaattattaactattcagtgaaagagactagtgtaacaaagaactgtaataatatacattggtaagtatcattattatctttcattgagcacctaacatgccccatctattcattaactcacttaacaaatatttatggtatgtatatgctataattctgtcctgggaattgaatattcaagtatgagcaaaatatacaagctccctatacttgtgggccttacatatttgtattctaaagggtaactttagctgaaacctggtgaatacaaagaaaaataaagatcaaatggtatttctgtctttaggtctttgaggaatcaccacgctgacttccacaatgattgaactaatttatactcccactgcagaaattctattcaaccctgcaatcccattactggctatatacccaaaggaatataaatcattccattataaagacacatgctcattgcaacattactcacaatagcaaaaacataaaatcaacttaaatgcccatcagtgatagactggataaagaaaatgtggtacatatacaccacggaatactatacagccataaaaaatgagatcatgttttctgcatggacatggatggagctggaggccattaaccttagcaagttaacacagggacagaaaaccaaatactgcaggttctcacatgtaaatcagaggtgaatgatgagaacacatgtatacatagtggggaacaacatactctggggcctgctggagggtgggaggagacagaggatcaggaaagataaccggtgaatacttgacttcatacatgggtgatgaaataatacgtacaacaaatccccatgacaccagtttatgtaacaaacctgcacatgtgcccctgaatttttaattttaaatacttaaaattaaagttaaaaaaagaaaagatagtcccagctactcgggaggctgaagcaggagaatggcgtgaacccgagaggcagggcttgcagtgagtggagattgcgccactgcactccagcctgggcggcagagagactccgtctcacaaaaaagaaaaagaaaaatatacagaagaatgaaataaaggcagtcacgtaaaaaatatgcctacaacatgaagaacatgggaggcatgatgatacaagctgaagatggaaaggcaagaaaggtccaggccatgcaggatgttgcaggctcttataaaaaaaatttaatgttggccaggcgcggtggctcacgcctgtaatcccagcactttgggaggccgaggcgggcagttcacttgaggtcaggctttcaagaccagcctgaccaacatggtgaaaccccgtctctaccaaaaagagaaaaattagctggatgtggtggtgcacgcctgtaatcccagctactcaggaggctgaggcaggagaatcgcttgaacctgggaggaggaggatgcagtgaaccaagattgtgccactgcactccagcctgggtgaaagagtgatactccgtctcaagaaaagataataataataatgttaattacaacagaaagccattgaggagatttaagcaaatgactggaacaattcaatcttagaaaggattattctggctgctcattttcctggataatcaattgaagaaatcttataaagaaacctgtaataatctagcaagaaatgatggtgacttctctatgattggcgacagtagatattgagaaaagtggtcacagtcagatatattttccaagttgaatcaactgtatttgctgatagactagatgtgagtagtaaggtagagagaggaatcagggtctactcctagcttctagtttgacagcctagtgcattttgacagcattaatacagatagggtagactagcacataaacacgtgaggggcagaagaaaattaatgatcttcttttgcaaatgcaaaatttgagatgccttggagatatccatgtaaagatgtcaaacaggaaagtgaatatgtaaggttggactcaggggagagttttggtttagacatgcaaattgagggtcatcaatatataaaatatttagaatgcatgaaatcgcctggagaggaagtataaatattgcaaaggtacagctaaaaaataagctctgctgaggggccagattttggaaaagccagctatgaaaaggagtcaacccaaaaagtaagataaagtgagagtaaatgacgtcatagagggcaaaaaagaatgttttaggtactttatttttaaagacatatgcaagacttatatatttcagagaaaaacgtatccgattcacatggaagatactatattccatgtacattctatacactgaagatttctgacacattggctatgtttttgagtgtgtctgtatgtgtggcatatgtataccaagaatccttataacaactctaaaatgtaggtacaggttgaacaacccctacacaaaatgcttaggaccaaaattcagatacagaatctttcagattttggaatagttacattacacttacttactgcttgagcgttccaaatcctaaaatgtgaaattggaaatattccaataagaatttcctttgagtgtcacatgagtactcaaacatgctgcaattttggaggatttcagatttttaatttttgaatttgggatgtttgaactgtattattttattaccttcattttacaaatgatgtaatgggttttgataagttaaaaactagctgatcacttagaaaataatggagctagaatttatgtctatgcctgttgactttataacacattgttttaactatttcttgctgcctcacagccccttcctaccaaaaaaatgaaagatactaccaatgtccatgaaaacaagaagggccacccagacacaatttgaacatccaagagatatagaatcttacaggagttgcctttcaaactatacattaacgagcattccagggaaaagatgattcagctcatagagacacagaaggtacagtgtgtaggttatctagtacaagtgtatttacattgcctgaatatccaccccaaattatagctcatcagattatgaagcctaatctgatgaggcagatattagctatgaacttagatacctggaatacacttttaaaaaaatcatgacatagaaatgcgaaagaactgtgccattactcagattattataaggttaaatagaaagtcatcttacgtgcaatcaaaatacaagaaatacatagagtataaattccaaatagacctgaaaggaatacatcaaatctatcagcatcactcatgtgttttctataaatgtttattcagtagcacacccttctatgccccaaggatccagttatggacaaaatagatataaagtcacatcattatggagcctgtattcgaagagggtttgcgagacaagaaacaaaataaatacgtaaaatattgtgtgctacatggtgctgagtgtttaaaagcaaaaaaaaaaaaacaaaatgcagtgaagcagtatagaaagtgccagagatataggaaattttgagtaatgtggccaaagaagcataaactgaaaaaataacatttgagtaaatagctaaaagaattaaaggaatgagtcatgcagatctctagagaaacaacattccaggtaaaggataaagcaaatacaaagcccctaagacagacttaatatttagtgtgctgaggagtagcaaacagcctcatgtggctgtagaaaagttaaaatgcagagaaaggaagacatggagaacaagaggtaatgtggtgatgttgaacctgtttggactttaaaagactttggccttaacatttcatgagaacgtttttctgagaggattccaacagcggaggaacacattctacctaaaattttaacaagaataagggcacgaaggcagaaaatgaagagaaaattaggaaacttgcactaacttaggtgagagagatgatagtcgttggattggagatacggtaagtacaagtggtgagaactgctgggattctgaatatattttgaaggtagagtgaacaaattggctattagagctgacgtaggatgttggagaaagagaaaaatcaatgaggacgccaagattttcagcccgaacacaaaaaggatagagtcgcatcggctgtggtggagaatgcggcggcaaggatgtggatggaaacaacaaaacaacataagttcaattttgatatatcaagttgcacatactagaaactcaagaagagatcattgaatgagcaggcagatgtagggggctgaattctgaagagaggtctgaacaggagataaaatgtgaaggtgtgagtatacagaagtcctttttgtaagccatgaaactggattaaatcaccgaggaagtggaaagagaaaagaatctagtgccagaggttgtgccccagggaattccaaggttcaatggtaaggaataatcagcaaaggagactgaacgattttttgaatagaaacttccttttgtgaagtgaggagagagaagcagtaaaatgtgaagtattcatgttgtatcatgcagaaataaagggacggtatgctttgattttctcaagaaatattatgggtgggcatgtatgcatacataaagactggaaacatatacattgacattaatagagtgttctctgggtagtaaaaatatagtacttttaattttattttcttcatctgtgttttctaaatttataaatatagtaatacaacatatttgctaatcattagtatttttaatttggaactgagggatatgctttctaaatttctgcaactttctcccttgagaccttatctccttccatccattcctccttgggagcctattagtcaagttaggctcttgtccaagtatacactgttttattccaatggctttgcacatgctgcttctgatccctgatatgcagttgttccaattgtcttcatagcagagttgttaagagcatgggcttggagtccaatgacctgaattggaatcctggcacagccatttattggcggtgtgtccttaggcatttagcctctctgagcctcatgcctttattggcaattggagtgacagcagtacctaccccaaagagttttagtgagtattgaataagctaatatttaaaaatagtcccttcctaaattattaccatatccctcacctggcagtgtttgctctatcctccaagctcacatggcaatttatttatactttcttatagtattcattaccaagctaatattgtaggatgtttaaggaaaatagcatcacaaaactagagagggccctggagatgattccatttaactgagatccatggaaagcaaatgattcatagcagacctgggacttgaattcaacaaaatgtcactcaaaacacaattttaatcatagtttacaacttggtatcagctcttatataattttcaaagcttataatattttattttttatttaaataaaattttaatatgaaatctctctcataatatatttttattttctttgtataatataaatatctttcatataagttcatttggatgatggggacaattataacaacaattaaaatatacagagggcatatcatgtgttgttcactttgctaagtatctcacatgaaatgacatttagttgtcatacaaactgtaaaataagttatgtatgcacattttacagagaaaagaactgaggctcagagagatacagaggcttggcccagattcccaagcaagtgggtagtaccagagccaagagtcacatttagaacatttatttaattttatcagttgcatggcattcaattatatgtgtgtaccaatatttaattattccttattgttagatattaaggttatttatagatttgtcttaatatcataaacaatgttgcattttgcttgcttttgaaagtatctttgtagcacaattatttaaagatgatatttctggcataaatgtttctcctggtttacaactgatgaatgtagaatataaaagatgatatcaacttcactccaagatctgtctcattaacatcatcaattctgagaactatccaatattctttctgtgaggatctactctctcttgcttctatataagttcctgagtaaggccatttctccttgtggtgagatttctcctgtgcaacgtcaccacaagattcattcattattttaacaagtgtctagtaaaagaaaagatgaagaaaaataccacaatactttattttcagcgtaaagagccttttttcattcttgatctcacatctacctaaaaataatacttctagaaatgtctaagaacaccaatttcttatagtaggaaacaaattctcaagtaaaataaattattttctttaggttatagcttttagatggtggggataatatgtcagtagaaataaaggggcaggtttatcctgtagataatggggaggcattaattcttgtaatgataaaaaagcttttaaaatgttatgatctacagtctaataatatggtgacatttaattcactaaaaagtgggtaaatgtattaatagtttgattatatagtatattagttcaagtacctattttcagaagtatgctttactcagtgttatatttgtgggtccttagcagagtaaattaattactagcacattatagaaaacaatagacatattttaaatacatacaaaagtatttcacatcaggtaaccacacactctcatattatatcctaaatgatatgaaaaagagatattgatggataaactttgccataaattgcaatctacactatataatcagattcacagctcacattgtcctttattttcaacaatcttctaaaatactgaccatctttctggcacagatgtctcttatataacttaatctccacacaagcaaatcacacagctcaggacataaacactaaaatgatttcttctgcctgatcagtggcctcatcacaaacagtcagggctgtcaatattgcatatgccatcaatgcatctgatatatttttctgaaaacaagtgcataccacagataagagacagcctgaggtgcaatgatacagagaaccctgtagtctgaggaaagctccattgtcattactatctcaatcacacatttgtgaccctgtaaacaagaaaatgcagcatccccactgtttagccccacaaaatataggccatattttaactgaaaccccctcaacaaaaaaagggccataaaacactattgtacaaagatgaaatctgtaattttatccattaattaaaaagttctggcagttcaatagagctcactaaatcattgtaaatcatttaaacaagtggtttagcagtctatgaagacctggaacagccttctgcagcaaagcaataaacatgatgcaatccactgttaactagtctcagtttaattataaagcagggattttagacttttacacatcctgtagccttcagctgatttcttgttattaagggtatacctctgaagactgtaaatcattatttatatattacattacatatcattaaatgcttgagaccgtggttttacatttctataacatgatctccacttacttattaatacataatatttataaagtgccttctttctgttaaataatgtataataattatttaatgtaagactcacaataaccctgtaaggtaggtataattactacctatgttactacctctagaaatcgaagtttagaggtcaagaatcttctccaaagtatcaaacctacaataaatggcagaaccaggacatgaatccaactatatttggctccaaagcccaaacttaataaacaaataatgaggtctccccacaaaaaaaaacaagtgaattggttattcaaacctcatgcattgattgcaaagcattttggagattctgctttccattaaattcttatgtaacgtacataaattcatcagaaagcatacaaacaaatcaagtaaatataggaaactctgtttcctagcatcatttagataagggtttctcaacctgagcactattgacattttggagtggataatcttttgttgtgggcggatgttgtctgtgcactgttggttgtttagcagcacccctggcttctgttcactagacgacaatgccatcccctcccagctctgataaacaaatacgtcctcagatattagcaaatgtcgcctgtatgtcaaagtcacttccagttgaaaaacactaatttacatgaaagttaatcctggcaagatcgacatagtcatgaaagaagagcatacctaagagccaatcatctggacccatcagtcttagaaattctctacctgaaacttccaaataatgctaaggagagacggttgaaataggcttgccttactcaatgtttatgcagttatttgtctgtattatcttgttgaaaaggtagaaatttcaatttgagaaagacaaatttaagctttaagagtcaaggttgatattaccttacattaaatatgcatagttctaagtatcacaaattacaagaaatgaatgtgaggagagtatcctacgatatacttcccgaattcaaaggctgttcttgataggaaatgcaaagtttattataattttaacaagactgcaacaataacgataactttataaattaatttacatgttgatttttcattttatttatttttaaacaaatgatataatagtgtattatttacttctatgtctttgaataattctacattactatgcatttagacaaattgtttttcaaaaaatatttttgattattcttctgtaaaatataatgaatgtaagaaggttgcattattaaagtgctcactattatcactgtgattacaagttttcattttcctcagaacatttatactcaaaattttaaaacccatggcctgaaccagcattattgtgaacaactaatcattagagaatttttcttgaatctgatatatttgcaagaccaatagaataatatatacagaaaatatatattttgcatctaagtctttcttttacacttcttctacagtctgactaaaaaaggagatatttgagatagcaattacgtattattttgatttctgattatcttcaagcatttgcatgtttattttaaaatattcttgaatatatgagaaaagtagatatttgcacattcctttgcagaggaagggatgctgactcaaaattagtagaattcaaaaaaattgatatatgtttgtaagctgtaggtcagtatcataaaagtttggaaatcagatgatcctagatttaaataccggctttgtcacctttgtttgtactgtgggacattggacaagttatttaatctatgttagtattatgttttatcattaaagtcataaaataaagataagacacaatccatagggcagttgaacattaaatgtaataacataggaaacgcagaaaactcgacatccaaaggcctgggtaggattgatagtttgcactctgttcactatgggtcagatactttatttttttaatttatttttctctttatgtcttctaaaaaaaatgggatacatgtgcagaatgtgcaggtttgttacatatgtctatgtgtgccatggtggttttccttctgcacctattgctttttttctaacttgtgcaatttattcatcatattcactccatgccatgtactgctataacccatcccccaatttgaaaatagtgaaactaaggtacataaatttaagtaacttgcctaaggtcacacaagtagtaagccacaaagctgagattcaaacccaggcaatttgaagccagagcctgtacttccaacatactacaactcactggaaaccacagtaaaataatcccataatgtttattgtttagccacaccacagagtaaagcagctcaaaacaaaggaaacacggtaaattttagtgccaaacaaatcaaatctctctcttttgcgtatgtatgtatatatatttccattatttttgccttttacatatatggtaaatggtatatatatatatatatatacacacacacacacacacacatatatatgaatgaaatatatgtttccttattttgaaaatgggggatgggttatggcagtacatgttattgaataagtataatgaattaattgcacaaataaaaataaagtgacccacagtgaacactgcataaactatgcactgttctttgacagtagaataaaaaacgtagtttttataactgaaaaggaaaaacaaataatgccttgtattgttgatatgataattaaataaaataacatacctactgcttagcatgatgcctgacgtgcttaataaatagtagttattagagcagggatgagtctgcaccaagacttttgcctgatggcccttctgacaaaagttatatatagttaaaagatgattcagaaaggtaaaatatagattttcatctcctatgaatttaaaggaaatgaaagcaaacctatgccttaatgttttttagaaacacattttaaacaactaagataaaggaatatcaagatactatctcatttacaaataattgaaaattcaaaactaaaaattgaagtttcttttcttgggttatataaatacatcatgcactaaaaatatttcttttgatgctcatgtcttcttatgttctcctaagcttcactcactgactaaaatgactagaattaatatttctctgaatatgaatataacacataacacatatttctaaagtgcagaatcttcctgctttgtaataatacatcttcaatatatccaacctctaaaccagccaaatcagctttatcatataacatatatgtatatcaacatatataaaaagtagtatctaatattttataaagttggtttatacatgatctatctatctatatcgagatacacataaaagtacctcacatgtacgtatacataatacaataagaatgtgtaagataaaacatttgtatatagctctgtcttcatcccatgaggatagaaaacctgggataaaattggtatacaaataaatacaatatttttaatgatcaacctcatctcacattttctacttgtagtaccacctacattttattgacacttaatttagtttctctaaccaaaatgatcattctgtaaaagacaatatagtaagactcctataaaatattaaatgggttttggaaagaaataagaaaagtagaattattaaaatgctttagtcacaaaagtgagcacctttgatgaggtaagtcattttaacatgaaacacaacaatgttaataatcagagccaaaattaaaaatggtatgtagttaatcaagtattcccaaagtctggatagtttttgctggttggttataatagatatgagtgaatttttcaatttccccctgggtgtttgtcatcatgtccataaggtatactataaagtgatagtaaaggcctgtgtctacctatggaagaaaagtgaaaaacttggattattcagataccaactccctctcccaaatcatctcgacacatcctttcataagtgaacattgaagagtttgggctttttgtgagtgtgtagcccgcagccaaaacattcccgtgtgatagcacaaacctctaggggtgcaattaaaatatctagattgtatattttgtcatgtggagtgtaaatgactagagaaagctttttctcttaagagaagctgttatttaggaagtgctatgtacatttttctcctaagaaacttgaaagatctgtccagagtgctgacaagatttcacagggagaaggctggaaatttgacgggacgcacactactaacccaatgagttcaggacgcagtattttcaagtcctaaaccaatggcatgtttaaatggaaataaacatgcataaaggacagaaatagccacaattgattcttacatgtgtaattacattgaggtaactgagaaattaaaggaggaaactccctgcactccataaagaaaacagcataaagcacacctaacaagaggtagcatacctgaacactccacagctgacagtagaatgtcatgcaactaagacttccacagaaaacccctgcttatgtcccactggaggaagggctgcacgtagtcctggtcaatgcacctttggctgcttcaaatggccagtgcccaggattagagacacaaattagctctagctttgtcctgagaaactctgaacaataaaatcccatgtagcgaatggagaagaaggtgaaaaggagaagctgccttctcactggtctgtatcaatttcttattgaaaaagtaaagtattggagaccctatcttggttactcgatgttaacagtccagctaaggcagcatcaagattgtgtctaaataagcacaagcgcttgttatcctctcctaaatttcccttccacacagcaactcctctgaaaggaaatgagggcagctgtaaattcgagtaccaggtgaaagagccctccaggtggacctgtcacttccctggagaggtcctaatgcacgttgggctcgggccaccggctagcctccgcactcacgggcctgccctgggttttcttccctaagtcgctgtagcctgggcttcctccttggcatgccgctcatgcccccgccgtgggataactagcaggctttgtgttcgaggggaaagataaatccatggaagaggaaagagcgggagggctcaggctggtgttcaaagagaggcaatatagcctgagtgaaagagatgtgctttcagcaccacccgctgtcccccctcttcctgcagcaggcgccacgaagcggcccctaacagatctattgaaaagcaattctctgtcctcttttcctctccacctttgcttctcacaattccgagccctcgggtggtttgtgggagcacactctgcattcgaaaccacgcgcacctggccttagagagcgggaactcggatgcgaaggcatgcagaatctccttttcaacccttgcagctcttccctccttcaccccattgctcgcgcctttttccccaacaggtttaattaaggctgttcgcaaatggaacagacttgaatcttgtcggctttggccacccctgctccacccgcgtccccctcccccaaaccacactatgagctactcagcaagcctatagatcctaaatccttctctggccaggggacacttgggcacacagacacttagcaagcttacccccctgttggctgcgctgcgagcagtgagactcggtctagctagccccccgaaaagttgggccacggggatcagcagggcagagccggcctctccagtccccggcttcccccccaagatgatctcaagctcattccctccgctcagcgtgcgcagaacagccgagct

SEQ ID NO: 2306 - DNA, 543498 bp, Homo sapiens
atcatattataggttttttaatttttttgaaaagtaactggcttcacaaacaccaagtacaacatgatttagacaactgagaaacaggcaagtatattttgaagtgctaaaataaaacatatttatacaagtacaaagcaaaacaatgctgataaaaatgttaaactttatgaaaaaaaatcatttgcagttcacatcaaaataatttaacattctctattattttaatagtacaagctgccacaacagagaaagaacagatacacgcacacaattttaaaaccaaatcagttataagtgcagaaaaaagtaagtacaagcacttttagcccacacaaatcttttaggattggcaccatctttctaaaacatctataatctatatagatttctaattacaacaccatcagcagctgccattgatttctagaaatacacacaatatacatagtatatttgttcacattgggaagatcagtgaaattcaaccaactattttatacatgcctcattcttcaatagacagtagagactctcccaggcctcagaccctcttcaaagtgaattctgacttgtctttatgctttcactgatctgtattttttcacagtataaaattgtaaatggtaactatagagattctgacagcttgagggttattaataagctgttgctaaatgtgaactcacataatacctttgaagtctccaaaacatgtacattttactgggagactagcataggaaatgcttttgttttttgttattcttaaaaagagcatttaattcctggcttggaagtcacagaactgcagcagagctattatacaattcatttacagtcagaaatagctcctagtcttcctgatcacttgctggtaacagcagtagtttgggaaagatagttactttcaaggattagcacgtttggggatttgctttttttccttgcttcagtcaaatctcttataatttttctttccatactccctttctgttccccatccctagcccagaaagacggttcttcccaatccagatatgttcttcttaggctgcccccactcctttcccaaaatggaaggatgagtggactgcttagattagtcagtataacttggttaaaccacgtcttcttctttccatcctgggacatatctctcatttagggtcactttgctgagccttagcatatccccttccttttagtcatgctggtcccgactgaattatcactgggcaccaggaacagattgttttgaaggaaattcaatgagaatgtacccaaatgaattgtgaagttcatatcctatagccctagaatgaatattcagttctctttgtactgtagagttattacttggaacctggtattagaattggcaaagagacagagttagcatcattccaaaataaaagatctcaagaatgcattactaataatcttatgtccaacatacaatgtattcaatggagtggcaaaagttatagaaatacagagaaaaatatatcttgtccttttctaattggataaatcatttttattattacagttgattatgatagcatgtggaagtatcagatggcaatttacttgcattaaatttaatttctgatgaagttttttataaggtagtgtgctttttaagagatatgttactaaaaaaatagaaaatgaatttgaccatgaacaaagtttaaacatgttcttcaactggtctagagtgaaacgtattgtacttgagaataaaatgaaaatcaacataaggattttataaaacaaattttaaaatgtagagcatatcaagaaaggtttttaatacctaagaagtcaagataggaatcctcaggtgaatgccatccttttgatgaggatccaaagggtattaacacctcaaaagatttccatttgtttttcagatagaggcagacatttgcttttaatgaaaccatgaaacttagctagatttcacttacattttaaaagcctcggtgtaatatttgggatcagggtgctgtgatgatgttattttcaaatctagcatgggaggttcgatttcttttaaattaatactttagtacattaatgttagcttttaatgttttgtattgggaggtttgacttaaagttgcaagtaagaacaaatagcagaaaagaaaactcaagcagaatatttattagaattttttaaagtgaagaatgataaattatgccaatggactgacttctatttctcagtttattttctgttaagtagatgtgaaataaaaaaaaatacttaccaaagtaaggatattgagctaaaagaaaaagttttatttattattctctctgccaaaatatacttctgcctcacagcacatatttttcataaggctatcttaagtataaggctgggtcaactgaactttaaatttataggacacctcctccatttattactatccttatttaaaaatcaaaacatttggtacctgaggatagctgcaatgggaggaagaaagagatgacagtggattcaggtcttgaactatgaattctacctatttgagactatcaaagcacacttgtttctgttatactctaaatctcttttctgtagttttaaaaagtgacagtatgaagtgcacaaaatcatattaatcattattttaaaaaagaaaataagaattgctttgcctctttttggaatggctaagaaagactgtgtggttaatattcattaaggttcctcttttttagtattttgtattgctttgaaaaatctacatttgtcatagttcatagctgccctgtttaagcagccaagaatagttaaaatcactgctcactggcatagctaaatctccactaagctgacttgacacagttaaaattttcagtgtattaagattgtgttaatcctttcaacaacagtctctcaaatcatgacaatgtcttcatggggtctatggaccactcttccagtggtgggactcgaaaagaacaaaggagctctttgtgcatcaggttctcaaaataaaggaatgaagaagccccaatgcatattttaatattttagttggcaatgcaaacgcaacagcattcctaaagagtggccatgtttcttgaaagagatagccaggctggagctcaagaatgatttttataaagagaatttccagctacaatgcaccccagtgagggaattacaaaacagtattccagaaaatattttttttgctactccagtattgattggcaacatggtgaaatagtcaagaaatcttccactggttttcttggttaatggaggtgaatctgaaataagtaggtggaatccccgatgcaggcttttggaagagtatttcacaacccaattggagaggaaaatctctggtagaagccctacgtagtacattagcgcagcactcactatccagtagtgtgttatgcatgggacacattcacaacgcctccgtaaatactggacccaagttactgcttttcaaggtctttacaggaaagaaaaaacaaaaagaaagaaaaaagaaagaaaaaagttgatgttttggtcccagattttgagtttgttagaaaatgtacattcatgtttggtgaatcaaagactcttctgggaaaagaattaaagtaaacaaataaaactttttacagttgcttattaactatgctcttcaccctccgttacgctgtttcacacgcactgcttccctagagcaaagcacttggtatggaactgtttgaagagacgccttgtcagccctcaaagatatcagccgtgtttcttaaaagcccatgttttctaaggccactagaagaaaatctgccaaaagatttgtcgtcggtttcttcgtcggttgtcatgagatagcactactgatctcgtgtttccattaaggggtgcccttggcatcttccccctgggccgtaaccaggcgactatgcttgccattgtgtgtgtgtgaacacggggggctccgctccgcacgcgcaggccggcgtgctttccagggacattcacaacgacgaggagctctgagtgtaatctcttatgataagagtgtcatatttgggagacgacgggatacagagggccgactcggacactggcgagttgggggttgtgctccccgagtccaccgagtctctgaagggggacggcggggtgagagccaccagctcctccaggtctggcttggcggccgcagcctcgggaccggccgcggggctctcccgggccgcgtccccagccgcctgcgcccctgccgcgggctgcgcgcctcccgtgacttcgatggccggcagaggctggatttcggcaaaggtcgtcatggtcgtgggcaactggatctctttggggatcaggtaggacgagcagagcggggcgccgacgccggggctgggggccgcggtggacagcatcatggagttgagctcgctgatgttggccgtgaagcgggtgaccacactgctgatctgctccatgagggagccctgcgaggagctgctgcgcgccacaggctccgagtgcagcgacggcacatcgtcgtccgtgcggctggccgagcccgcgcggtggctcagcgtgctgatgggcgacggtgagcgcggccgcgcgggcgccgggaagtgctcctcagcctcggccacatcatacagcgccttggggccggcgtctggggactcgggcccgcctgggccggcgcctgcgcagcccgcaccgcccgtggcccccacgcccccagcgctcccgcctgcgccagcgccagcgcccaggccacggctctccgtgctcttggggaagggcttgatgacggccgtttggttggggttttctttcttgttgatgtggatggacaggcgctgccacaggtgctgcccccggctgctcttctcattctgggcccacgtgacggattttccattggaactgaggagagaagggagaggaaaggtgactcagcgaggtgcccagggggcttggatgccgcttccccaatggtggttgctcatgggccccggactggggaggacttttctcattctttcaggaaacacagcatcaaaaggacatcatggaaagagaccttggaagtggctttcctttgcttgttttgagttaaagactgctttctatatcagggcttcagtttatcataatcgtgaaaatgtgtcaaaggggatgcttgtcaggatgaaggagtgtttattaggattctgcgggagttctgagcccacctgtgagtgcagcagcacacagatgcaagggcttgcagtgtcccggctgtgtgcacaagtgcctggtacaggacaggggcttcctagagttagtggcctctgaaggaaaacattaccactaggacccaaactcaccaacaatcatcagagaggagggaaggggtaagagagtcagggattaccaggaggtagtcagtggttccagttccgcctttattctggaagttggtatatatataactagggttttctgtctgaacccctgattttgaacatagtgttacttaggctgccttacctgctggaaaataaaaatttaatgaacacacatttctaatgagagcttctttacttcacagaaattcacctcacaaatgtattttgagttctgtacttgaataacagttcaatgagtgagagtgctgtataatgccttcggcacttagcagagtgatctcaaattaggatcctggtgaatattgagggactgacaagttttttgaaggcctttctctctctttctcctttgcacttccaccatggggtctgaaagccactctcaagatgtgattggtgcctcagcctcagcgccctagtacctctccttaccactaaaagctgacacaatagcttctgaagctgcagacgttctttcagaaactttacaaaggtcagagaatgtggcctgacactcaagattttttttttattttttgttttttagacggagttttgctcttgttgcccaggctgaagtgcagtggcgccatctcagctcactgcaccctcggcctctgggattcaagcgaatctcctgcctcagcttcctgagaagctgggattgtaggcatgcgccaccacgcccagctaattttgtatttttagtagatacggggtttcaccatgttggtaagactgttctagaactgctgacctcaagtgatcaacctgcctcagcctcctaaagtgttgggattacaggcgtgagccactgcgtctggccaggaatgttatatgaagagattctggtgtagtttcccatcacaaagtaatccaagatctctgttactagggggtctgttattttcagtcaagacagctctgttctaggggctgtgaccaacagatagccttgagcagcctgactacaaaagaagttgaagactacagttttatcatcacagcctatggttattaaactaaattctgtgtaagactcatctagggcatttgtcaaagatataagatgtgaccccaggagagtctgattgtctggattggcttccaaggatctatgcttttgacaagcattctgttcttctgctcccaaagtaaatctgaagcactttgtttctcagattctttcacaatctgagaaactctggcagaaagccatccttttcttctaaatccccatcactccccttgggcccccttgctggagggctggcttgcctttgaggggctggggcgtgtacctcatttggaatccaccagccttgaggctgcctgactggccctgcaggatccactctgtctgagaaacccactcccttggtaacagactgccatttctgcatcccctttaatgacatgctttttgcctctttccacactgcttcccatttctttatctgttcctttctacttcatggtctttctttctccgctctttcctgtgaaatttctttccatgtaatctacccaatatattgtagtctcatgtccttcagaatcctggaatatgagcttcttccaccccactctgcccttcctggaaaggatgaatgaaccattttcaggtttggaggttgctgtgcatccatagtagcagagggggcactgccaaacagttggtgttcctttctagtagtttcaggatttatttttcaattttgcattagcctgacttacgtgtattacaattctttttcccaggtgtccactagcttctggaacatggcagagaagaaatgggccagtttatttacgagatttgattgggaggatggttgccaactacaccctttctcctatcagaaggataagaaacaggtgtttcgaaaggtacaagtattatttcaggtcactaagtccccttttaatacaaagcatggacttgaaatcaggagactaattggatttattccaccaacttttaccttagggacactcttgctcctagtacagagaggttttgcaaacactagcttttaaaaagtttctctctctctctctcgaatgcctttagttgaacatgatggaacataactttggatgttagcagtaacagtctttggaatcacctgtagccatgccccaaaacatgatagcatgttgcaaaacctctaggtgagtgtgtgatgaggaaaccatcctaatcaaccaattctgtacaaagtattgacatctttttcctggctgtgcctttggttacagtgcccatggccataagggagaaagagcaccagaccatctgaataacgtgaaagtggacacaggaaacaccagacacccagagaaatggagtccaaatgtgagtacttcatttcattcttttgaacatgaaagcttttttttccctgaagtaaatgagaactcttaagaaaaaaaacaaaagaaactccctactcacgacattattctgtttattagtagaaagtacattctatgaagacacagatcttatctatctttttcagtgacactcagcatgatcttaataagcatttgatggatgaataggatttttaagttaacagggccactgtggggtgtcatggaaggtgcaatagaatagagatcctaaaatccggttcttattctggatctgccatcccagatacttggaaaagaataatctttttaagcctcggtaagaagcagacagtgtctcatttggttaaggttgttttgagattacatgagacaatgtaggtgaaaagagctggtaaagagaaggtgtctaaggatgttcagtttttatattttatgtgaatacagcatttcagaaaataaaaagtatactcaatgccattttgaaccctggtttaaggaacagagaattcagtgcaaagtaaaatatttggtaagccataaaacctttcaggttctttctcttttacctgacctggagttccatgatccgtggcctcttcacaccctaaactatctccttgggtgatcacctctaccccattaaattccaaattaacctttttcctcaaatgctttctcattgtgctacatcctctcttcctttttgcttaactgtatcctctttttttcttattttattttaccttaattgtcttgtcttaaagaaagctttcctgaccctgctaggctagattcctatggcacctgcattcaggcatatcataactctttgctatatgtctatctcacctgcttgatgggacattatgaaggcacagatggagggtttgctctttcctatatgcccagtagtacccatgcattgtttagaacatggtagtgctcagtaatatttttgggccaatgattgagtagataaaatgcagtttatttttaaaatttatactgaattgttttcctgttagaattaagtttttaaaataattcagtgttaatgaaactctattttgccttatggatctacttttacttcttatatacctccctttaatcaatagtactcaatgtctacatatttaaaaaatttcattaaatatgaaaatacaaagcttgatatctgccatgaaaatcacaaaataattccttctttataactcatatctgtcttagtaaaattgctcagtggtgaaatctcatcgaggcagtagtgatagtggaaagaaaggacccagattctcagtccaggatctgactcagaatgatgttgagcaaatcacttgccacctttgagcttctttctttattggaaaaaaagaaaagaaaagaaaagaaataaacctcccttgcccaccttgcatgatgtctgggaaaaaacaaaaggataatacatatgagggtactttatagagcatagcccttctgcaaatgcaaggggttattcattaacattaaaccttctattcagttgagctaagatgttgtatttattatttaggctgagatttttttttcagcatccatgttatatgtttgtccttgggggctgaagtaagaaaaatgaaagggaacttttctttacccatctatggcacgtcaccttccctcactgaatattttggacattagaaaaggagagggaaagaagaatgaaggagaaagggacaagatgaaatgatctgccacatctgaggagggggccaaaagtaacgtcttgctctcttccaggcaccatttaacccttttgcaaaatataatatgatgccatctaatgttctctctgttataattatttgctctttatttctgaaaaacaaaaagcagcatatcaataatgttatttgaggattaagttttttgtttatttgtttcattagtttttgtttacattttgggtctgccaaaatgacactttctatctttattctcagaggtttatttttcctgtttttcccttccatatcagaaacttagcaaatttattcattttcaagcagggtctgaatgtcatgtcaatgacctcacccagtttctctattcctctgctcaaacctgcagatattagagtattctgccatggtacaccatcattaggaagcaaacattaatagaggaaaaaaaagtttgaccatcaaaaaagtcaatggaatttataattcaatacaggaatacagtgttaaggtattcacaagtgtgacaaaaatgaggatggaaaggaatgtactgacatgaaaactactgtggaaaaaaaaagactttgggtttttcttatcaggattagaaaaattcagagaaaaagttgttcactgaggaaagaagtttcaaggaaggatttgcaaataaagtggatattaacgaggccttaaagcttggggatgttaaaatagcatggataagcaaatctcaattaatacatgtattgcatatatggaaaggaaactaattctacatgtctaatcccaactcctccaacagccctaagtgacgtggattttcacctctctcttaagtagcagtggttacatgtttccacaataattcccccagagaatctttcttaccaggcatttaatccctaataaattcctggtgggaggagaatcactcgatcctctcttaactagtctttggtttaacagcaacaggaagccttttcagaagctacatgttcattcacggtgggttattaaagtgcttaatggtactagtacagtcgctacttcccctgagtcctcataaggagcaagcaccttaacaaaggagaatatgacacgggagcatatgccaagcattggaattgtgttgagtcatcacagatatttccttctcaaatcaaactatttattttgatccacaattctgttacctggactcagcttcaaaactaaactactctaactggtattagttggtaaagtgatacaaaattacagctaggtacaaggaatgagctctggtgttctgcagcattgtagggtgaatatagttaactataatttgttgtatagtttcaagaagctagaataaaggattttgaatgttcacaacacaaagaaatgataaatgtttgtggtcatcgctatgctaattaccctgattttgtcattacacttggtatacatgtaaggaagcattccgtatcctataaatgtgtacaattattaagtgtcaactaaaaataaatttaaaaaaatctcactaaactactcttcatcctgacatttaagttctaggtcttagctgagatgttttaacagcgattagcaagaattttagatttttgtacttctttttcaaaacaggaaatgatttttaccagcaattactataaagctcaattataatttagtaaatagagaacaaagccagacatagctgttttgtgtctagaagctgctgcagtcaggaagactttgtggaggaattcagcttgatttaaaccttgaataaaacatggaattgggattggtggcaaagaagaggagaatcctggaatggtaatagtttccattttaatagaacttttcagctcacaaggtgttttcacctatggcatcatattttaccttcataacagctgtctaggataggatttatcagatagttttttaattacttatttacaagtctgttcctgcactaaacctagagcattgcaagggcagatgctacatgtatctcctgtgcttaatatggtgtctggtgcagagtagtgcagaggagtgttagtgaaataaagtgaactatatgatcttgaatgtttgatattgacaggtattattaaccttcactatagatatgagaaatgaggcttatggaacttaactaagtcgaccaagtcaaagtaaatggcaggacagtgccccaaatctgatgctaaatccagagtcattcccattgtctgtgtactgagtgccaagatacacacaggaaccaaggggctaacaagacatacccctgtggagcatccaagatggcagtgccccaggttttgcccataaaataacctgataaattctaaagctctgcatcaacattgctgagataaatcctgagggactgtaagataaaagttgtcccaggatgtttagaatggttgctgggaaaataattcctgtttaggcaaaagactcctttctgtcttacagcacctcagctgaagcttgtgacttaaatctgatgtacgaaggggatgttagttatgaggcttgaatcctgggtgcagattcaccaccaatatgtttattgtcagtgaagtctcttggtttaagaaggaagtttcttgattatcctggtttttttttttaattggataaaatgggcatatgccttatatctgtcagttctagtcccatttcctgtggaattcttgggatgctgagcactgtatctttgtactattaaaacaaatttaaatctaccatggacaccattattttgcttaatgtcaatcttgttgcttcctcaaagacaatagaaatctttcctttctctggacccttaaaaattaattgggtaggttaattaagatatttccttaatatttccagattaagatattttgttaatatttccagattaagatatttccttaatatttctagattaattgtgtacccaattaattggttacacaaacatacagctattcctgattaatgtttacttttttcttacaattgtaatatattggcttctgtacacacacacacacacacacacacacacacacacgtttctgatcccctcatttacattcttttaatctttaaaaatatctgtgcatatgtgttgtcatatgcatgctattaaattgactacaaaactgaggattagagaggttcaaagaacttgtgtgcataaaagtagaaaatacttaaggtataaacatcttggtaaagccaagatttttgataagctactgattcttggagaatggaagacagtgtgtgtaaaagcttagtgtgctttgaaggcatgtgagacacagtggcaaaaaaagttttaaaaaatgattaataataaataacatttgtgttgaagaatcagttcaaactaactcattaaacatgggattagataaaatgattgatttaaattttcagagcactcagctttgctgagtaactttcgtctacatttcaatattaccattatacataatgggaatatgccaataagattagttggacacaattcccaaattttatccatatctttaggtgagactaaaagtagaaagtattccttaaaattcacttccctctcaagagcatacaagtttggacttgatgactacatgtcaggcggttcccattttggcttggcattttccattagaaatgattttgatttcctttttccttttttacagaaaattacaagctagcaaatctattgtttcagataaaatatatgcatatatattgtatataactactgaattatctacaaaaactatacatttgtacataaatgtgtgcatatagatgtgtgtgtacatatatatgtctatttacaaaatgtttttcacaggcaagaacagcagcctcacacaaggctttgaccagctcctcctttttttcagtaaaaagagtattagataagatgagaattgagcagaaactgagatgagagagtcatagaattcaagtattcctgttacatttctgtattacattttttacaggctaagaaaagagactgttcaatttaataatataaaaaatagaatatgttcaatttaataatataaaaatagaatatactctgagtagttagtaattctttcagaaaaataagaaaagataattagaaatctggttaatatttgtggtatttaataaagctagtaaatttcaattccagtcaccaaacattagttaatctttttggtttttgctggtcttataaggacttatctggaaaaatgcttataataagatttcaaggattactataagctactcatcatacataattttgatgctatgttttttgattaattttttataaaattaattggtaaatggtatagaaagtaagaatgacaatagatggttcatgaataaatggtttcagggtcaaataaatggtttcagggtcaaataagttaaacaaattaaactaatttctgatgaatttatcaattttttatgtaactattcactgagaatttccaagaagggcatatgagcatatatgttggctccattattgttagccatactgtcatccctgcttccctccaatcctgaccaccatccaaatcttggccttattattggtatcacagatttaaaattttaatgtagactattgctcttgcaggttccatcagagcgagttttatttctttattaagattgtaatttcctttagggtggagattattttatacttccccaaacaccccatggtccctaaaacaatgctacctacatacacaaaaattatccaggcacttttattgagtggttgattgactcaatagacttctcacactgttgagtactgaagacgtaaaagtgaaccatacatttttgttttgtggccttaaaaacctcaagtttaatgagaagacacaggcaactagataatatgcaatatcggatgtaaaggtaaaatacattagaattatgaagttgggcagagtttagctagactaagacttttagacacatcaaggaggaatggacattagagttgggttttgaaacctgagtaggtttgctaggtggagcagcaatgggagttccttctccctggaagaagatggatagaaagagaaatgaaggataatccagatagaaacacagcatgtcttaagtcttaagatgtgctgttgtagaaaatagttagcatgtttggagacttgtatatctgggatgtctggaaaggagaacatatgtacagaagcagaaggaatgatggtcaaatagttaggttagggttagtttatgaagaaccttgtattctgagtgcatgagttcgtatttttttcctgggtggctgataacatagtgattatagtatgtgaattgcagaatcagactgagttgggctctaatatgggctttaccaattttttaaggaagattaagtgagcaatcatgcagataaagcatttgacacagtgtctcatgtatctaagtactcaataaatgttggctgcttttataggtaaacatgggagaacatgaattttaaaacagggaaattatatcattgaatttattcttttgttatcattagattttgttttacttacttttccagaattgatttttgagcaaacaaccatggtggcagggtagagaaagacaagacaaaacagtaaatacgtaaaaaacaacctttctaaactgggtggccttggatagtaagagcacatgctaaaatttattgaatgcctattgtgtgtcaggcaatatgctaagtgctgtacttatataattccatttatttttcacagcatcacagtaagataagtgctataatataatctgacgtttatagaaaattgatattaaagagttgaaatgacactccgtggtcacacactggctagtgccagaaccagatattgaagttcctttgattttagatttttcatgagattgctctactgtgtatgttattttatttccctgatcctcattttcctgtgtgtagcatgggaagaaaaaaaattataccttctttatatgttcttgggagaacttaatgcagaacctccatgaagggacttagtatagtgtgggatacatggtaatcatagcaatgttactaattcttcttcttcttattttttagaatatgttagaatattaatatggaattgattttggagataaataaagtgaaggttattgtagaaattctaatctattctcaaaaaccagctggcttctattgtctgtactggaaaggcagaatctttctcttatctatggagtttaaattatataactacatgccttacactttctgaatactcagtttacatctgttattatgtgttattctattacttttaattctgtttgtactggtacaaactatagcatgtggtaagaaatgggcacttaatctgaggcataaactcccctgtgttagaggagttttatattgcattgcagttatctgtttttctgcctgtttctcaatacactgcagattttcaagggcattagtcatatcttggtcatccatttatctctagagtcttttgagtccttggttcataataggtgcttaataaatgagctttacctgaaggaagaaataattgaatgaatgaaaggcaatcctaacacaagacattgtatttggggctatctgaggtcctactcatttaacaaggactattatgacatgactcttaccaaattctccaagcctttattaaacatatgtacctactaaaattagatgctgcatatcacaggagaaaatcagttactcaactaattgaaagttaatagtttgcatagcttatatcacaaaagagtaataataataattctctttttgttcaaaaataaccccatcccaccctccttccttctggcactggagggggactagagagctgtctatttcatttgactgacggagcccttcctcaaagagagactaggaggctcagaatgtctttgtttctccttcgtggcctacatcatgagcacatcagaaagcagattccagccaggagtggtggctcacgcctgtaatcccagctttttgggaggcctaggtgggtggatcacaaggtcaagagttcgagactagcctggccaacatagtgaaaccccgtctctactaaaaatacaaaaaattagccgggcgtggtggcgggcatctgtaatcccagctactcaggagtctgaggcaggagaatcgcttgaacctgggaggcagaagttgcagtgagccaagatcgcaccattgcactccagcctgggtgacattgcagactctgactgagaaaaaagcaagcaagcagattccaagtactccaatgccatgcccctgctgacacagaagataataacattcagtgttgaggtttcagtcattcagtcattcctgaggctggaccatcttgctagcaactcacatggtaacagtgtttagagaatttcagttcttagagccacctccctgtttaggactctcttttacttctcctgcaatcaggaggattctgctctgaatcacacttagactgtccactgtgaaaatatgaaaagatgacaagttatactatattcagacatgaggttaaaaaaaaagcctcttcacataaagggaaaacagcaacatatttcaggaagctagtgtgctatggggacatgttatattctcattcctttcccagcatgagggttgagggaggaaggcagaagtaaaggagcatctgtctaaggccctgctaatgttacagatcagaaaatagtgctctgctctgcttcaactgtaaacactgtgaaatgctttctttccccaccaggcaacttggctctgggataatcatcctaggcatgaattcatagagtactgtccattctacagcttcattatacaaaacaggcaaatgagatgcagagtgacactctcggttttctgtggttgtttgagctccccttaacccctccctggaactagctattcaataatggccacagaggagtcccagatgtttgcagagtaaatgtgatgcttggctttgactcctggaagcaatagggggtggagtagggatgaattacaaagaaaggccttattggttgacgctaaaagtacctataaaagtctcacatacatagagttaacctttcttcagcccttctattccattcctgagtaagcaaatttggattaactacttcaaccccttacttagaaacggcttccatcacagttatctcctctctgacagctttctcttaatgttcattttaaacttatttctcctggataaatatgtgtgtgcaggcatgtgtgtctgtatttatgtgaacaaatgtgaagttggaaaaaaagataccaagaccttgtgaattttgacctctcttttcatatgtctctaggccttttctactccctaagggaaagcttaagcatggcaggtctctcttctctctctctctctctcgctctctctctctctctgtgtgtgtgtgtgtgtgtgtgtgtgtgtgtgtgtgtgtgtcagtttttatatagtgctaaagaaatgagaaggaagagatactaggaagggaagatcatttgttcccaattaactctgcttatctgtgtggctgaggtggatgatctaacacaattgtatttatagtagtatgcattattcccctctcctccaccaggatatatcagtgtaataagcctttctattatcttggctatatccaaacaagtgaggaaacaaaaattaaatgatatcttgcggttgtagagaaactcagaccattcttgctggagatacatcaagtgaatacctttgtagatctggacctgacccaaggaagcctggtatgtttatctgggatctcctactctctgtgtactaccctctctgtccctttcccctcattctcaattaagacagccttgagcaaatttaatttctgtgatgatcagatctaaagctctaagtattgactaaacactgctaagagcatcgaattgcataattgagaccaaatgcttgccacaaacagctccatgtcatctcctacatgaatggattactctaaaatatcagttcatgcactggcttctttgagatgacctaggaaacttgttacatgacagattcctaagttgtattgcccaatattttgcctcagtctgtttgatagtcagctaagtttgccaggtttgggaactccagttttagacctcaaattagaagtcactctgggaagagcccttgagcactcatttggtgaagtcactttaaccttgtccagcttactctggtgctgtttgcctaattttcaaggatatgaattatgctactttgttatatctaagtggaaggaaaataggagccccaatagcattctgttgagtcacttccacaaaatgatcctctgagactcattttgcagatgcactgagatccaaagatagctgtataaagggattgtaggcataaggccatcagatacaccaaagtacacacatatatgcctacacatgtacacacactatcattgccttgtctctgagaaccatagacaaagttggccaagcccttggccaggactgttgtgaatgattgctcaaactgtatgctgaacagttctgggcaccattttcatagactgcaatatgaatagtccaccagcagttgtgcaatatggtgggccttggaaaaatgtagttattattttgaaaataggaaggagcccaccactgaggaagcaaacaaaatgtttgtggtgaaatttcaacaggattatcttcttgttatgcaattaggtctcaagctctgctctcagcacatggacatgcatatgcacatactctacttattgaatttttccttttctctaatccaggatgatttgcaaaagttttccttccatacctctacaccacagatggattgagaaatgtcacaacaaattagaagtgaagagttaagtcatggcaagtgactcctcaactcaaggctccttcaacattctggaactgtttaatgtcaatcttgactttgtctccagggcccttttcttttcttttttctttttctttctttctttctttctttctttttttttttttttttttttgagacagttttcactctcgttgcccaggttggagtgcaatggcatgttatcaactcactgcaacctctgcctcctgggttcaagcagtcctctggcctcagtctcctgagtagctggaattacaagcgtgtgccaccatgcccggctaatttttgtgtttttagtagagacggggtttcaccacattggctaggctgttcttgaactcctgacctcagctgatccacccgccttggcctcccaaagtgttgggattacaggcgtgagccaatgcgcccggccccagggcccttttcttaaaaccaaatcccatgcaataaagcacgtttatttcatgcaacacagcttagttaatgcttatacttccaaatactccggtttactaggtacaactcaatcaggagtgcctagtataaaagaacatgcacagcacagcgacagagaatgttcatcaccaaacacaaggaagcaaaggagatgcaaagctatggtagctagaggaggattagctttcctgatttcagtttgagaaaagccacttgtctctacagtccactagtttggcaaggcatttgcccttggctgtgagatgatgttacattcaaagtaaggtatattaatttccaggcttgtccaggatcaggggctggagtcttccttcaatagtaatcctttccttaaaaccagttctaagctttgtatttgttttattaagtgattggatagccctgaaatatgagtttcctccaatctcttccactttgcaaactccagaaccgtttgaccaataagttaaaacccagaggaggactgactgtgagctaaggcttcagacatgcaaagcgcacaaccctgggaaacagcagcatctgggacaggaggctcccattactacacatgagggtgtcataggttttgcaaatcaaacacacatagaaaaccagtagtagcctgggttggacacactgtatgagttgcacagttgagtgaggacccagaccagggagccacatgttcctctagcttgcatacatttatttcacaccacctcaggccactcatagtttgcttacctgctcattgttgctctcccaccattccccatactccctttgggggtgaaacactctatttccgacttgtgctgggccagtctcctgtctttgtacctggtgagcatgaacaaggacaggagcaaacagaaagacgtgattgtgtgcttaactgccaggctgaggaacggccgtgactgtggagatggtcactctgtgccaaaatgggggttcctgcttctcaatgcaatgaccaacctgtgatacttattagatgaatgtgatggcatatggacaacatcagggatgacgttgttactttttggttaaaccacatgtaacccattctttcacattgcctattaaactgaatatgtcacatttaatagtcaatggtaaaggtgtgcaatttctagcatcttagaaaaagatgaatatcaatcaacacattagaatctattcagtgcttaccatgtgtcagacactatgctagaactttacctaaattgtatccaggcaacagccctgggccagaggctttgttatcatttccattttactgatgaagaaacctaagattatagaggttaagcaaattaatcaaagattagttaattaaataagtggttgggctggattttgaatacagggaatctaagtttagaacccacacttcagccattataatgtgttgccttccattatcaagtttttaagctaattattatcttgagcaagccctcattgagtgataccattctggatgttgttagacattggcaataacagaggagagaagacatgttctttggatattaaaagtttctgtaaacattaagctgaagttttactgtcagtattgggatgccgccattatttttgtattataattggcagttcaccgcgctttgaagataccagatatttcatctaaaataagtgatgagattcccaatattactcttctacgtggtgcatcaagatgagttcttgtatctcaatgacagttttttgagctaacatgatttcacagaaataacctcttttactcattggttcgattctgtaaggtttttaaaaaagaactgttatttccatttgccagatgaggaagctagatttacttaactgacttcatgaaagtcacaagcctcatcagtagagaataaccacctgtagagcttgcaggggcccagagctcttaaggttttattaccttttccctaattaaactggagcctggtataacaccacttcatccaccttcctggtatccagtaggctatgataaagggagttactataataagacttgtttatctcagtacagtcacactctttttagtttattttcctgctgtttcaaaagtagtataaaataaaataaaatgcaacaaagtcaacatcattattgatcctggggcagaggccttcctcttaattttttttcccttctaaaatgtttaaagtatctagtatttgaagaaaaatggcttattacatcaagcaaaatgaatttaatggattacctatttaacggacattagttgagcatttattaaatcctaggtaatggactttgcactacagatgtaaagataagtaatctgcaggccccacctgttagaatttacctaacagtaggagaaggaaggaaataagaaatacgtacacaagtaattttagatgtaggcataaagaagagaggaaaagaacttagagactttgttaaaggaggtaaatcatcagaccaagctagattgagtagacttaattttaccaagaaaataccttagaagtaccaatggccaaatgatgctcaatgtttcaatgcaaagtattttgtgcttctttgtgaattggattgctcaagcaaaatactgctcgacagctcaaattaaaagaatattgatagaataataaattattggtggtcattcacttccttacaaagggatccttaacatatttttgaatatcttctgttaggctaattgtgaattaatcattaaatatttcatagatgagttaagaaacctacagtcttcatgcttataagctcttctctttctttctttctctcatgaccacacacactctgccaggtgacctctgtttatgaaatatggaatagatcctaagcatcttattctatcaaactctaacctctgtgaagaaaaaggaatgcttacacactgctagtgggaatggaaattagttcagccactgtggaaatcagcttggcaatttctcaaagaacttaaagcagaactaccatttgacccagaaatcccattactggtcatatacctaaaggaatataaatctctctatcataaaaacacatccatgtatatgttcactgcagcactattcactataacaaagtcatggaatcaacctaaatgcccatcaacggtaaaatggataaagaaaatgtggtacatatacatcatagaatactatgcagtcataaaaagaatgagatcatgtcctttacacatgaatagcacaggagggcattatcctaaccaaactaatggagaaacagaaaaccaagtacttcatgttttcatttatcaatgggagcttaacactgagtacgcatggacacaaagggaaaaatagacactggggcctccatgagggtggagggtgggaggagagtgaggatcaaaaaactacctaccagattctatacttattacctgggtgatgaaataatctgcatattatacccctgcaaaacacaacttacctataaaacaaacctgcacatatacccctgaacctaaaagtttagaaaaaccatagaaacaaaacaaaaaacaaaaacaaaacctaactgcttttggtaaaagctttcactgacatataaaaaacaaaataatgaaaattcaaaacaataataacaaaactcattttaaaaatgtgagcaatatcttagactttttggaactttcaagcagtttttgtattcaatgcaagctgaaaatggcattaatacagaatgggaaactcatcattgctttcagataggaccctacttgcctgtctgtacctgtaattatattcaccagatatttaaatagatcatatttttattcattcacttactcattatcccatttaccagtaatgtgctgttcaaaattactaatagatttaatagtctcaactgttgagtttaaaaactcaacatttttttccagttgagtttattttagaaatatggaattgtcaattaaaaatagtttaagcttttcagaatttacagatcatggaatatcaattttaaaatttcatttcttttacataataaatttatatatcagatactaaaacacccatacactcatacttgtaaggcactgtttcaagtgctttgcaagtattaactcacttttcaaatgaaatgtttaatttactatatttatattcaaagttataataaaaagtaataatgacaaaatattgagcatgccaggctgtttgctgtacactattgtaaattattaaaacagccatacaaagcagctgctattattctcattctgaagaggcagacactgaagatcagtgtcagtaagcccaacctcatgtggtttatgagcagggagcccaaggttaaaaatcaggtttctctgattctaaagctcatgctatttccattaatttttcctccaagtaacaatattactacgtttaaaaacaaaattacaaaagcttattatttaccttttctcttcttgaccccgttttgcaaataagtagcagagttatcaagtacaggcagtagagaatctagtgataggactttaaattttgttacttcctttaggtccctatgcctgtaccaggcaggtttagttgacatcattcaaaaccgtttactgaatagtccatgtgctgggcactgtgataaggagcatatgggtgattatgtcattgataaggtcacagtcttgaatgagaagatgaaatgtaaacagataatttccaaacaatgtaagaagttttattatagaaacaaatacaagaagggttacttaacccatactagattggcagagaacactttagtgagatatgatacgtaagacaaatctgaaaaattgagcagacatgcaccgtgaagagaaaatcaggtgcaaacatgtagagaggtttagcagcatggtgtatactgggaaacactgtttagtaatttttattgtaagaagtataaaataggaggtcaaaggggaaagcagatggagaagtatataaaaatgatgaatttgcttgttgattatgagatgtcattgtggaatccttatgctacataaaacaggatcagagttgacatttagataaaatgcaatggacttgaaggaacaaaactagagagatagagaaatactactacagttatgcatgtgagagatgataagctaatgcttagggtagcgataatacagatgaaaaatagagcacagtctcaagactatttgggaggcaaaaatgagtaggatttattggatgatgagtataataggaagaagtatagaatgataccccagttactgtgttggatggtgcagttaactgagttaagaaaattcaagagaaggagtatatttgggcaaggaagtaaaaagcttcattttggaatatttgatttgagatgctggtgggacatccaagtggacatattcagcagacacatgagtataaacatttggaggttagaggattgttatacacaggggagctctcagcataccgatggttgcaaatacaatgagaatggttgaaaatattcagaacaggaaaactatgtagacagtggaaagaagaggtgaatagccatgctcattctacctgtccaaaaacttttataacactgttagtgtaagcattcccttaaaacatttactggaaaaaaaatctgctgagtgccttgtatatgctagacatggagtttaaggctcttcaatcttgtaaacctgtaagttttcttataaactatggatttctagatttatgcctaatacagctttgacactttagtttataggccagaagcttggcatgaaaaactctcacaatagatttaataaatttcagaatgacttattctgaaataagttttgcttatcttctgtaaagatttttgttgttgttgttcttcttcttgtaccttctttgtccaggaagttctagctcttctgtactgagttctacaagagcctatactcatctggtaaatctaaaagatgtgcaggtaagaataacttaggatcagatagtaaatgtaattttccattattatttggataaaaaatttcatttcttcacctcaattcctctttcctaccaatatctactgaatattggattactgaaatttctatattggctatgtgattcagaatacataaatgagtgcagaatgaagtgaaagactagaagaaaataaacaagtttaaataataaatgtgtatattaggtgaagtagcagatagatggagaattgtgcctgaagctggcagaaaaggagagattttgatattggaaataatgatgccttatgtgaggctgatcaagtttgagtaagtgaccaggaataggaacattaaaatgtattagaactggggggaagaaagaagcttggtactcatctgtcctttatacaagcactaaattcactcagaatgatagccgggcttgggatagacagaagttctttatccagaagttggcagtaaacagtagttataaatgaagctaaaagatagagggataactagattccatgagtctaaattcagtcagagctttaattttcacatttttgtatgtaagggtgtgatatatgcctggaagcagcgttgagttgctgacctccatctctgtgtcctgtgaaacacgtgatatggaagaataagaaactttacttgagagagatatggcgtagaaatgtccttaggagggaattgggtttcaatttaagaaaacaacagtaaatggagtgtttagtgaagcggttgaataagaaggggggtttaatcattaaataggaattatagacagggactctatatggtttggaagggaaaggtcagtggatgaagcaaagagcaatatatagaagtagaatttacaaatgtgctacaacttatgagatgctaggaagattccattgatgaattctttcctcatttttctctgataccaaggagcaaatgttctccatcctgtatgagtgaggacactcaagatgcaaatgctgttgtgagtatcccatggcatacttagagacatgttttctcatagaaattgcagactctctgagaacatatttggttaaaaatgagtggagaaagagcctaagtttcctagagagttcaagaatggaggggaaaaaacacaaacacagcaaataagaaagctaaaggcaccagaggcacatttcccttactccagttttgtcataggcttatcctgctccaggttttgttctttccaatagataaaattgtcttaaaaaataattttctttcgccactttctctctcacactgacatctactatggcccgtagtcttccccttgaaggagcattgtgctaagccttgtgagcacttaaactcgttttccattcctaagctagctgtcattcagcttagtgaaaaccacagggagatattttcttatatgtgtagaaaccacagtatacctattttacttcatgctataatgctttaaactattcatagaaaaaaacagcctgatttctctaagaagtctgtgaaagcgagttggaaaatgttgcatatttcacatatgtcttatgtgtaaattttagtaactcaatatggaatggacactaatgaggcaggagggtaagtctggggagtaagtgggtaggagtgtgttcttcaaggaaacctctcatttaaaccaatatagatgcatcccatttacaaagcaaatttaaattctctctttcctcaattactttttattatttagaatagaagtatggtatgagcagagaaaaacaatatgggaggaaaagagtctttttggccaagaaagtgccaaaaatagtaaaagttattgaatgagggacatttgaactatagtcatatgacaagtcactgtgaatgttacagaaaatcctataagggattttcataccaaaattgcagtaaagatggcagagttttaggactaagcttgagcataaacatggaagtgcagagacttaaagaaaaatgaccatgtgaataaaccctaaacatagtgcctccattatgtaagccctcaaccaacattttctgagggaatacctccatgaataaatgaataaaatggaattgtaactttagggatgatcaaatctccaatgagatttgctgttgttatttgttttgtttttaataataaatacaaactgaagacattctgtacatgttggtcaagagatcaaggaagatggaaaatattaaagatgtttacagaaagtggtaactaatgtacagagttttgagataaagtaattgtagaaaaaaggaggaaagaacagacttttttgtaatcagtcagcatatactgcaggctccatctgcaaaacatacctaaaatctgaccatttctcaccagtatttattaccctggcccaagccaccaatacctgttaaaattttaacagtttctcaaactggttctgctttgtctgttactaaatttccccaacccagaccaaacccattccaacctccacccagcaagcagaatatcctgtcaaaatagaaatcttttcatatcattcatctgctcaaaacgctgttagttacccatttctctgagtaaattatgaaattttttatcatggtttacaaatccctacacttacctcccactccctgactatctctctgatcccaaaagtcactttttctcccttgctcacattgcttcatctacaatgatcttcttgttgcttgaagacaccagatatcctcccagcatagtgtctttgctttggccatttcctctgcctttaatgctttcattaaaaatatcctcaaagcttacttctttcaaatttttgcctaaatgtcactttctcaatacatcctgccagaccaccctatttaaaaaggcaactaccactctactctttctgttaccatttcctgcttttatcaggaaaacttatctaaaataatttatattttacttatttattttatttattctctgttttcccccagtggaatctgtgatagaatgcaagctctatgaaggcatgggttctgaaccgtatgcttcactgctatcttcccagtgcctatgatagtataggtaataatatttattgaatgaggtatgcatgaatgactgacaaaaaggaaaattaaattataaatttccaggaaatttgcataagtaatgaggagccaaatgttaatccccaagacaatggggaaaatgtctccagagcacgtcagaggtcttcaggcagccccttccatcacagatctggaggcttaggaggaaaaagtggtttcgtgggccaggcctcgggtccctgagctgtgtgcagccagggacttggtgccctgcatcccagccactctagttatggctgaaatgggtcaacatagaactcagactgtggcttcagaggatgcaagccccaggtcttggcagcttccatgtggtgttgagcctgtgggtactcagaagtcaggaattgaggttcaggaaccacctagatttcagaagatgtatgaaaatgtctgacgtccaggcagaagtttgttgcaggagtggggctttcatggagaacctctgctagggcagtgcagaagggaaatgtggggttggagtcctcacacagagtccttactggggcactgcctagtggagctgtaagaagagggctgctgtcctccagacgccagaatgtagatccactgacgacttgcactgtgtgcctggaaaagcggtagacactcaacaccagcctgtgaaagcagctgagagggaggctgtactcttcaaagccacacaggtggagctgcctaagaccatgggaggtcacctcttgcagtagcgtgacctggatgtgagacatgaagtcaaaggaagtttaatatttgactgccctggtggattttggacttacatgggacctgtcacccctttgttttggccaatttctcccatctggaatggctgtatttacccaattcctgtacacccgttgtatctaggaagtaactaacttgcttttgattttacaagcacataggtggaaaggagttgccttgtcttggaagagactttggactgtgcacttttgagttaatgctgaaataatttgagactttaggggactgtcaggaaggcatgattggttttgaaatgtgaagttatgagatttgggaggggctggggcagaataatatggtttggctctgtttccccacacaaatttcatcttcacttgtactcccatgattcccatgtgttgtgggagggaccttgtgggagataattgaatcatgggggcagtttcccctatactgttctcatggtagtgagtaagtctcacaagagctgatggtttgataaggggaaacttgttttgcttggctgtcattctctctttgcctgctgccatccttgtaagatgggacttgcttctccttgccttctgccatgattgtgaggcttccccagccatgtggaactgtaaatccaattaaacctctttcttttgtaaattgcacagtctcgggtatgtctttatcagcagcatgaaaacgaactaatacagttacatggaagatacttatttttttaagatatttgcctttcctttgcattgtcacattcttcttaacaagccatcccatccttaccttcacgatgtagacactgattagactaagatgataatagtaattatcagattcacttgccactttactcatcagttttagccaatgatcatgggagagagtcttctggagacttctgagaacgatttctttagtattaataaaacactggaaaacatagtctctttttctgtggacagtggtctggatgtgatacctgacaatgctccaaccatatggcaggcatgagagaagctaagccaacatttcaaaaactgtggtccagtgattcagtggtagactggaaaggtcgaaataagtaggtccttgagccattgtgtcctttgagctactgaattagcctttttagtgtcagaaattctttttatgtgagattaatttgttatcatttaagccactttgagttaggttatagactttctgaggctgaaatcctcctatctgctatacttggtttcattagtttttcttccaaaactgagtctaagaatttctgaaattgttatagcatttacttaggtttgactgtttataaatactgtgtgtgtctctctgtgtgtgtacacatgtgtgtgagtgtatatatatgatgaatctaaagaagttactactaacaaatactttagtgttacttagatgtttgtgttcttttaaataatgctcctttctgtatgtaccatttatataaaataagtgtgagagttaataagttagatttgtaaggagcaaaaaagagagagatcgattgggtaaaacaaagtattattttctcaataatccacacttagagaaagcctaaacaattggtccttataatcatggaagaaacacccttgttcatttcctgaaagctatgctagttacagtcataaccagttactgtgggtttagtgttacattcttaaactgattaggtcatgggaaatgattcagctcatagtactgaagccttataactactctgaaaacgcttttgttcacatatattgaagaattggcatgggcttatacatatttaacaaaaattgtttgcaattatcttttgtgtaatttgaataagaaggtgtcacacacacaaaaaagaaaatgaacctcagtgggcttatgtgcttattccttattagtcagtgacagatccatatacaagtaatcctggctcaactcagtgatgatttaggagttctttccagccaccatcttctttgagaccagttatagcaaattttggagccagtttttatttgttagctctctctttccctttgcctccctgccttgagacagaatttttctgactttagtttttaatcttgactttgctgtagttattgtatccactccccctttgtaccaacacaaagctttataacagctttgagcacattcaattctgttcccatgttggttccttgaacaccagccaagacctcagcttttcgacctcaggtgaaatttggatcaaacatctacctctagatgatatctttagtgatcacccagaaacacagtttataattttaaaacatcttagggaaaatatatgaggtagaatgctgcacattgcatcttattctacagatttattgccacattccttttgggaccatcctaattttggatcttggcagtcataaagtgaagagagaaactatggtgtaatatacttttgaatagcattcacattattatagaaaaactttccctatatcatttaattttcttaacaaactcaggaatataattatccccattcagcagataaggaaactggctcagaaagcttcacaatttggtcaagaccccatagcttgtaagtctcagaagtgccactagaaaccagatgttttacctccaaatctcatgctcttcattaacaacttactttttctttatttcatgcttaaaaaccccttatttaaataatctgatggcacatttgagagactgaaaaggtcgtacatgaagttaatagtgtatacttagtggagctaggctttgagcacaatatacgcttattttttaaaaggtcaaatttgactacataatggtcaagtggaataaatcaccctctgggccccttgttaacatgcaaacagattggcatttctctggctggagttttcctagacagaaatacaccaaaaatctgaaggctgtaaaagaggcatcactaagaagagctgacaatcagtttcgatgtgtgggatacagtgtgatagcagaagacagacagggacgagatggtagaatattttaacaacttcagagtgttacaaagagagctgaaggaaagcccaagtcagccttccaagtctaattgatcagaggaaaattctagatgaaggcagaagggaagtcattatggatctttaggttagagggaaacagtgaagccaaatttaaaaagatcaatattatgcagtactattgcaaggtaattcctttcttcaatatcatctctcaaccttctatctatctatatatgtaaatatattggaatgatttactagatattccatcagatcttgtggtctccgtgcgcagaaaaacatcttttgcacagacttgaaatgtcaacttgattccttcagataaatcagattaaaaacaaaaactgagcatgattaatagctccagaaactaatggcaaagtgaagataagctgcaaaatgatttgagaaattgccaggtaacatatttcactgtgttctgtgaaaataatggaaaggtaaaagctgaaaagtggggaagcaatgcaaataaggaattaaaaagtaaaaaatcagctgtattgacttagtaattctaggaatttattctaaggaaacaattcaacataagctcaaaggtttctgcacaaagattttttccttcaatgttatagaaaacagaaaaaaaaaaaaacctcaacaaaaaagaacaaaccaaccacgggagaatagtttaataaattacagcatagcaatattatggaaatgtgttaaattttgtattgagtaaagcctttcatttagcttctgaagaattcccaaaggatgtattttaatcctacttatgatgagagcttgttttcagatatgaatcatcataagtcattgccattttattgtgtactttccttcaacattactatttgttacacaatcaatagaaattcaggaagatacagatttcaaaaccaatcctaaggtgctttacaagctttatacaacatcctcaatagggaaaacttttcagggaggaacaaaatgttaactataagaagggtctccataggaaacatttcattatggcattaattaaaagttgctagtttctatcttataggactgaggaattttcagacagataaccttactatttctaaagagagataggtagttttccaacagagatttttcctcacatttttatacatgaacaattggaaatgcagtgaagtcagatgaagctagataataaatgtaataagagccatcacttactgagcacttggaatgttccagacacaattctaagtccctgaatttactgatttaatcattacaacagtcttttgagttaggtactattattattcctactttacaaatgaagaactaggacacaggagatcaagtgatttgcccaggttactagaatggtcaactgtgaggtaaattgcttctcactaaaatgctggctacaaatagtagctgtgccatttgttaaacctagttctgtctttaaatggcctaagggatacaggtaactgtactatttttcaaaccttatcattttttttccccataatctccttggcttgagacactgcctatgcttttacttgagccctttctacccttttggataggaagactgattcctctgtgatactaactttgattaaaatttgcaccagcaactaaattttctcagtctggggactgatggagcttaaacctcagtggtgctcgatggaagcagatttgctctaaagctgatggagtatcagggtccctcactcacagatgcccctggcaaggccctgtttctatttttgtattcacattttgtaatctttttcttaaataaagctccccaagtggaaggaactttaggtctcacaaagcctggatctacttgtttaccagagtttgcctttgacccataagggaatcataaactgtgtttatgttcatagggttagttatgctttctgagttacaatttctccatatatacaatggaaatattgaggatcaggtaagacaattcatgtaaaatgcttgattttatagttgtttcataatgttcctttcatatctgtcattttcttctgtactaataacttctataaccaggcaggcttctcccagatagctctgatacaaaatatttgtcctgtttcctccacacaccccctaatacttatgaaatagtgcttcctcatacgagacataaccaatataatctctattaattcttttaagttaatgcatctttgattttcttacctccatctggacctacctccatctggacctacttccatctggatctgtctgctcccacataccctaatttacgctgctgcgatttaggctggatttgaaaatgatgtagagacaaatgatgctcttctctttacttgtctcagcctgtctcccctgttaatctgtatcagggcctattctcttccttcataccaattattaacaaattataattaaatatctgcctgactactagtttagtaactgtctttctcactacaccgtaaagtttatggctacctgggcacgtctgttcttttaacaagcatctaggatagggcctagtatagagcagcaactcaacaagtgaaatggtaaaagcagggacatttatgaaatgcaaggcagtactatttatctaaatctaactacatcaaaactagcctcccccttctatcatacacagaagttcattcaccagttcttgtctcaactaattcattccgtttgccaccctcctttctttctctagccttcttccttcacctttcttgcccttttaacccctcctgtcctatctcaatgcataaaacttgtctttgttttcctcattcctttgtctttggacaacttagaaacaaaaaaagctttctacatttttgccaagaagcttagtttccatttatttcaggatgtaaaataactggattttcacaagaacaagatgagatggggtggaggaaggagattgggatgtttcttttgcctatatacatgcgaggggtgaagactgaagggaggggaatcatgcttacttttgatagatgcagctgcccacgagtgggaatgacacccagggagagagaagcagttctggaaagtcctgggcatgcaattacaggtagccagtgtaagttgtgcacttacatggccatcaaaagaatcatctccacttcatgacacggggaggagggaactcaaatcacaagtctatgactagagattacctttccactgcctctattcttcatcacattgtctttatttttatttctattttttatttttatttttttgagacagagtctcgctctgtcatccaggctggagtgcagtggcgtgatcgtgatctcagctcactgtaagctctgcctcctgggttcacgccattctcctgcctcagcctcctgagtagctgggattacaggtgcccaccaccacgcctggttaattttttttttgtatttttagtagagatggggtttcaccatgttagccaggatggtctcaatctcctgaccttgtgatccgcccgcctcggcttcccaaagtgctggaattacaggcgtgagtcaccgcgcccagccccatcacattgtcttaagattattattttaataaaggtaattatatttctcctggtattaggataacgttttatgtttaattataatcacacatgattacaacagatggatttcctaattctgtcatttccaagcagatttccacactgccgagtgtctatcacaataaaggaaagtgagattactttaatttcacaatgcaaaatatccaaagaaacgtttactgatgtttcttaagtacttagtatttgctaggtcctaagctaggagtttcattgtgatctgttatagatattaggaatttatcatgtcagagtgtgataagctaatgcatgaagttaagtagtatcatctgtatacatacaagtatataagcatatataaatatatagacacagatacatgtatatacacacatacaatcacacacttatacatatataaacatacatatagatagatataccatagctcttcagatttgtctaacttgactgggctttagtttgcctgagatgggcaatatattatggaaattaagtgtactggatttggagttaattaacatggattttattctcagcaataccacttactagctatattgttatgaataacttatataactttttctcaaattttcttttcgcataatggaagaaataccatgtaatttacaggattgatgttttatgtagattttagcatttaatttcactaagacacttatatggtttggctctctgtccccactcaaatctcatctcaaattgtaattctcacatgtcaagggagggatctgtaatccccatgtgtggaggaagggaggtgattggatcgtgagggggagtttcccccatgctcttctcatgatagtgagtgacttcttgtgagatctaaaggttttacaggggctcttcccccttagctttctcttctctctcctgctcccttgtgaagaaggtacctgcttaacatttggccatgattgtaagtttcctgaagcctccccagccatgtggaactgggagtcaattaaacctctttcctttataaattacccaatctcatgtagtacctttatagaagggtgagagcagactaatacactatgagatatgtactattattatccccctttcaccgataaaaataactgaggcacagagtggctgggtagcttgctgaaagtcacacagttagatgaggcaaagccaggactcatatttgggctgttgaacactgaggcttgtattgtagaacactagattaaagaaaataaccaaaattaccaaaggcatggctaaaaaggaaaaaacaaacaaacaaaaatcaagtagagggcaaagaataaagaagagaaagaggaagagcaagcatacgtaacaggcactatactcagagctttttaaacattgtttcaaacattgtctctttacaaccctagggaggggtattgatgatcctgtttaaaagagatctattggtcacaaagtttataaatgttgatgttggaattcaaagctaggttcttctgtttgtaaatgatatacttaaacatatattgtgtattttctagatacctggcatagtacttggttttctacttgacatccagaaaatacatttcacagcctctcaactcaaggagcttagaatccaatggggatgataaacattggctgtcatagacaaacaaatagagcacactaaactcatggtaaagataataacacctgccgggcttggtggcttatgtctgtactcgcagcactttgggaggaagaggctggtggatcacctgaggtcaggagttcgagaccagcctggccaacatggtgaaaccccgtctctactaaaaatacaaaattagctaggtatggtggcacatacctgtaatcccagctacaaaggaggctgaggcaggagaatcacctgagcccgggaagtggaggttgcagtaagctgagattgggccactgcactccagcctgggcgacagaacaagacttcatttcaaaaaaggttaataacacctaggtgtcctagaatgaaaaaataaatctcctagaactaaaatggaaaatgccgtggtgtaatttgaacttaccctggcctgagaggcacaagcttggcacactgtgcacaacaactatttgttaactgcataagcgataagagctgattaagtgaaaagacatgatattctttatctgttacctttctttctcacatggggccttgtagagctgaccgtttaagctttctccttcaagcctaggaagagggcagggtgcagaatgtgtcattggaagaaacaaatgggtgcaagctgactgccttgcttgtgactgtcacgttcaccacaaataaaatagcagaaggtttctgaaggcagggaccatgtatgtatcccagtgcccacaacagtgagtggggcctggcaagactcaataataaaaaaagtgctgaatgagagaataaataaatgagaaagaaaaatattatttcagggaagacatagagaaatcagagaagaggaaaaaaaaaacccacaaccaggacccataccatcatgttatccttttttttttttttttgaggcctttcctgtcctctctcatcattatttccctttttgtatacccacaaaggatcgagttatctatacttccttactaacattattttttatgagtctgaatttattatgaagagaaaagttatctgggggaaggatggtattgtattcatttttatatctccagtgcctaacctatcatctagcccatagcagataacatggttgctatagcttgaaaatgtcaccaaaagttcacgtgttgaaaacttaattgccgtgtaacagtattaagaggtgggacatttaggggtgattttgtgagggctctgccctcacgaatggattaatgttgttatcatgggagtgggttagttattgggagagttggctcctggtaaaaagataagtttgtctcccatttgctctcactctctctctctctcacacacacacatacacatacacatacacatgctctcttgcccttccaccatgggatgaccctccccagatgctggtgccatggtcttggatttcccagtcttcagaactgagaaataaatttcatttaaatagtgttacccagtccgtggtattctcttatagcaacacaaaacagactaggaaaatggtgaaatggtacctgtttattatgattgcttgggtcataacattcactgagcagacaagccttgctttcctgtgactgacttctggtcactcttttctttcctagcccagccttgtgtttgctgtctggttcacattttagacttttctactccttgtattacggacttccttcatttcacaaagcttaacttcattctccgtaaatgtgtgcattgcctccttgtgtctccttgagtgaaactccccactaacctctgttttgggctttctccccactcctgtgaggctctgctgccctctagggggccttgttcatcacacacttctcagggcccagttggatctgcacttggcaatacagtcctagtgtaggagtgtcatgacagtgctgcaaagcctcagtgctccttttcctgctcctacagtccccagtataaaatgtgtggctatataatgcagttgatttaggaacattaaacttgggcataagcaagcaagaagtctgtcaagaactgaaactcattacaagaggaggctggaagaggctaccacagggtctcagtgctcttggtaccaacgaaatccttggctatgagtatcacacctgcatcttgatagtttgcacattatattaaggtttgcactatagaatccggtagccaactaatgagaatgttctatttgacgaatgaacattgatttacatctttgcctgggcctttgggagacaaaaaacttcctcaaagagatgggacctgaaattgctttttgctaaaccctcaaccaacatctggtttccatacccaatgatgactcttaactctatctaacctgactcatctgcaactggaactattgactacttcttcatctttgaaacacatttttcctgtcatgctatcacttgtatctgggtctcagttcttggactttctttatttatctagtctctgggctctgttcttggttcttccaaattgtgcttacaaacaaaccccaaactctcctaattattggtccaattttcttgcagtttcctggacttgttcacttagatgtctcttagaaattttaaatttaatagttccaaaaacaaacacatatttcttcaaacctattctcttttaccttacccaccccaatccaaattatttctaatttagtcctattattatcaaatgcagttggccccccctcccccaccctttgattctctagtctgaacctttctttgagctcataggacataatataaacatgtccaaacttagttatcaattttacccttcaaacctcttctccttgaggttgaattacacaggtccaaatcctccattcacaaaggtaaaatctagcacccatctttaagtattctcttttctttatacgcaacattcaatcagttattaagtttcatcattatacattctagttgaaaccatcgtgatttctcacctatcctgttgcaatggacatctgatttccctcttctcttcttgtcactctaaattttattctatctacagaaaccagaaagatatcttgaacatattaatcttatgatgtaactcctcttctcaaagcttccgaagcttcctatcacattcaggacaatatacaaaatatatattttgtatattgtctgatccccaatcctcacctagtctgatccccaaataccagtccacatttttctgttgtcattctctccttttctcattttactttaatcacaatggagtttttgctagtctcctaaaatgaaaatctgtttcctgccttaagatctttttggttgttgctgtctttgcttgggatacatacctccacctcccagaactctgtgtgtcttattttctcgcttcattcttccttctctttaacttattcagaaggctgttcatgacactgtatctaaacatatctaaaattagtcccaaatcaatttcactgtaatacctcatcttgcttctctttttttaatgacaattaatactatgtatttgtttatgttttattggcattctctctgactatagttgaagttctttgagagctgagattttaggttgttcttcattttatcctcaaagcatagaacagtttctggcacacagcatattctcaatgaatagttactgaatgtgctaatgagtaaagtcaagatattaaattatagctaaagttccccagaattgtcctctattacaatgacttttgctttgctttatgtttaataattatatatgttaaaacttttgttgcagtttgcttggaatttggctaaatggagttttcttttaggaagatgtatacacatatatatgttcatagccatttcagtgaatggtaaagtcttaatatgggccctatgtgttcaaaacttctgtagactagatagtgaagaaagactttgtacgtggtgtaagcttgatgcgtggggataaatttcatgctaatgagattcatgtaaatgaatttctgtaaattcaatgaatttactttgtagaaacagcaatgtacaagaacaatttgagtggtgagggagcttggtttatgcagaagattaatgctgaggagaagcataaggttaaattgaaaaggtaagaagagcaagctgaagatactatgaggaattgccagtagtgtatttttcaacaaaaatggggaggtattgaatattttttagttggtcagatgtattggtttctcattcttctattaattaagatgtatagatatatgatattcaattgtatagcaattgtgaaaattaaaatgaggatacaaaatcaaaacattaaaaaacagttttacctatatctgattaaaaatgggtaaattgaggaccaggaaaaattaaacatgattgcattttcagagtgggaagtagaaaaatttgttgcatttaatagaaaactgggaagaaagaaactattacaaatggatttatttgatataaaagaaagtgagtttggatatgttaaggttgaggtgatcccaggtatgaaagtggagctatctagttgtcatttgtagactcacaaccagaactcaaggaagactaatactccagaattgaaagtgtaatgatgggatggttgaattctccaaagaagagaacaaaagtagacagaactcaaggaccacagattgaccttagggaataccctcagttaggagatgggagactgcctcaagtagccccaaaccttatctttgtgcctgccgttatctcttgctggaatgccttccctatataagcaactcaaacactcccattattcttgtactcaaggctatctcctctatgagttcctttaatagatcacttgagagttgaaattctatacctgattccatcttttcagactgacaggcaaatatttttcagctaaagaataatggaggctataataaggcatagtatgaagagcacaaggagtaggctggcagtcatgggttcacatcagctcaataacaagctgggcatacaggctcaaattatttcacctgtctgagtctcagctttcacaagtgtaaaaattagcatatttttattttacaaggctattgtacaatgaaataagatataatatgaaatagcacacagtactttgaaggaacttgataaatatgttttcttctttaaccagccaccagatatatctctatgcctaccaactaatggaaatatttgatctacaaaatgccttgtgggaggtggggaagggaaggagttgggacatagaaggtgagaccaaaaatgtgtgtccaggtgattgagaaaaggtagaaaacttattttagccaaagggctagagaaaaggatattcctatctttttcttgtttaatttctttccttgttaccaaaggaatgctgcttgggagaagagagttgttaactcacagaattatgcctgaggcatacttttctctcatattaagtgttatgttctgaaggaaatatgatttgcatgcaccagatacggtgcagcaagaccacttctaagcaggactaatgtaaataaaaggaacatttcttgagacagaattttgaaaataaaactgcttagtttaccttaccattcagagaatttataacaattaatcaaaaacatttcaatcaaatttaagtagtaacaaatgaggccactaacatcacatgcaaattaaaaaaatccactgtaatcacagcacttaaaaatatcaattcattatgcgaagggagtgttttagatgcaattcatcaaaatcatccagacatagtctttaatagctccacaaatatacttcaattattacggagccaaaccatttaattaatcactacaaagcatttcttccctcaaaataaaacactttaaaatatatcattcataacattacaacctgccagatctaaatcttcttagcatttaccttctacatctccagtgagagacattaatatatttaaaaagtatattactaggcactagtggagcacttggaaagttgacttattctcttggaaaatgaactactattgagtgttgattcacattaagggaggagctaagacttcaccagagactagagaagtgaatctttgctggtcacccagcacatatttatcagataacttgctaaaaacaagcaccaaattagttgctgagggtggaggcaaagaaagcaatgcctgcaagaaatttacagtcaagcacaggggaaaaacatgcaaatcaatggtacaatataacctgatgagttttataggagatctagagaatctaatggaaataacagttgataaaataagtgaaacacttgggttaggaattggagagtaagaaggcattttctaggtaatagaaagggagataaattcaggcattagtagaggcaggaagaataccaaagaaatggccaggaggcctggcacagttgctcatgcctgtaatcccagcaatttgggagaccagggagggtggatttcttgagctcaggggttcaagaccaagtgggggcaacatggtaatacctggtctctacaaaaaatacaaaaattagccaggtgtggtggcatgcacctgtggttccatttacttgggaggatcactttagcccaggccatggacgttgcttatgccactgcactccagcctgggtgacagagccacaccttgtctcaaagaaaaaaaaaaaaaacccaaacaaaacgaaacaaaccaaaccccaaccccccagagaacaaacaacaacaacaaaagaaatgtccaaggattgttgaaattgggaactatatgcagtttggcaccgtgttatagtatgtgtttggaggctatatagtatggtatacattttatatagccatactatatggctatatagtatgtgtttggaggtatagtatggcactggtggtgggggctctaggggcttgatgtagcagactggtggctggatccaaggttgggaaggccaagtcatcaagggccaggtcactaaggctctgtgagccatgtgaaagagttttagatttttatattctaaggcatgtatacccgctgaactcaatttgagtattgaataatgtgattacattttcactttaggaagattacgctggtagctgctgggacagggtggtggatcaacaagagagatttagaaaattatgtcagcagttcagacaataggttatgaagacctcatccatgaagatatcagtgaaaatgcaaaagataaggtaaaattagtaggagaaatgactggttggatgtgaagggtcagagcaagtaaaatgttaaggatgacacaggtttgggcaattagttgaagttacagcttttatccagagaagaaatagaagaagaagaagaaacttcaatcaaggtctggagaagtgatgataaaatcatcacttaatttcttggtcaaaatagtattttcttctaatgatctgatttaaatattaaaattatccagattgtcaagtacacttaattctaaaaattgacttaagtatttctactaggtaggtgcttaagaaatagctgatgaaattgaactgtacctgaccactttctaaaatacatgttccacaacaactttagaagtagttttcatttgaagaaaggaaataaaaataaaactgataaaatgaaaccgtgtacttcatctgaatctgtctttaggacacacatccaactccgtgtaccaatttagttcaagtcagccctgcttgcattatgcagacatttcagctaagaaacttaaatgtgcttcttgtgtacatttgctttcatgaccaaaccatattgtcttcagacgttgactggattataatacagatgagtacttcagacagtggctttatatcttctgaaagagaaactgataagggagtgggggggataaaaaaagaaaacagggaaatggacagtcatttattcagtttatcaagaggcttaaataggaagattcctaactgaaatcaagttgtaatgatgataatttcccaaatgtctttctcaatactgacatttcattgattcctacaaattctttaccagtctttcaaatacaatcttagtgtttataatttctggtagctaagctaatggactctagagacaaactgcttagatttgaatttaaagtccaatcctttccagctgtttgtccttgggcaatttatttaacctcacatgtctcaacttccttacttataaaatggggatactaatgttacctgtctcatggggttgttttaatggttcagtgaatatctatgtggtattgacagtagtacctgctactgtcagtctcaatttcacatgtctcaatttccttatttataaaatgggaatagtaatgttacctgtctcatggggttgttttagtggttcagtgaatgtctatgtggtactgacagtagtacctgctacatcataaatgctcattgaagttagttatcattagcccctatcatcccctttccacatcctacactccactttcccttctgtgggttctgcctatttagacttcagctggagtgtccaagaacttgactttaaatcctgtgatagttgcaaaaacagtctgacttcattcttggtctcttttctcatctacctcccaccagcagacctcaacctcttcatacttgcattgagcacttacttaggtataaaatgttgcagactctgacatattaattttccctgatagtaaaaggctacgtgccccttcacaattcttttttccccctccagaaatgggatgagtaagcatgtgacaaggcagattcgattcttattcacaaggtcaagctttagagaaattgatacattttagtagattttagagctaaaattcttaacctcaacagttgaattcaaaccttagtttagccgctcactgccttgggcaagcttctttccctctccacacttcagtgtcctcatcagtataggggtctaataaacttttcttacagggttattgtaagaagtgaattagattaaacagagagtacacatgggcacatggtacatcaccaatcaatggaagatcatggtagtttgactctgaagaattaacactggaagcagaactcattgaattgtaaaggtattttcactgtcaaaagtgactggtaggaagatatttaggcaagccttcttctatggtgtgtgaggtgtatgtttttaaaatctagcatcaacattctaggaaacagctacagctcattttttccaacttttaaatgtcacatctttttttttttttgagtcaggatctttgttgcccaggctggagtgcagtggcatgaccatagctcactgttgcctcaaactcctgggctcaagtgattctcccacctcagcctcctgagtaactggtatgatagctgtctgtcaccacatctagctattttgtttaatttttttgtagcgatggggtcttgctatgtcatccaggctggtcttgaactcctggcctcaagtgattctttcccactggcctcccaacattctaggattataagcataagccatcgtggctggactgttatatcatttttatggttatggaaatgtgatatcaatgataatcagcaaaccaagagatgaaatttagaaatttgtattaggaatcttcttcagctggtccatctgggaatcagcacctctactcttaccactgcttctgcaaaagtttgtctctgctgcttacattgagctctctgtgcaaacccacagtggtagtctttgattattgctacacaagctgagtgcatcttgggcagaaaggctttctcactggagttgcccaaagaacttcgcctgccacctactggccaggaaagggacctggtcgactgactgctggggaccaggttaggggttgaggggagaagaaaaggaggaggaaaaacagtccatagactgttgacacacaaggtctgattcttctctagcattactgaggatggtcagaaatgccccagagtttaaaagctgtctgctcctctcagcccataactcgtagtctgtctggcactattctccctggagatacagtcacagagcagtgtctgtacagtgaatgcaattaaacaaaagcctctaaaaatttccaaggggaaattagataacatgtgctttgatgtagggatttggagtttgaaggtgaaaaagacagccaagacatcagaagtctgcaactgcttagctccagttcatcacattagcattctgctaacatgtctttttttgttgttttttaaagtttttcactaaagtcaatttgctcagtttttctcaagtaccatcggacattttaaacattctttagattaagacaagtcctgaagttggacttctgttgtgagtgaatgatgaaatcaatttttcttgtgtttttattagttaatcaatcaaagggaaaagtgcttgctagtccatttgggctagaacatttggttctcattttgctatgctggcaggccgtagctctgtgcatggatgagaaaagtctacttttgtcctggtccattctccagcaataagccgtacactcagctgtatccagtggctagatagttcctgagagatgtgtccacagttcactcagagttcctgttccccctcattttcctctgatgttccttctgtgccttttctgcattgtcataatgtgtctgcctgagtcagagcacaatgtctggtgtgcctgactctcactaatgggccaagtgtggtcctgctctctttagcttctaatcaagactccagtgggatccagagtaaaagtgaacaggccacagcataggggaaaattaagatggatggtatagcacagcaggagcttgtttatccctgaggaatataagtagggggaattggtagaacttgctctcattttcacaccttgtattaccacgacagtgatttactgagtatctactcagagccaacctagggatgaatatattcttgtcctcaatgatctctggtagaacatgcatgttggggggaaaaatacagtgactttctgtgtgatacgtatgaccaaagtaaaaccttgtaagatgtcataaaacctcacaggagttttgggtagggaagaccaaaatctcctctccttttgcctaatccaagatagtctaccttttaaggagtgttgtggttaggaaaggatcattcatctgggatccagatcttatgaagggtgtattagttttctattgctgctttaaaagttgaccacaaatttagtggctttaaagcaaaagaaatttaatatcttacagttctggagatcagaaggctgaaatggcttccactgagttaaaatcatggtgtcagtagggctacattcctttctggaggctgtaggggacaatccatttccttgtatttttcggcttctagaggctgcttgcattccttggcttctatacccttcctccacattcaaagccagcagaatagcactttcaaatgtctctccgactctggcaccccgcttccctcttgtaatatctttgtgatcacattgggcccactggataatccaggatcatctttccttaacataattgcacctgcaagtcccttttgccatgtaagataacatagtcacaggttccagggaatagcatgtgaccatgtttgggggccatcatctggctactaaagaggacttccaggttgatattattctatcctattacttcccttgttttattcatgctattgaagatgtaataagatttttttgtttaatttagcttttgtttttacagcaattctacatgatgatgctgagatactagccaacttatatcccaagttcttttctaattccctgttaattaactatgttcctgcatctggcactgatgcagttgtttgtttggacctgaatgtaggggaagggcaaataatcttttggattggacattggctcctagtgaggtgaaaaagtgttcccctcaaccagaagtggagaaggtggatgaagacttttcacataatctctgagactgctatggaatttaccagatgggcagagtggagagtatgcttaataaccaatagcaagcctcttataatggcagtgttattatcttaccctcaggtgggccagcaatgtcctagagtttaatgaatctgcaaaacaaaagtttgaatatggagcaaacaggaaggagggaacaattacccacttgacatatcctcttgaaagcttaccagtcatggtactgtggaaagaacatgctgtttggactcagacaaccttggatgtcaggaccatttgtgtcccttaccagctatgtaatcttagatcacttaacctccctcagcttcaagtttctcacttttaaaacagagttaataatatctgactcatatcactggtgtgagcttagaatatgtaagtccattgttctcaaagtgaatctatgttgtgattcctaacccaggaatgtcatcattacttggaagttccttagcaaagcaatctctctggccctactccagacaaactgaatcagaaactctgggttgggaagtcttaccccataaaatagtagtacgcaaaacacatggaaaagagtctcacgcgactggactgggacttacttaacaaatgctgattgtaattattcttttcactgggagcctcattatattcaccatgctttttgcttttcagttactgtttgttttggaagaacatggccaatgacagatttatgtttgtttaccaagttgtggtctctcttttttctcaaactaaaaagtcacataaataaatgaaagaaacagcattattagtttgtatttctggctgtgccgttttaactcagcagagggggagtcacgcactctggcaacttctttatccagaatgtgctgtcgtgatgccacagagcaaggctaggcacaaagcttatgcacctgagagatgctgtgactattttcttcagttgcttttttaaattttttgactaaatatacatgaaaaacataagcgcacacatacctcaccaaatacagcttcatattatatgatgcataaaatttattgcagtgatttatcatttagtttctatgtaattaagtaaagatggatccacatgttctgggccaagttaaaactcatattttttatgaagaatcataaatgcactgccaaaccacaacaggaatgagggaaatggctaaaactcacaaaccgcctttaaaccctgaggaaagtttgacttctagaaaagcagttaagcagaaacttattaacttgccaccgaaggatgtaatgaaaatttggagggccatggatccccaggatagagcaatgatttcctagtagttcaggcaggattcctgaagtcaaatatttccatgtcagtagcattctaaagagtaaagtcatgtaacctactcagattgtcaccaggactgtctattaggtggggtcatgagatgaccccaggattagtgaaaagaaaactcacatttcatggatatgaactgtgggacacattcttttcttttctttttttttttttttttagatggagtcttgctctgtcacctaggctggagtgcaatggcgcaatcttggctcactgcaatctccaccttctgggtttaagcaattctcctgcctcagtctcccaagtagctgggattacaggtgcccaccatcatgccccgctaatttttatatttttggtagagacagggtttcaccatgttggtcaggctggtcttaaactcctgacctcatgatccgcctgccttagcctcccaaagttctgggattacaggcatgagccaccatgcatggccctgtgggatacatcctgtattatgttcacagtggacctttgagcacaatacagagtgaaatgaatatttttgtccttattttctagaggctctgagaatttaagtgcttagtctagggtcctggcttataaatgtcaaagtcaggattagaatgcatgtcttcgctgacaaggctcacttccctataccacactacttctgtcaaattatgacatgagagacaccgacggctaccttgttccatcagggtcacttggactgatttgcctatataccaaaaaaagaaaaaaaatgttgcatttagggttatttctctgggactaaaaatctgtgtcaaaatatgtggcagaaatacattcatcatgaccttatttatcaacagtaacaagaacaaaatgagatacatgcttgagaaaataaatccaccagtaaagcaatgttggaatgaaaaagagctttgaagatacatagacctgcgtttgaatcctaaattttggttctaccacctattagttcactaactaaaggctattaggcctctatgtgcttccgttactaatttttctttatatgtggataggcgatgatagtttctattttaaaatactatgtgaagatccaatgagataacagataaaagtacttagcacagtatctgtcataaagtagttgctcattaagtgtttactgcataaaggatgaagcaagccattattaatccttatcatcatagcacagattaatttatctcttctctagcagagaggaggggaagttttgattgcatatggtgtgtggaggcatcaggctgatgctggggaggtagccatgagtattatggaattggatgtctaaagtgggtgttaagaagggaaaagaggcaactgaaaggaaattgggaaagctggaaggtggttggctgatggctccttgaggctaagcttataaggaaacaatagaggatcctcctctgccccttccctgtcagcttcatctcctgttacctgctgacacacattttacatgcttgtgattccctgcacacaccatgttgtttcatacttctgggctgttgctcctgttgtttcccagtatggtgtattccacggttttcacgtggcttaatcatccttttttttttttttttaatactttaagttctggggtacatgtgcagaacatgtaggtttgttacataggtatacacgtgccatggtggtttgcttcacccctcaacccatcacctacattaggtatttctcctaatgctatccctttgagattcaactcaagtgtcacctttcctgaaaccttcaaattggacttagtttattcttcagtgacttctgatttctctgtgcatttttctctctcatcacttcatactctaaaacattgctttgtgtatgaattgatctcccccactactctgtgagcttttccaaagggcaggctttgtgtcttgtttatctttattctcccagaactcagcaatgtacccagtatataatgattattctaaaaactctggttgaattacactggactgaaccaaggtgggaagcataaggatcctttgcctatttcatttcacttcagattaggcactctctccaaagaaaagtaactatatcagggtttgtgactcagctcttggcgatttatggccaggtgagtttgtaaatacagccccacattcgaaacaacaatcccagcttgttgttctcactgcttttgggagctgtcattccagtcagtgtttctgcagttcctcattaattgttattatccaaagtaagcacctgttgaatgccattgtgctaagggataggtgggatttggaaaagggttgcaatttctgctgttgagatttcacaggctgcactcctgtaattttgttctaaggggagagagtgggaaagggttagatgacttgaaacattgacctgctggcaggtggatcatgaggtcaagagatcgagaccatcctggacaacatggtgaaaccccatctcttctaaaaatccaaaaattagctgggtgtggtggtgcgcgcttatagtcccacaacttgggaggctgaggcaggagaatcgcttgaaactgagaggtggaggttgcagtgagcccagatcatacctctgcactacagcctggcaacagagtgagactccatctcaaaaaaaaaaaaaaaaaaaaaaaaaatacaacaaacaacacaaacacaaaacagcataattctcaaagtatatttataaagttctatttttttaagtttgtgggacttcttggagggaaaaattagtaaatagaagcagagtaaaaatgtggtttataaagagctcataataaaagtttataataaaaactttgtaactaaaaatattataccaaaaagtagtgtaagtcttctcaattcctgtaaaaatattatacataataaaaataagtcagtcagattttattctcataaagaaaatctatacaaatatttgaaaatcaccaccaaatttcaggcagttcttaaggtttaaattttatctcagaagcttttgtgtactctattcacaatcaaatttggttcattcaggatatgatggaatcagaagtgtgcagtgcaataaagatgcagggagcagttttcaaggaaattccttggcggggagttctactcctcactcattaatctcagtttttcctcagttagggctgccatgtttgtcataagggctggaataaggaacacagcttaaaggttacctgagtgggctatgaagctagcttccttttattctaatccttcctcttctacttactatctgaatggggaagtcaattagcttctgtttgcctcagtttcctcatgtgtacaataaatgagctaataatgcctaccccatagattgttgtggatataaaaagattcattacatttaaggggtttagagcagtgcctggcccatagcaagtgctcaataactattactccctagcttcagccttttcttgttcactggcaaatgccagtgcagctcagacattagttatttatccatgtattcatttaacaaacatttttgagtattgagtatgtgattggcactgtgcacggtgcaaatgatacagaaaatgagtaagctcctctctttaataagttcatggtatagtgtgtgtctgtggcgagtctagagatgatggtgcaaaagagtctttcaattaaacagacaattctaacgtgggatgataaatgctctgtagtgagaagcacatggctcatttggatcataaggaggggaacttaatgcagtctcagagggccaggagaggctttccagcagaattggtatctaagatgagtatgagttggccaagtgagagttgagggtgagatggggtaggtgtatttcataccaaagtagctgcctctctagaggccatagagcaaggaaattgtataaggatcagtgtggaaagtcaggcagggggtggccagaagcaaggctagctaagggtgaaggagtcagattagcaagggcctttcctattatgcaaaagaactttatggctctatcctgtcctactgggcggagaagccctgaaggcttctaaacagggtttaaaacacttagatagtttttcttgtttgaatgagtatcttttaaacattatttctaatttcgggcagaatttactacttctacctttgggtccttctgtttctctataggctcctatcatggcactgtattgctttattgaacttaactgtttctaatcctgcctttcctgggagactgagggcttcccaaagattgttttttatctatctctgtatccctaggatctggaacagttactgatgctgctgagtaggcattcaatggaagcttgattttaaaaagaaaagttgattttagaaagaaagcattttttttcttatatttttaggacaaagcattatcagataaaatctggcccatcaagtcagcaaagtgagtaatcttgttcactctgaaggcagtgtgagctccatgaggtgctgcccaacagatctctaatccacctgtccttctgtgtgctctttattaatcactgcatggcaagcactgtgctaggcaccaagggagatataaatacgctgaagacagcattagatagttgtgaaaatgttacatatgtacacaaaacaaactcaatatcccgagggcctagcacagtggtggtattgctcagtcctcagtcaatgtctgtgaataaataacaagtgaagaaagggagagtgatatgtgtgaaatatatggaatacataataaatgctccaagagtccagatgtgggaaaatctgtgagatgggtaaatctgatagggtctcattgaggtgtcctagccttggaagatgagtaggatctggagagatagaaggaaaaggtggaggactctaaagaacgagaaatagcatgaacatcacttcatgcagactaataatgcctgaaggaaatataagccattggaaattatgaaagctctgacaacaattggagtatattggaattcacacaaatgaaccagttttctaggcatattgtaattcggccaatgaatgtggggagaccagcagttgctttagcagacagccaaagtgggccctcgtgacaatgctaattaaagcaaagttaattagttaattaaaacagaagtggcaaatggcagtttctaaatttcagttaaggtggaggcaacactaatgattctgccccctgactagaatcccaggggagggttttgacttctgagaaaatttataacttccagctgtaggtctctgtcatcaatttagccatgaaaggcccattgcattttagaaccccagttccatgtgcctggaaattctgaatcttgcagagctagaactttagattcatcagattcaatgctttatttaggtcagaactggccttgtgttcatttgtcaatttgcagctgaagtgaatgccttaaacggaagcctggcattatctgcttgacaatgatttgatgctgcaccatgttgtgctggaaattagtgtctagaaccaaaatgttaatcacagggacctctatacattgatggcataaatagcatgtttccatataaaaaaatctgtagtgactcatttccatttaaataaaaatctccctttgctatttcagtgaattgaatggctgattccgggcccttttctatttgtgctctaggttgagccaatttaacttcacagaaaattgttggatctgttagaattacctctgttgtctccttaggtgctcagagagctcaaagtgattctttctccatgatgagaggtggaaatttgcttcgtctagcccccttctcactaaagatatgaactactcttcaggccccataaacatgtcttctcttgggtctatgatgatgttttccaaagtaagttctttggagcatcagttcttcagaatgttaagaggtttacttggaaaaaaatggtcttgtatacatgtttgcaaaatgatagaaagagttaacaaatagatgataggtttctacagtgcaagacttctcagtgtttatctccaataagagaatagagttttttcacctttttgaccaaataatttctttttcatggagctatttaatttttcaaagaatatactaattttccaaagaaaacagtccatatatgcttagctctagtaatcatcagctaagaccttaatttaaaaactgctccattactcattagtcatgaaacaataggcaagtattctcaccgtgcaggacctcaaatttcccatctgaaaaatgggaggattgttgcttcaacttgcagtattttatgacaattagaaatgttagactagttatacatacaaaaagttctgtaaggtggcagaacatagtaggtaggtaataaatgaaccattttgggggactactctgatttgaaacttttttccagtctcctactttgtgctccacttcttcttacttctttcctcttctttgctctcttctctgttccattcctcttccttctgcgactgctaccaccgtgactactactaggtgctaacattttaggcactatgcactggattatctaacaaacacctgacacgccattttttctttccatttccatgatagagatggaagaggctaaatgtcactttcccatattctcttatattagacagtttgggccagtgagacacaagggcaattcttatgggactctgagaagacttttgttttccctaatgaaagtacacaatgtatggaaccatgacaactatattacaaccattagtaaaaggcctagagaatggtagaagtgtttgcctttgcatcactgaaccaacacccgaagaaatctccctccacaatttttataacatgaggaaaatgaactctaaagagtataagtgtttgaaaacaggctttctgctacttgcagacacaattctaaaaggttgaggtagcatttattgaatactttctacgtgctggtactaaacacttaatgcatattacctcatttactactcaaaataggaattattatctaccattttacagttgagaaaacagactaaagtgccttattcaaattcatagctgaattgaaatccaggtgtggttccaaagccagaactctaaactagtatgctgcctttgcattttccatctgtgtacatacacctttccaggagcctgtacaaacttttggagacatagttaccataatcttagatattattatagtcttcattttgaggtacacaattagtatcctctttaagatagagagcccttaccatctgccattccatgtggaagggacacacacgaccccatccagaaacagagggcatacccaatctcagattatagcagcctgtttcttcatacacctgacagaggacagcagaacagggctgggtcgagcatggtagatgcttctccaccaaagacctacatccagagactttatttacctatttaagcccacatgacatcccaagagatgggctcaatagcatattaaaattttcaagactgagaagcacaactcagggaagcaatttagaagaaaatgtaaaaatattagaaatacctgaatttatttgtttcccattagttaagctgaagtgcggtgaaccatgtgttatacactggcttttcataaaagtaattatcaaatgggagctgaatccctgcataaccagctatatcctatagtgtaataaatatgctaaacatcacagattttgtatcacagagaagaaatatttagttttggagctcatggaagccatagaggaaaggaattttagtttgcatctctttctaatgactgtgggttaaaaaggagagcagatatcagatgcatgtgatacaaaagaattatagctttccctgcccctttttcttatccatatcaaaagcaggttctagcttgaatatgccagttgatgtcaaaaaagaaatctccatataatcagactgtggcctgtgtcagctataatcacatagacagatcaagatttgccaagattgcagaaagaagaccaaacacttgccaaaggtttctctttaccctctttcagattctaacatccaaatgcacagatttcaaaaaaactacatggccctgtaggaaaaacaagttaaaatattgcaacaaaaatctttagaatttccgttttctagtggttggcactatcagtaaaatttgttgcttttgtttgtccctttgtttattaaattagaaacaaaacagttgaaaatatttattgaatgttactagagaaactttataactatagtaaagcaagggatcagtgatccgattctagagcagagactgatgaccacaggagtgagagagatatctgtaatacagggcactgttgccttaatcttataaaagttaatagtacaactagggagtaagagtgtgcacatttgaagacaagcaaaaaaagtacctaccacattaataccatcccaaattcattcaacaaacataccaaaaatcattattgagcatattctatgtgtcaagcacccttcaaggtacaggtaggtattggaggcacagtgatgagcaaggtaaagaaggcctccatccctaaggagcttgctctgcttaaattggaagacaggatgtgctatacagaatggcaaagagctggacaacatgaagatcgagatgccctgtaaaactcagattgtataatcaatgtctccataggtttgtgctgccgtttatagtgctgtctttgttattaagatcatccagattgtgtattgggtacagtaactttcatgagtaaaagaagactgacaatggttaacttagttaatcaaaatagcaaatacttaagaagggcttactatgtggcagacactatacacatgttaacttattcagtcatcacaaccagtctatgaagtatgcatttctttatctccattttttcggaggaagaaatcaaagcatagagaggttaagtgaatttgcctaaggttctgcacctgctaagtgatgctgccagtatttaatcccagtgctctccagcactatactgtgctaccttcaataaagtgcctactatgtgccagccattacacatattatctccttcattttttacaatccagtttgtcagatgatagaaataaggtgcagagagacaaagtagcactgctgttgttcaaacccaaaacaatctggctaggcagccagtgttctctgccaccactccatgctgtctccctaaggggctttctctagtgagttttttacgtgctcagacatagactcacaattcccttcctccatcaatatgcttgttttatataccaggctttcctgggagattctgtttacagataggacttgaagaaaagctgataaaacaaaagtttgaaaaataaattttcttagccaaaaggaaaggctgatcttgcagaaatttcagaaaaagaatggttcatacaggagtcaggaaggcagatggaaaataggccagcaggttagatatatgaaaggcctgctgtgtacagaccatgacattgccaggatttattgaaaaagaagacatgagttacagtttaattgaatgtcttgtacaatgtacgtagaaagagatgagaagtgtaaaacaagtagaaaagagttgaaagaggtaagagtacaagttaataatgtaaacgaattggaccttgtggataaaattcaactatcctctgatttattttcaaacttcagcagacatagtatctttaccatcataataagtcatactttgaagatttagggctgacagaaaagtaggactttcctgcaggctaagtgatagtataggagaatagttcaagagatgttatttagatatgtagcttccatttgaaatctacatatcttccatttatttatctagattttagaaatactgttaaatttcagaagagttagcagggctgatgtcttgaccagctcttttgattacacattacacttcttaaatagaggtgatacttagtcccagttatcaacaattggtgttgcctttttcatacttcaacatttttcccaagccactgataacatgatcttgtcttttgaagtgctttgggatcatttatcacataaggaagttccttatatgggggaaatcattggcttctggctttagattcttttcagattgaaatggtcgaataactactacctgtgatattgaacttggggtgggatgagactataggcaacaaagaattgggaaaatgactggttgtttttatgtgcaaagtcactttgttgttttgcccttttcagctgcttagacatctcctaaagatttcatcttgcccattaagaactaaaatataaatcctacattcttgtgcctctattggatgggcatttaagcactcttctggcttgaataaggtttaggcacgtacaagtgcagtctgatgtgtcgagttcttggcattttgctctcagtataatctttgttagtaatatatttttactctgttctggtgaactagaatttaacccacagtataactctgtcccctcagaacttgagggtccttgccttggctttgtgagctaactctgctctgtctgccctctcaacctcactccccctacgctgtaactctgctttattagagattttgacttccatgtttctagacttggcctaagtaattggacccacatcccattaaccccataaataccattttatgagaaggtccatgccgtaagtcaccctgcctcacatggtttcatttacccagatttctcccatttaaaagacccaggaaacacatgcctctgctccagttttaggggccagcatccctgtaagcccccacaacttttaccttaaggtttccccagaggagccccttctcttccacaggttgactaggctgctggatctgctggctgcggaggatgacttgccatcccctacatgcatgcgcaccacggtagatgtggtgaaggcgctgcgcacgtttctctctggtttggccaggatgatgtacaccttcggcacaaacatgcagcctagggccactgtggcactgaggctgaccgagaaacacatggtgatgattttgtagttgctgccaaagtagattggcacaaaagctagccatataatgcaggtcgtgtacattgtgaaggcgatatacttggcctcgttgaagttagctggaacatttctggtcttgaacgcatagaaggtgcagctcaaaatcaacaatccattgtatccaagtggagtgacaactcctaggttggtggtgttacagatcaggtagacttctcgaatgcttgggtagtcatgcattatgtcaggaggctccattataaagagggcaacgatgatgcccaactggatgcatatgagaatgaaagcaatcactagctgggcacaggcactcatgaatctgggctttttggtacagatcttcttcttgctgccagccaggatccttgcaatacggttggtctttgttacaagggctgagtagctcatggctggggagagaccaatgccaattctctgaaggtagcagtaaatctgtttgggcttcgcaatgaggcagaaggtacataagtagcccaggcagatgccagcaaggataatgtagcagagttccctgcttgaggacttgactactggtgtatcacggtaaatgatgaagactacagtaacaaacagggtggccaggaggccaaggcaggcaaacaccacagctgcaatgggttcagggtcaccccatcgaagatactgtactgggatcaagtcacaacctgcagagacacaaacacatattgtaaaggagggagagatgttgacttgggtcacatatccctaagttacaagcagctgtttatgaccatttcagtttgttccccatctacctttctaatttcagaatctcctgctacttattgtttcatgtattcattcagaaaacgttaatgatgatattactgaacatgtacatggtctgtgataggaactattctaggttctgaaacaaaataatgcagaacatgtttcctgctctcataaaaaaaaatcagtggccttttaaacaactgtaactgtgataagggtcatgaagaggtataacatgggttctaagcagtctcttgaagcagcaaaggcctcctacaataggaatgagcaaataaatgtgttggtttgatggagttggggatttcatgggcttggcaaacttacagttaaagtacattaactgtaaggaagagaggcatgaagggaagccactgtatgacagtgtaacaagtggcctaagatgaggctgggaggtagggaggaaggggatcttgcaggttagagaatcctagatcagtaggaagttattctaaggatctttgtagagcaatgacaagctcagatttgtgtgtgcgtgtgtgttttaaacatttctttggtttctgtgtgggttttggatgagataaaggtgtgcacacatttaagacttattttagagccatatagagtgtttgaatggatgtgggagtgtgtgaaaagtgaaaaagatatgaaatatgaccaacactagtaaagaagagttggaattttcagagaatcttgtggtctagatgttttagaagattctgttaaaaaaaggaggaagttcatttttataagaaaactgaccccaaaggcaaacaattggcaggcaagggaagtgcaccactctcaaaatcgttccttattctttatttatgatatggagtttttaaattattccttgattatatagcagaaaaatagtgacagaatatagcatcatttggattatctgtcttttacaattttttaggacagtggttctcaaagttggctacacactagaatcaccaagactatatatatacatatttacacacatatataaaatcctgagacctgggtgtcccattggttgagcttctgacttaatttgtctgagtgtgacatgggcatcaggattttttaacaatactgcaagtgcttctaatgtgcaaccaaagttgagaaccattgttctaggaggatcattcctgtcagttagacttgaaagaaaatggacttgagatagcttcactgagtaagtaggaaaggaggcaagtaatctggagcattgggcatttgaggaatgtagcagaaatgactaattgcatgtcaatatctattctccccttcattctcagcaatagacctctaatttcatttgggatggtaaaggcattagttacaatactacatttttcatcaaccattgctgtgaaatgtggcataggaataggtttcagccaataacatgtacacagaggattcctgaaaggaaaatgactcatggtagaaagtaacctttttcccttctttactttcttcttctgctgcctggcacataaacatgatggctacagctccagcagttgttttggacttcaaggtaacttgaaggacagaaaatgtgttctgggtttggaagagaaaaatagagggggctccactccctgagaaccatggaccccccactacctgtggactatgcatatccacatcttctttgtttaagctcctttcatttatttattttcttgatatatgcagggaaaacaaatcctcattgataaggagtaaagttttcctattaacttgtcctatcccatgatcaagggtgttgcagtcagtggctttgaatatcaatggttactgggaggtaggggaggcaacaacaagtaatgacagcaaggaagcatgtagttctttcaaaatatgcctaagggtagcttcgttgtagaaagggaagggaagaagggaagggaagaaacaaaggaaagagaaggggaaggggaaagggaagggaagggaattattcttccccttatttctgccctgctgctgttttgctttaagatctcacatttcagatagtactattagtactataattaaagtcataatggatttaataggagttatgagctagcctgggattctcagcacactttgtaaaatgtttctatgggaaaatgtattcttactctaaataattgtgcatttaatattgaaacaaagggctttaaattttaaaaaattgtggatagctcagactaaatataactaaatacaaaacagttgtgttatatgacctcattaagtataaaaatacatatctcattgctaattaatatacctatatctgtatttctagtcatctacgttcccatgtgcttcctatatagttggaattcaacctctgatactttagtatgccatagagtttaggcttatatttacaaatttgctccttggagaggctgttttaccaaaaaaagtattaataatatatatatatatatatatattttttttttttttttttttttttttgagacatagtcgccctttgtcacccaggctagagtgcagtggtgtgatcttggctcactgcaacctctgcctcccgagttcaagcgattcttgtgcctcagccgcctgagctgggattacaggcactcccggctaatttttttgtatatttagtagagacgggatttcaccatgttggccaggctggtcgaactccttgccctgagtgatccaccttcctcggcctctcaaagtgctgggattacaggcatgagccactgtacctatcccattcctatatttattattttatattagttcatttatagcaatgatttgacaataaaatttattaaatatatagaggtctgtttctactgctaggtcatgtgctgctaacgtccatagcaatttacttatataggaaacgttatgtttgtatatagggcaggaatcttttcattacctaaaagaatgagctggaaaaagtaattaaacacttaattttaccccagtttttcctactgttctgctaaatcttaattgttttcatcttaatgtaattaagtttaatttctaaatactttgcatagaataacatttactactatttttatcagatatatttttgaactcttcatgttcagcttattaacatctgtgtgaaactaaagaaaactcattagatatatgtgttaaaaatgtacatgaggcttgtctctaatgtgatgtaattattttcccaaatctttcaggatttatatattaaatgaatgcttcttttatttaatgtaaaccatttagaaagtcttacatttagtttgatgccttcattgcaaaaaatactgttgtaactattctctaagaatagcaaactggactctgattaaagggttataatcactgaatcttataattgaataagatcttagagtttccaaaaaatggatgcgtatcacaatcacttgggaagcctacaaaactgtaactcaggagtctaaactcagaagattttgagtcagtacattgtggtggggcaaaggaatctttattttgaataagcaacttcagttatgctatattagtctttggtgcaatttaaccttagagattatcaagccaaattcttacccatcgtgcaaatgccttatatgataactccaagatgtaatcatcctaaccttacttaaggctttttataaaatatatcatctcaagggcaggactggtggtggtgtggggagatagattgaaaaggcaggaggctgtgatggcaagtgaagactggaaatgaagaaaccagtcagaagactatcacaaggagacagggatgataaagacaaaaactaagtaactgtactagagaaaacaattagttggtaaagacatttcagaactggaattgaaagaaattatgaagaagatagaagaatcaagaagaaaggctttgtagctgatagcaatactgttaactaagatgagggcttaggaagcaaagggtcacatttcatgggaatgatatctagctccagtttgagcatgctgtttgtactgggtctgacctagtgagctttgaaaagctatcagtgtggaagttacagctttaggaatcatctttttatagaagctgaaaataagagacatggaaataaacacaaccaatgaggaaattcttagatgtggatgagagcagagcctagcagtctggtgtaacaccaatactaatgaatgagagagggagagaatatgtcagagaagatgtaacatcagacagaaggaaggaagtgtatcagaagccaaaggaaagtattaattggatggcccaccacagtctcctctaacaatatcagttctgttttactttttaaaattcttacccaaatagcttgcacaaagcttcaagcttcaggttcacagatatctcttctgacattagataattatatgtttttttcccttcactagtattagatttatttcttttgaataagggatattatactttctaacatgaaacaaggtctaccaaatctcagaatcttgaaataatgctaacctcattatgatataaatttaaattctcagtgataactacccttactatgtacacagttgtacaaatatctgtgtagttattgttcctaacttccttattttcttctaatcactgggcattttttccatcaatggttgtattttttatccctgtttcatccttactgtaatggtaagttactggaagtgtatgtagaggttacctaagagtctaaagcgcatataatgtatagttttattatgaatttaatcaatttagcatatgttattatattttaaattaaataatcttgatcatgtcagtgaaattccttcctaacaagcatattgccatttctctggttctcagaaaatgcacagtattatattattttctagaaatgcagatgaaacatggattagaaaactgcggtccattttctaataacatctatttaggtatctattcacttttaatttttcttcccttttatacttgattcgtaagtctgtggttctcttgtataatccatcttttcaaaacttgaactgacatatattgaaaagacaagtttttctttttttaaagagggaaagtgagctgccaaaactatattgtccactttcattctattacttcactaatgtgttccccataagtctaatagcagaatggatgatctactgattttctggacccctaaaaatgatgtgactcctcattcacagctggtactcatgcttagattgttagttttgcagtattaatattcctgtagttactagtttctagactgctgcatttttcaaaccctgttccaagtgtctcttcagggagagatgcctgatgttctgtaaattgggctgaacaagagctccttaccaagctcctacattcctgtatattttggataaaggaagttgctgtttagaatctctgagaataagatgtatgtgctctcagctgctggttaggtcatttcaggtatacaatgagaaggaagatataagatagattataaaaaactgatctattaaaactaatatggggatacagaactgacaaggggctgttgtgggtttcctctttgatatttgagcaacagatctgtccagagcacaaggtgttgactggtgactaacaacatcatgcttgctttccatctatttaactaataagccatctttctgcctttccttctttctttacctctctggatttggatctcatggatgttgaactgggatcacagggtgatacagaatcagaattctgtgtctagtgttcatatccctgatcctttaatattttttctttacttagcctgagctaaagtttttcatcacttccataattcagagaatttgaaatggtgggtgtctgtgtgtgctgtgagacattgaggaaactcatttctctctgtagcacttactgtatttataatctattttgtggtagggggagtttgattgactgtatcattaaggtctgtcttctctacttgactagaagcaccctgatgatagggagtttgtctcttttgcacacaaacgggtcctcagtactgagcacagtgcctcactcatatggttaatatagcattttacaaattaatatattttgtatacaattaaatatagaattctaattctagtgcatggataagtcattctcaaaaaacttttgcgttgcctttagaagtcccaagttacagaactattatgtagtgttttaggcagaagtctaaaatcaattcactacacctgaatttgagtctagtttctggaacccaaagagggcaaaactagataagcagctcaaaaacttacttctgcctagggacgtgacatgtttcatattagaaatattcctcgtgggcaggtgcagtggctcatgcctgtaatcccagcactttgggaggccgaggtgggtggatcacaaggtcaggagttcaagacaagcctggccaatatggtgaaactccatctctactaaaaatacagaaattagccaggcatggtggcaggcacctgtagtcccagctactcaggaggctgaggcaggagaatcgcttgaacccaggagatggaggttgcagtgagccaagattgcaccactgcactccagcctgggtgacagagtgagactccatctcaaagaaaaagaaatattcctcatgctgactagtcatttgggacattttttatgactgattaatctaattttgagtaattcattggatctgggaagtatgtatagaggaaagaatgagacagtaaccagtaaagtcattctttagaaagtgccatccaactatgaaggtcagatagatgtacttttcttaaggaggctgttaattgtaacttttcttttcttttttttttttttttactttagcatagaaaaaaaaaatagaaaagttcccaagttttcttcaaggaaggcatattctacagttgattgatttttaccttagcacgaaacaaaacatggcatgattgctttctccaataaaaagagagtctttatccaaggtgttaagcaagttttattggtaactgcctcaacaggaagctgccatattcctctttatgtcagtatcaaaagaaaaaagagactaacatttattgaatgcctactatatatcatgtgttattccagaaattttatgtaatcatcataataaaaaatgaggtaaatatcattatctctatttttcagagggggcagtatgaagcttaattagatatgttaactttctgggactgagattaaaactctgtggttatctactaacttatttatttattttatctttgctacatcaggggaggcaacttggccagttactcctctgaaagaagtcctgagtctatttagtaggaaacagaatcatgattaattaacaatgtctgcatgggcaaggtggggctagtggtggcataaatatttgatagctttatcttgatataaatccatgcttcctcttgagaaatctcattggttcaaacccttcagcaagattttcgttctgggctatatgtccttagagttgctgccagagacactgattgatcagttgtttttcttgggttcctaaagttttctagcatagaaaatgttctgaatgatcattcatgggacattcccaactttgctacagagtagactcacagccatccatttgtcattggacctagcctattccccatccttcaaggtttattacacatctcgttttagattccttaatagaattccttcacagagctgaaaattcacagctatagtttttatttttgttttttttaattggttatattttataggggaatttgaaattgtgtgcaaagatttattttataattaagacataaagaatgatttaatagtactgcagagtactaaagggaaatgtgatcacagatgcacatttgtaggaaatagctttgaaaaatatgacttccggtcatactgcacatggataagagtggaaaaacacagcatgtgaatttaaataataaagcgtgctgactggaataattccctccctttctacttttctccagtccctttttactagctaacttctccttattcttctactttccagattctccttgatgagtatgacttttctgattccctgaagctgactgacaggttcctctcatgtggtcaaatggctccctgggcctgtacccgtcatagcacttgcattcttactaattgtgtattagtattgtctctttgaaatggtagatttagcaatttgagaggaggagactgtttctttgcttgttgtatttctagtgctagtcatagtacctggcacacaataggcagttaaataagtttaatgaatgaatgaatgattaacaaagaagagggcaagtaaggaataaggaggcatgcccttcattttcagcttgcacacaaatatttcctattaatatgagccttttactctatgtctcaattttttcatatataaaatgaaaataatacagacttatcttatctataattagggttttaatctggagaaacccttgcagaagaattcacagatgagaaattaaagaccaatgacctgaaaaaggtcagtgaagcaatttctcagaaataaatttataaaatgcttaaagttgtttttgtattttattgaaataaaacattaaactcatcattttaaaaccgatagggtatcagtggaattttgcacacataataggagctataatttggattttacgattcatttctatttatccttgctagcttgccagacccttgtcaagatccctttcctgcagttttagtcagactcataaaattgcttattttgcaaataagctgcatactaaaaagcactttcctactgtagctggtcatccatccaaatgttcaataactttctgattttgtgactcagaattttgcaaccactctccaggccccactatattccttctgtgttcccatatacccttgattttttttttcctttgaggcataccaggactattctaagacctgaaattacattacctttcctaaggaaggttgcaaaattgtatgcatattctgccacagattttacctcctttttctctttccaagcctatttgttcctaaattttaagtatcgttaagtattctccagttgagctatgggcatacatttaactattcaaatgctcatgtttattacagaaagaaaatatggggacaaagtgcacacatgtaagaaaaatgtacaaggggaaagattaatgcctcatcccacccattaaagagattgaacattgttcacacagcacagctacagcatttcactcttgagcacctacaccattcataccacttggtccacactatggtgatagaaaggtaattgtttgttcctttaaaataatgtattgaccaaatgctcaggctctgtgactttactctgctagtcattgtattgaacactttattcttattaccttctttaatacctacaaggtcctcatgcgatagggaccattatttcatctattttcagttaaggaaactattttctgttggaactaaagagcatttgaaaggaaccatagaaagagaaacacagacatagagaaaagcagaagaaatgtaaaggaaacagccaaaatgcaaaagtcagatatgcagaggaaaaaactctacagcatagtaatgtatcaagagaattacaatgtctttgggaattattgctgatagttcagatggggaattagcaaaagctttaggagggaaggtgataatacctatctgcctacatctcaaggattagtgtgaggaccatataaaataaattggacagtggcataataattatgaagtgagagaaagtggaaatggggaagtgtatatacaaaacggtgtgactcaacatctgctaaagtgcctgttttattagattatcctttattattctggggaaaagccaggctactttctctctctagcttgtttaggtatgtgttgccccaagtaaatggtattatgttgtcttaaattgtctgtaagtacaagacagcccataatgctttgaatttttcatcacctcaattaatgtgattttttaagaggtgtcaagataggaggaatttatctgcttcatattactcatataatatatcaatgctttgtgaagcattttccaagtaggttagataatgcaatagttagcactgtatcataatgtttcttgttctaaggggaaaatgtgataatttattttgggtaagctacattgaccaaaaactgaaatcaatgaaatcacattattgtcttcagtctggccatgtcagagtggtttttgaccacaatgccattgttttggtcagaccacaaatttatcattgtgaagaagaacatggtgaacatttttcatcgagtggtttctggcaagatgaaaactggtttatgttcttttcagggacctgttttgataagttccactaagagaggggctttcagccctttttttcttctttagtcagtggcgtttacaagtttaaatatactgactttttgactcatcttgtaggaagaaaattattaaaagttaatgaacgttgagaaattggaagagtaagaaggcattttagaatttatcaatgtgtaagccctggaatctcattttaaaagaaccagaacacaacattgttgtttttagtgctaactgaaacaactttatcaagctaactgtttgaaaaaaaaaagacagtgcacaaaatttttcattgcattttagagatcctgttagaaagaatccattgattcacaatcacttccatatttcctgcagcatcatgtcaaggaaaaagcactagttttacagaaagatgaaacagggtctgagccttactctcctgcttactgtgtgatcatgagcatggatattttcaattttcaaactcaattttctgtaaaatggaaatcatgattccaaccttttttaaagtttatttttataattttaatttttatgggtacctagtagggattccaacctttttgagctgtcaggaggattaggtgatagaacacaaacttcctattctgataggtgacaggtactcaatacatggggatttcttacctttcttccatcctgtattcacttctttagtgaatattcattgaatatctactgtgttctagcagcctggtattctcaaatgaggaaaatatacaaaagttactgtattttggcttatatcctagctgaaggatcaacagtatatgatcagtgaaaatacattaacacataaacaatataaaatagtatgaggtgatataagaggtagagaaaagaagaggtagaactggatatgaggggggttagtttgtagtattaaacgggttgctcagggtagacatttgagcaaggacttgaggaaggaaagaatagtggtcatgtggttatctgcagtaaagccttccaggcagataactgctagggaaattaccctgggataagagcctttctgaccttttaatggaagaacaaaaagaccaatgtattgggaggaagaaccagatgaagtgaagggaaaagtaggtcagacacatgacagaagaccaggtcatacaaaacaggaatttgtaagtactttggcttttactttgaatgaaatgggaaatcattgtagatccttatacaatggagtaacatgacctggcttattttgtaaaaagatatctctgcctggaatgttgaggagagactgtaagtaggggcaagggtagaatcaaggagaaaagttaggaggttattttcagaagaaagatgattaatgatgattgttagacacttttactggaggtagtgagaagtggtggaatttgggatatgaaggattagccaatgggatttctttactgactaaaggatgtgcaagacgtcagtagattgactccaaagttattggtcttacctaatgaaagaacgggtttattatcagatgaaatgtaatagtaaggataaagcagcctgggagattaagaaggtaaagacctggatttcagtgatggaagtgtagaatttaagatatctattagatattcaaataaatatgtcaagtaggcaatggaatatttaagtctggagattaggtgagagatctggacaagatactttacatcaaaatgtttattgtgtagatgatatttaatgacatgaatgaaactgggtatgatcaccagtgaagcaagtgtagacagaaaagaggatcaacactgagctctggagcacttcagcacaatagccttcattttatttgaaattcataaatgtaaaaatatcagtggcaatagatgctagatcctttttgggaaggttatttttttatttttattttgccagtgaggaaaatatcaaaagtgtataatgaagtgatcagtgaaactagaaaccttttttatcagggacaatgataagatagaaaaacaaatggcaggtgctgtgtagtattgtcacggcttacggctttctgggatttccaagtcaccattaaacttctgcaatttattcatttagaatcagaagggctatgaagctaatctaaacgaagttaaaagagatgtttataacagtaagcttagttcaacaaataaaaattgtctactctctgccattgattgtgctagacagtcattgacttaaagggatcttactttcaaatgtagaagacatttaataaacacctgttaggccaggcacagtggctcacgcctgtaatcccagcactttgggaggctgaggcggcctgactaacaaggtgaaaccctgtttctactaaaaatacaaaaaattagctggcatggtggcatgcgcctgtagtcacagctactcaggaggctgaggcaggagaattgcttgaacccgggaggcggaggttgcagtgagctgagacagtgatgtgccactgcactccaacctgggcgacagagcaagattccatctcaataaataaataaatttaaataaataaataaataaacacaggttaaaactttccccaaattttcttcttcattcattcttaaatcaatccatctatctctctattcatttttcatcactatattttaaaaactttattaacagtagagtgataatagtattcttgaacagttaatgcatacgaaactttttgtatgctataaaatagctctaataatcttatgaactagttactactgttatctcaattttatggaagagaaagctgacactcacagataaaaatttccgtgctttaagtcgcacaatgagtcactggtggagtgtgaatttgaacatgggcatgtttgactccaaaaccttttgatttaaaccactacactcttagaagaaaataaagatgaattgttgcagattggtattttatgcagcacaaattctcagctgtactttgttacactacatttgccataaattcaacttccttagattgtactggtgagtgtgtaatgtagtgaacttatctagagaaacctaaaaagtgcttagagacctgggaattctattgttaaacaaaagtcactttcttttacagctgatcaccattatgatgtttggtatttaggaaaggatagttcccataatagaggctttgatgaaaaagcgaccgtgaaatggtggtgtacttgctctgaatgttatattggaaaaaatattttgagacacacatacattccttagatatgacatgtatcattccttatggtctttttttctgcctgaaaattcatttctgctttacctggttagcatcttattttcacatacatgaattccctttccacccagaagctacctctgaacttccaagacctggttaatttcctctcatcaacgtttactcccatcctagcactttctttccttccttcattcatttcttcatttcctctcctctcttttattccttcattatacaaacattaaattggttcctacactatggcagggatacttaatgtattgaaattgcctctttatttgcatatgtctctgcctaggctctgcgatacttgggagtaggaagtggggctcgatcaccattgtgtgcccaatactggatctagtgctatgtttggcactagttggaactcaaatatgtgctaatgaataatttcatcctttgtgccaccactgcatttggtgtgtggtttaactattgtatgcattatatgtataatttaatgcaattatttaagtaaggttaggtaccttccatttatatttgtatcatcagaacttagcacagtgttaaaaaaagagtaggaatgtgataaaatcttttgctgaatgaattaatgaatgatagatagccagctgtatagcatatgctcctgttcagattactatctaacctagaaaccaagaagctagatagcagaattctgaaagctattccagtttcaatattaacaagaaatatttattaaaattgtaataataaactaaacttatttctcatcaaaactcatcagaaatttcctctaaagaatcataaacaaataatatttaatagatgccaagaattttccctcctttcctcatctaagtttaattataatagtcaaataacacattttaagcacatttggaataaaaaatatcagagcagcctggagataattaacatgtgaccagcttgaagccgattttttttccttctataatttcctgaaaatatggggctctaaaatgtgattgtggagagagacaggtagtatagcataaaaaccccagaatcatagcacctgggatttcttttccaccagttttgtggtcttgtccatgtatagaatgttcctgagttttgtttcattcaactgtagaataataatctcaaccttaaaggattaaaaaaggtaatgcttaagatagttataataattggaaatgaaaagaaatcttccccatgtttttatttaatgtgcttatttattaaaaggcaaaaaaaaaaaaagtcccaagaaaagtaggacaagctgaggaacacaaattaaatgcacatttgtaaaaagagagcaattccaatgcgggagttataaaacctgccagtggttacacctcttggagctcatcctctgctccctccttgattcttaccaacatctctttgtttaactctgcggcttttttcctcttaagtgaagagacaaatgttccaacctccaaagcaattaggtaactcagggaaccaaaggaacttcctagagaacgtccctattgacattaagctgttgatacatattgccttggatggaataaaatggaagcgttttacagctttggacttacgtaagatacatttcttttatgattgaaaagcaggagataatgctaacttcctgtcataggacttcccacctggttacttcttgaaagacaggctatttttgctctttccttttacttagtttattggaaggttggcagcatctggtaagccccacctgtaagtgtttctgtggctttggactggggacctaaagatctttagagctcttactacttatatctcctcctaaattctttgatacaaaacaaataaaaaattctttctaggacagtttttgcagatatgtggcagggaatggtgtcccagaaaaagtgtcttggcaaatgcttttcagataattctctgaacgtctagctcaaattgttgccttttattactttttctcctttctctctcaaaccagactacatttttctgagaactaattaccttgttctattgattttaattcctaatcaaatctttgttgcttttgattcacattacattatccttacccaaaccactggtagattcacatggatttttgcaaaattttcttacccttatcctctctttataattcccaacttagtcttatattttaaaatcttatcttttagtgttaaatatttaaatagcgcaaatagtatggaatcatttaaattataaaatttttaaatatgcagagaaaagtatatggtatggaacaaataaaatctatattaaaaaatgttaatattttgtcatatgtttcaaattacacacacacacacacacacacacacacacacatgctaaagctataactaaaacctattttgtaactcccatctaactccctttcttctcttactagatgatactgctattctgaaatctgtatccttccttttcatgtttttatacaatatctactcttcacattgtgactatgtaaataatatttataaagcagcccatcatgattgcattttctttcttttcttttcttttctttttgtttttgagatggagtcttgctctgtcacccgagctggagtgcagtggcatgatctccactcactgcaacctctgcctcctaagtttcccaggttcaagcgattctcctgcctcagactcctgagtagctgggattacaggcatgcaccaccgtggctggctaattttttgtatgtttagtagagacaaggttttgccatgttggccaagctggtctcaaactcctgacctcaggtaatccacccaatgtagcctcccaaagtgttgagattacaggcatgagccactgcacctggcacattttctttcatattcaatttttgaatattcctggagataatcaccttgcttaaaactattctctccactagaatgtaaacattataagaacagataattttactggttttgttcatagaaatattttcagcatttagaacattgcctgagatggggttcacaacactctactccaaaatatggcactttggcatattgaattttttaagctgaaggaatttgagaaacagcaagtgcagaaagactttatgtccttctcccacccttcacccctgaagcaggtcataagaccctcatgtgagaggtgcccttcttagacctggagggaaggagcatccctatctcagaggagtctgaaggaacaggccttgctaagtttacctgagtttacttatgccctttgtcctatcttctttctctacaactcttcattttacatcaaacctagcatacgaacagccaggtttaactgcttcttcaggtccttaggaaggttccagtgttacataaaacttatattaaataaatgtgtatgcttttcttttgttaatctatttttagttacaggggccccagccaatgaacctaagatggatagagggaaaatatatatttcctcccctgcaattggaacagtgaaagtgctagatacacatttattgaatgaatgactagatgactgaatgaataaatctttttaaatttcccttaagataaactttaaaatatttaccatagtttaccaggctccccaaaaggtggcctttgctttcttgtctcatttctcccttatactctcagttccatttcagttcctgtgttctgtgtccacaacactcttctctttcattttagtttggccagctcccatcattactccaatttttgcatgcccacaattcattgaagaggcaattttaaatatcacctaagttagcttttactgttatgggctctcacaccattctggccttctctgttgtcaatattcagtatcttattattactttcaatatttggaaaaattatctccatgagggcagggatcctctttatcctatttactgctagcataggtacctgttaattataagacaaaggaataactgcttgctgtcctcaatgaaaataagttgaattgaggacatgggctatgttctgacctcatcctccatttatttctcatttctttcatgtcttcttggttttcataccagattctttatttgtctacctaattctggtgttcctaagaatttatgactgctattgagaatatggctggcttaaacatcattttaatgatttttattgatgaagatacattctcataatatcattcaatcctctgcatacatgtttacacacacacacacacacacatattcacatgtatttatgtgtaaaaaaaggaacctgtaatcctaccacctgtaaacaccttaacgttaggtagccttcatttaggatatttctatgaaaaaaatatatacacatacaaaaagtatatggctaaatatataggtagacattaatgtcagttgattgctactttaagttgttttctgaacaattgtttaattccaggtgggctgagatctcttagccatgctgataatcttataggattgtgttgacataaaatgaaataacatttccaagatgctgcaaacagttcctgtcacatagaaagcattatatatgtactggttgttattatcacaatgaaggcactgacccaaaggtaacttgagctgtcacattataggctgaagtaaggtaactataagccaagtgcatataagaaaggcttgcaatatttcctaaaactggccccaagcctttctgtggcaggctttggaatagctgaagccatcaggatgttcttctagctagcaattccgagtgatgtgttactttgaatcagagtcactgaggtgggcttgcacacagctataggctctttggaaaagtgctgtagattccagttaaaggttaaacttcacataatatcaatgcaaaggcatttctaggtttggcatttttcccctacccagaccacccacacacatacacacactcacatgtatgcacctagccagagacaaatcattttattcttctgtctgaaaacctccactggccccacactgtctatataggataaattccaaactcgttaaaggctttactcacaggctggccttaatacctactttaatcttcatttgtaacactctccatcattttactggaggttgacacgtatttaccgaaagcttactctatgtcaggcattgtattaggtgctgagattacaaatatgtttaagggacagctatgtccatgagagactaacatttcagtaggagtggcagatatgtatacagatcattaaaatttagtttgcaaagtgatttaaaggggaaagcagaatttgttttagaaatacagaaggggaaacttagcagtctaagtatatcaaagaaagcttcatagagaaagtaacacctgaacagagtaagggagggtaagtgggagttactcaagtaaagaaagaggggtaagcacattccaggtggagaagacaatatgtacacagacagggaggaataaaatagcattctgtgtggatgagaattatcagcagtctttgacaacagaatgtaaaatgaaagatggaaagcagtggtgattgaaactagaaagatcataggagggtgggaaagaggacattttgtatgtcatattgaaagcttggaatatatcatacagagttataaaaccagtggtaagttttgagtgatgggattcaggacacactaccctgaagtgtggcaccttggcatttgagaaaacagcagaagcaggaaggtaactctcaccttccccccagcattctcccctgaagcaggtcataaaactctcatttgacaggttctctctctgtacccagaggaagtgaacatctgtatatctctaaaaatgcaaggtcactgacagcaatctgaacaaacacgaatagctgagttctccccagctaactatcattagatcatgcttttttaatccaatcatactcctcaatgacttaccacttctctatcaaacctagcataaaaatacacaagttttcctgtttctttgtgttttcctttccctatgtaaaacttatctttaataaatgtacatgcttttctcttgttagtttgtgttttgttccaaggatttaatccacaaacctaggctgggaagaaacgataattactttctcctacatgagcaaggaaataaaaaagacagatctgtattttggatacattattcagtagcaagatcatcttctcccatcagcaccttcttcaagtaatgtgatgacaccatttcttgtgtgcttggaaaaagtttcagcttgctgtctcctttgttgttttaaagaagtgttagacaaagcattgtttgcaaaatctagggagataatggagtacactttgatttgttattctgtgtgagctatgatctaagttattggctctttccaactttaaaaatttttgttgttaaaagcaccttgcttaggaaattttaaatatttatgtctgcaacaattgtctcaaaataataaactgtgccattcctgtcattaaaaaaagacctgaattcttcctgaaaaaatagcaagatcaaaagtggattaagaggcatgtggcataaatctaggggcaagggaataaattggaaagttactgcaatatttaaatatgagatgatgagaacacctcttctgacactgttctcctacctgcttacccatatacagacattcacatgtgctgttaccccagactgaaatttcttcttagttattatttgctaaatatttatatttataatttaggtcgcagttaatttttacttcttcagagagaaattatatgaccacaaatttaaattacgacctctcggatatttccatgtttttattcctgttctttgacttcatatataatttgtcagtgaggcacacaaatagcccattagcaaacaaagagctgactagccatgtgcatgtgttgttttatgtctctttccccacaagatggtaagatgtatgaggaccaggatataggcaacaagtgacacaggaagcattgctgtttttccacctcaatttctcaagtacctaatattataatggaaatagtaataataaaatatttatctgttgaaataatgaaagtgtgtgttcattctcaatatcatagtcttacagaacatgagacaaaaagttacatctgtatattcattcacaaggtgcttagccatgcaagttagttgacgatgcaagacagttttttattttcacaataatccagtttaaaattagaaaaacatgtaaataaatagtataaagaaaagataggaatactgctcctcacccttcttcaagaaaaccaatcatagtatttttttctttttggcatttttactgtgtgtgtgcacacaggtacactatagatcatctattcaacaaaatttatttaaggctttgtgtttagaactggggaaaacaggatgaataagagcatcagaaagctcacagtctaatggcaaaaataagattcaaatgcgatcaaaaggcacttggatgttttattaaatcagattttttttttaagaaaaggaaaagtctcctgtatacataccaatcaccaaagaaaggtgagctgtcttgaaagacccaggatcatggaatttttaataaccagactttttaaataagtgaatacaactactatgagtaaaatcattcatcctgggagggatggagtctaatactgatgactttatgatcttctagcctctagaagttttgtgctaaatccatctgaattctaaaaccactagacaacctgacataccacatggagggctctctgcctgcaaggcttttttcctctttttcttgcatactcagttcatgggtgccctcctcatgctcctatgtctataaatctatgtcctcttattatattgtaatcatatttttacttttttgcctcctttattaatctgtgaacttcattaagatagaggtagtacttttatttctatatttttattttagtggtaggaaaataagcacatgagtgcatttaataaatgtttattgaagaaaaattggaagacagtatgaaaggaatcatattctgtttatatattgtaaaaattagaaaagactatgaaatatagactggagaacatgatgacatattctttaacatctgttggcacaaagaagcaaaagctaaaacaaaacaaaaaagaaaaaaaataaacaagtaaaatcaagtctttccctgtgccaacaatacttaaaagcatattagttggagactcctgatttcaattaataaaaacaattaacagaagaaaagaactttagatgacattctgcccaattcggtgatatctttttgttcttggatatgtcatgacatatttttctcactggctaaaacttctttctcttcacctaaaatgacacacataactgggaccctatttaggaacttctgggaatgtcctgggcatgagggaagaatgcccagtagacaagctaggaatactgatctaattttggagtgaagacagacatataggcagatctctcccagaggtctgaagatttgaataagtagctcagactttgggaagcttgtgttcccaaggaaattatttgttccataaataagactacccaagatgagtaacgcttggggatgtgacccccctctcccacgtctgcaccatttttcagttaatttatatgtggtgagattgtgatagattacctgtgagatcatcagtgggccaagaccccagttggcatgccttgcatgtgtactcatcaaagacatactcattctccttacaaggtgtacaggtccaacaacagctgacttctccctttcggatcacctaaggcaaatatttgaaatttagatttttttttgcatagataaaaatccaacaattctatattccaatgtgctgttttgcaaagcagaaaggcctttcacatacattattttaaatgttttcagataagcagtacaatttttaatattaatttataattaaagaaaataaggctgagtttaaacaagtccagcgtcataaagttagcttgtggcaggataaagaattaaattaaatgaaagtctttggataattagccttggaaacctgtatttaattaagtacctgtgcttgtgctcatatgtagatacacataactgaattcaccccaggatctgctctgcttctcctttccttaagttaagaacttctgctccctggatttaccttagcttccttccctccattagttgaataattgtgagcaaaaaacattgtatatttcctaatcttctaaaatctgtccatattgataaaaataattaggaatttgtattgggtagaacatagcaaaagattaagattttcctggagatgatctcttgatctctttctacgaaaaatctgattcaacaattcaacccattctttcctattttggtagccttgttttgtttgaaggtagatgaggtcactgagactattatatacctcttaatctatctgacttttttaaggtaatggaaaataattgaaataatttaacagttgaaagagtcacagatgttattctttcgaaatagatgtaccttttcttccccaccattggtgcatgaaaagcctctccggaatagacagcattcattaaatgttcttttaaataattaaaactgtgattaatattcagcaatgaccagagacagtaatgattacactttatatttctagtcttagatgctaactctagtaatgacctttgataataacatcagctagatacctatagccaaatataattgtaagctgacaactgtttgttacatttttgtagtatttcttgtgttgactcttaaaactacaaaaatacaagcagggaataatggcaaaagggcctgaaatagcttttccctaaagtaactaaataagtgaggcaaaattgctccttagacctgattaaagtattcttcataataatatcgactatttccaggctctttagtacttgtcacatactgttatcccattaaaacattagaacagctctgtatgaagtagctggtttatttttttcattttcttaggggagaaaactaaggtaaagttagctcacatagcatgttagggtaaataagggatcaaacaatgtatgttggacttcaaatgctcatgcttataaacattgagtcttactggaagatagactgcgtgatattttgaaagacgcaggggaaagagcactggcttgggaatcaagtagcaccagggttctagtcttatttatagccactaagtagttgtgcagccttgagtagtcctccagctaatgctcagtttcttttaactggacctgttgcttttaagataataatatctaccttataggatttccttaggattaaataaaacaacacagtgatttgtaaagtgtagaacactctaataatgttacctatttcattaataatatgcacataaatgtccatatacagaaatgaagaatttcattttcaaggtataccacacttggcaaaactatccttgaacaattattagattttgtaatgcaaacaggcatattgcaaagctgaaggagtgtctttcagaacttagcagggattagcaaataaaagcagttgcatttccccccactagaaataccttgatttcttatggttcagttttcattggtttgtgaatttcaggtgtttattaaaataaattcatgcccttttccaagaagaattccaacattacaatctctttttgaatcaatagtgataacttaatatgttttcctctgataatttagaaattgttttatgttttcatattttatgttctgtttcacatctattttgaacacgaggtagtgacaattctctttcatggcaatttaacattctggaagtagtggtgctttcttttttatttattttattttttgagacagagtcttgcattgttgcttaggctgggagtgcagtggcgccatcttggctcacggcagccttgacctccccagcccaagagagcctcccacctcagcttcctgaataactgggactacagatgtgtgccaccatgcccaattatttttgttccttattttttttgaagagatggggtctcactaaattgcctaggctgatcttgaactcctgagctcaagggattctcccacctcggcctcccaaaatgttgaaattatactcatgagccactgcacccacccagcggtgctttctttatgaataacaatatataacatatctgaaactttactagactaaatcctttcatggaaactaagtttacaaactctggaaaatgccatgagatgttgatatcatgaatgaaatcgctgttaaaccatattaagaaaatcttctaaattgtacatttaatagagtaaaaatgacatctggttaggaaaatggagtttgggatttttaaaaaaggactaagcaaatattattacaaaatgaccagtattaaaaatatgataataggctgggtgcagtggctcatgcctgtaatcccagcactttggaaggctgaggtgggcggatcacgaggtcagcagatcgagaccatcctggccaacatggtgaaaccccgcctctactaaaaatacaaaaacattagccaggtgtggtggcaggtgcctgtaatcccagctactctggaggccgagacaggagaatcacctgaacccgggaggcggaggttgcagtgagccgagatcgcgccactgcactccagcctggagacagagcaagactccgtctcaaaaaaaaaaacaaaaaattctgcatgtggaagttacattttccctttcttccttccctccctccctccttcgctccctccctccttctctctctctctctctctctctttctctctttttctctttctttctttttgacgtagtctcactctgtcgcccaggctggagtgcagtggcgccatctcggctcactgcaagctcctcctcccgggttcacgccattctccagcctcagcctcccaagtagctgggactacaggcgcctgccaacttgcctggctaatttttttgtatttttagtagagacggggttttaccatgttagccagatggtctcgatctcctgaccttgtgatccgcccgcctaggcctctcaaagtgctgggattacaggcgtgagccaccccgcccggccctagaagttacgttttcaaaatgtattgctgtgaagggtcaaaaataaacaaaaattatgtggtaatttacactgtgtaatctttctacaggaagcactggaaattatgaatatggatattcttggtgtaataattcatgtaaataattgtacatgaatttaaacccctcacaatgaagagtttaactgcaagataattggccaagatgaaaacctcttttgtcttgatataacaagtgttagcaaacttttttttgtacaaaggaccaaattgtaaatatttaggctttgggccatacagtctctattgcaactcagcaactcagctatccaactctgccactgtagcaggaaagtagccatggagactatataaacaaatgagcgtggctgtattttaataaaactttatttacaaagacaggtagtaggtcagatttagtctgtgggccatagtttaccagctgttgctgtataccataataagacatacagaaaatttcagatatctaatattttgagccatttagcagacattaattaatttatttttatcttcatttaccttatctttcttctttctggtcttatgctttccaaatcttcagacctaccctttgagggccttactatcagtattaaaatatttcagtttcagtcttaatcacagatgaaaaaacacatgaaatgccttctaaacagagtgaaggtaaggttgattgaaaacaccaagtccaatggctctaggaatacactgcctgaaatgtggtgtggtagtgcttcaagaactgtttgattagcaaataaattattttgatatcatttttccttacggcattgcataccaatagctgccctaactccctttttattatatctttgtcttctcttccttcattgaattttcatttcctgtaagtgtggccacatcttctttagcctaagagtaattttttaatgtcctcaaattaccaaattatccattacatgcttttttatcacatacttctttttcttatactctttatttttttcaattgacacataataattgtacatatttatgggttacatagtgatgttttgatacacatataacgatcagatcagggtaattagcatagccatcatctcaaatatttattatttcttcatgttaggaatgttcagtatcctccttctagctatttgaaactatagattacttttaactgtattcatcctacagtgctaaagaacactagaatttattcctcctatctagctgtgattttgcttcctttaacaaagctcttcctatccctctcttcctccttcccttcctaccctctagtatgctctgttctaatttttacttctgtgagatcaacattttttatcttgcacatataagtgagaacacgtgatgtttaattttctgtccttggcttatttcacttcacattctgttctccagttctgtctacgttgctgtgaatgacaggatttcattctttgttatggtttaatagtattctattatgtagataaactacattttccttatccattcatcttgatactcaattgccattacattctattcaatctggcaggcccagatgaagggtgaaccctcaattttcatgcctttccctcattgttcctcttctttgacctttctcttccactgactaccatcttatgtgacagtgtgctctctagttgtctatctctctgtacctgttgctgctcagcctctaccttttcttccttttttgtactttgaaagcagaaattctccaaggtatattcttggtccgtatttattttttatttacacttttaggttctgcaattttatttattttaatagcttcaactttaactctattcaatcaattcctaaatctgtattcttagctttatttttcattgctctagactaagctttaatcactggatggctattttaaaaccaacatgcccacaaactaaccaatcgctttttctctaaagccatccccatttttctattcctggaaatgcaaccttttagttactaacacttagaatttcagttgattgtgttgacttctttatcttccacaactcggcatcaaattggttgtcagcctgattgaatctacaaacgttttctccaaatgtgtcttctggccccttttcattctgtttcttccctaattcaaggccttgttaccactatcacagcatccttctaacttgtctcttctttcttgtttcataaatttgtttattcatcttccttaccacagctcaacttatgccagcatcttggtcaaaattattctctgactccagtttaataaaaattaagttcaatgtatttagtatgatgttcaaaactctccacaaatctgggttcaacttatttcaactttctcttttataataaccatttagagcattgcactctagattattcacttgtttctggacagtcttcaattgaccacttttgtcccttttcttttactgttctttctatatgaatgttctctccctgaaatcatattcattttctatggtccattgtttgacattttattcagtagaaatatctctatcccttttgtacaaacttatatagtcctcttcttttctttcttaacaaaatcatcacattttacatgatattgcttatctgtgtccatgatattttctcacatagactgtaagtcttctgacaataaagcgtgtctcatttatttttgcctaatcaatattaactattatattaataaacatttgatgaatatttattaaataaattagaattagtgtcttttctaactgtaaactttattcccaggaagtcatgtctttaaaggcttgtatgagcagaaacggtgtgggcaaacatgactcatcaactggttcaatcaaaccaactaataagactattgtgagttgcacatgggatttcacaaggaatgagtgagaatttctgacattagaagcttacaatataaaaagtaaaataagtgtctaaaatttttaaaaatagccaatgatagttaacactgttgaatttacaacaaaaatgaaagaaacatagattccattttaccttgatctggcctttctcacatggttcactgcacacagatctgatgatgttgcttttcttggaccatacttcatcatcatccatttttaattctccattgtcccaacttccaacgttgatataatcaaagtaatcttttcccatttccttgaaattcattatttcataccttaggaataagaatatgataattatgcagcttaagatgtaaatactcagctttgaaaaggcaatatattttattcccaaaaatgtgtctattgtcatataagtagcactggaattttccatgacagtacacttagaataacaaaaaaaatctgtctattttactttctctgcagagaccatttttgtactttcaagcttacacctgaaatagaaagtaatcccatgtgagaaggtgacttgaccccagcaggatgaaagacagtttcgaaataacttcaagaagtttaaacgagtactgttaggcttctacaaaagatagaaaggtttttgtctgtattcaagtaaaatgataaaacttacatttactaaccaagtgagaaatttggtaaatctttcatcttattttcagctttaggggatatagggataatttacagagggcctcattttacctttcttactttgcccattatcaatggctaaattcattgtacaaagatagttttgagagtgatgtttaaaaaagtttgaaaatagcttctaaagcacctcatgcaatgtaaacatcctggaagagagtagttccttgtgagttctcagcctttgctagctattgttttttgagtatgtggatagaaatgtaaaaagagaaaatcaatgtgctaacttacaagccttttcttataagtaagctcatttctagagaagaatctctgaaataattttccaatttgaggatattggataagcaatatcaccattatctcagtttctacaggtatgtctcaggtacacactgtgttcacataatattttatactgtttaccccctcaggacttatagtactgacagatagacatataaatgcctcctccaacttccaatgctcagcatgtgtagctatctggaaactgatatgaatggaaaatgttctcgcttttggattcaagtgatgagattactatacacaaaccaatgttctgtacagaaatactgagaacaaaactggcatcaatctattgaaacttatgttataaaatgatgccattctgttttcactcccagtcacattttttactgtagtttttttttttcttcagaatattacctcattcttgttttgttggttgttcagtaacttgataattttcctgcagtcagtaacaatttggtgtaactgtctaaattctacttctaaatcaaaaataccaatttataggatactttccttccctctcggtcacaattatcctttggcctctgtgcatgcaatgagttgagatattagagcacagagcactgaggtaaaaagaactcacgtattatgtcattggctacttcaaatatatgagctttaagtattcaaagggtgactttctatgagcaaataacctttgaagattctaggatgggagaaagagaaatgtcagtgtcagacttgtttctttgctgctgataatttgaagaaatatgtgggtgtcattccttactcaaaaatgagctgtcaactctgtttctagcaattcttaagtctgaaaagtttagttcacactgttaattttacagataatggactgaagctcagtgaggttaattagtacagattacagagtatgtaagcatcagagctaggacctaaaccaagcctttagatttcaagtctgcagttccttcttccttattagactgctccaaatcctgggtactgctccaaatcctgggtagagctaagagatcatattttccttgcttaaatattgtaaaaatttgaaccaatttatattgtaaggcttttatctctatatccatgcctctttgttttatgtatgacaaatagtaaaaagtaaagagatccagtttttgaaaaataaacatgaaaactctatagattggaaaatcacatttgacagggaacttgttttaaggaaagttaaaccttaatttcagttgaactcaataaacttgttataattacattagagacaatgaatcctctctttggaattaggctttagatttctagtcattgtttcttaatacaaggcaaacacaaagatattatcactcacagcttaagctgtgaaaatagaacattgctttaaaaatcttgttttagtacactaaaaaagagaaatagataatatgtctccacaaaagaatattctcccgttgacttgtgaattggtatgagcccttttaattttcagagatagaatatagcttttattctccaacaaaaggaaaataaagtgagtgtttaaaacatactcttacgtaacttttagttaagaatcaaaagacataatggcttcttgcaatctttagccatgattcaatctagaagactgtattttgttttccaataaaataacagaaggtcaggcacggtggctcacacctgtaatcccagcactttgggaggctgaggcgggcagatcatgaggtcaggagatcgagaccatcctggctaacatggtgaaaccccgtctctactaaaaataaaaaaaattagccgggcgtggtggcaggcgcctgtagtcccagctacttgggaggctgaggcaggagaatggcgtgaacccgggagacggagcttgcagtgagcctagatcgcgccactgcactccagcctgggtgacagagtgagactgtctcaaaacaaaacaaaacaagaaaacagtaattcagtgtgctctttgtttttgatggctttagtaaagatccaacttgcacatattcagtgtcagaagcaaagattagtgtgtcattccaatcacaagacactttaatataaatctccagcccagtttcttttttctccttcccatctccttcctcccatttatctcctcctccttctcttcttcctcaatcctcctcctccttcctcctcctcctcttcctccttcttcctcctgctccttctccctctcccccaccccttccccctctccctccccttccctcaccctcccctggcctttctttttcattgcacctcttggtttctatatttctctgcttctgaaatgtttttctcagcacagtgtgtttgtatatgtaatttatcttctttaatacctgtcccttccttccccttactctctaactcctcatgtctgctcttccttaaccagccaaaatttaaacctagaatattctaaataattttaaaaataaattttatatattgctcaaaatcaaaataaacaaaatatgttacaataacaacaacaaaaagttctattaaagcatttaaggtaaactagagaaagtcaggtttcaattgtacagaaataaggaactttctaaatggctagaactctgaaaattagagaagattgtcttcagatgataatgagggatttattcaaggggctgaaacagggttgttgttagagaaagtgaaaaatcatttggagaagactgaagagtattacttttatgtgggtcctaaggctctttcaatctataattccgatgctaaggtgcttttgttaaaaattcttaaatgtgtgctaaattatctgtgggttggcataataagccctggtccatacaacaaagcaattacaatgatctgtgcctttggggttggacaatcacagagtaatgagagatcacagagttagttagaccaaaaatgtgaatggcacctaataatgcaacacttttatactatatgttaatacattgaaccatttcaaatgtaatataagaaaaaaaaagaaggtaaatttttacttgatgattgtgcctgagatttgcgtatgtccttgccctgttatttaattgactatgcaaccttggacatgtctctttctttctatgacacagattttttaccaggacaatctggacattgaagcagaacatctgtttctatgagcagagacatatatcaagaatccgcatgcacacaaagtcgttatctgccatttctactattctagcctcgtattttctatttaccgcatctgtttgtgctcctctgttctttctttcctgccctattttgggccttttcttttctttctttctctctttctctcattctctttctctctcttttgttctttcttatctctctattggcttttaaatgctcctctttgtattaaaatttttgtggttgctcaagagattacaatatgcatttttattctacttaatattgagtcacttaatgtaaaatataagaaatttggctttgtgcaatttcaaattctttttcatttttgccgttgttttcaaatacttcgcacccatgtacttacaaaccccacaatataatgttttagttttttgctttaattagttagttgtactcagtctaacattgggtgtccacgtttcctctgcctattatggtcaattccgggtggcagccacgcatcttaaactttaattctcaatggagtccctaaacccgagattagcaaacttttgctgtgaggggatgtatggtaaatattttaggctttgagatggtttctattcacctctgccattgtggtgtacaagcagctatagcacctaaataaatcaatgtgactgggttccaaaaaacctttcttataaaaacaagcagcagactccatgtggtctgcagatcatagtttgatgactgatgactggtgatctagtctgttaatggtaaaatagtaaaggtccatatttcttatcggtaattgtgaaatctttagagctctgaaatttttttttcttttttttgtaactcacttggcagcaaaacatgacattacctgaactttatctagggatgaaatgtgactggaactaaatgaggctatttatagtcttgtttatcacaatgtgaatattcgtatgttttgctgcagaaatattaatgtgtttattagggagtgctattacatattatgttaggggcattatatgattgtttaggcttttgtaaattcaaaaattctgggttctgtaacacctggcaccatggttttcattagagcattgggtactgatagtagactaatcagatgagagatttaaaaacaatgattaaaacgtgctaacagtctgcaagtgtgtgccagagtgagttgccatctctctcagcttcctctgtttaggatcctccacttttaactctggaattgtagaggattccttaatcaccccaggatcctttgctttctcactcagctgggaatgcctttgatctggcagaatgcttttgctccacaaaaataacaacctaatgtctacaaataagttttctcagaatatagtgtctttaaaattttgatcctggttgattaattgtcaggctgttgtataatgttagaagttgaagcccaggagacagagttaaaattttgactctatcatttactagactgtgtttttgggcaagtcattgaacttttgtaagctttggttttctttagctggaaaaaagaatggtaacattacttacctcataggattaaaaagtagaacacttggcttagtctttggctcagaacacacactcaatatatgctagttataattttttttgtaaaagtaactggattatttggagaaacaaaaggtggtaaatcaccttttcctgagtctgcttcatgcccttagaggccaactctgataatttattcatgggttaatgttatactcaaacctagtagtgcaaggatagactcaaagcaatcctgaattcccagaagttgtttgcaagattttaagtatgttgttcttgaaagaatagctatacattttgtctgagtcttgaagggatgattgttccaaaaaaagattaagaaacccttacaacatatttggatgattatgaataaggtagcgatgttctgccagatccatcaaggtttcccattggaatagagctggaccttctgaggcatctcctccctccctggtttgcggaatggtttgggtacctgatataaaaactcttgaattggtggagctacagtcatcagattctatcagcaagtcctaagctgatgtcagaactctagagatgcacatgggaataataaattcctgtgcaggtatctgagcccaggccttgacctgagcctaaagactgagctcattggtcagcctgcccttaaaagatttacaactgtgaagttttgtttggccctgagaaaatgcttgtatttttttccttcatggatatacgtaagagccaaaaagtagaaaacaacatgtgaaaattcagcttattttggcaaacagcctagttatagcaatattcttcaagtctctggaatagaagaaaaaaaacctgggttttcacttggctgtatgacctgaaactagctatcacttataagtctggcatgtgaaatagtaacagctgcatttgggataagctccagctcatcttagaatgtagaagtgtgataaaccaaggttgctgacagaatgtgtgggcacatgtggtgtgaattgttggggattcatgaaaccttttggcagggtcaactacaaacagagtgtatagacagttttccaagcacagttgttaagtatgagctattgctagaagggcactgagagaccaaaggaccctattgttttgatacaaggctgagtgaagactcagccctgctacaactcaaaatatcatttcaatggcattattccttatagattaaaagtgtctataagtcttaaatgactatgtagagtcatttaagaatttggagtagaagacaaatgtgaattatggtaagttctgggtacttagtgatttctctggggactgacctatacttatgagtttatgttcctcaagttcctctacaaataataaaaggtaaaatttcagagaaaaaaaacaatttagtccttaacaaggaagaaagtgatccagctggagaataataaaataaaatgtgacttataattcacttgctgtacgtacagcaaacaacagaacagaacctcagccctatttctggattaccagaaatcaaattgttcctatttcagaatagttctattatgcaagaaaatatctgaatatggggaataacatgacaagcatgtacagagaaaccacagagatggtttttatttatctatgatcatgtgagtttcctgcctcttagtttaggtctctgaaatgtgatgattcgcaaagcacattttggacatcagcacaaatgcttttttcctggccacaggaaatggggcttcttctctctatctttgctcatttgggatgtcagggaaggggaaacattaccaggaaacctagattaaccacaaaggagagaaagagacatttcaggatcaagagttggctgttattcagtctctactctgcagaggagaattgtaacacaataccttcctggagagtctccattctcatcgaataggatcgtatctccagaaaccccagtaaaattggttttcatcagggactccaaaagtttccgtccatcaattggcttcatggcatcacagagtcctgcatagcctgggcagagggacatctgcatgttgtggagcccataggccatcgaatagatggcgttgatcacaaatcccattttggaatcctgaacatgatgtgttttcagagtcagagaacctgttgggaaacaaattaagcatagctttgaggtacaaatctactctcgcgacattcctgggtactgaataatgggttacctgtaattagagaatgcactggagcaattttatcagagttagaaccatgggtaacactgagaaacagtaccaacataatgggcctgatagttatcttctgtattcaggtttttcttccaaaactctgaaaaaagttctgaatcaccaacagtagcaagatccactttcttccaaaaccaaactctaagtatgaatgcaggatagaactgtatttctgtaccataaaatgtatcttaaggacagattcatttcattagtatgagctgtgataatatacctttttggttcagaaatcctcaacaaacctccagtttctaaactattatgttctcttacctggcgatactagatattccaccatctgatataaatttacctatttagatttatcacccagtacgtctaatctcaaagcatatgctctctataaactggcctatttgaaagttataaaatataacatttaaactcctttaattcattaattaattcagtaaacatttattagagtcagaatatacacaaagctgtgtaatttatcatctagagaaaaaaagatgatttgaacatggagcttgtacataagaaacttgtccaataacagagataaattatgtaaatacagtgaaaggtagaatataataaatctgtaaaacatgtggaggtaaaatctatagaggcccaaaggagtgagaaatatcccttccaatagaaggttcttgggaactaaggaactaaaggaactaaaatttgttattgatgattgatttgacaagtatggacttagtgcctgttatttctaactgctcagaacttgctccgagtgagggacatcatgctgaacaagaaagaagtgattcttgctctcatttacttagagtctaagggcagatgagcatctatctaagcaggcaattataatgtgttttgataagtactgagacaggactgaatagtgaatcagacctggaagctctctgaagctgagcattaagctaagtatcaatcagatgaagggagagaaagagtggtccaagcatttttgaagaataacagataagatagagcatgctatgtttgggagactttaaggaaatcaatgaccagcacagagagtaggaggtaggagaaaagagagagctgaaatggtagaggaaggcagagatgcttaagccatgttaagattgctgccttttggctaggagcggtggctcacgcctgtaatcccaacactttaggaggctgaggcgagtggatcacctgaggtcaagagtttaagaacagcctggccaacaaggtgaaaccctgtctctactaaaaacgcaaaattagctgggtgtggtggcaggtgcctctaatcccagctactcaggaggctgaggcaggagaatccctttaacctgggaggttgcagtgagccaagatggcgccattgcactccagcctgggcaacaagagggaaagtcagtcagcctcaaaacaaacaaaacaaacaaccaaaaaagattactgcattttatgataagagctttgggatccattgaagtgttgaggctagggagggacatgatcagatttctgttttagaaaagaccaatctggctacattgtggagaaaggtttaaagggctgtaggagtaggactgtcagggaaactcattaagagggaatgcagtgatcccaatgacagaagaaaatgttcctgcctgtggtagaggccatgattatggcaaaggtgtctaggaagtgaaatctatttccaggcctggtgattatagaatgaatagggttaagacatataggaagagtgtggttaaaaaaaaaataggtgaaagaaagagctgaggtaaagccagagcttatcattttggaagaaatgttttctttaagaaaggtgtttttttttttttttttcaacaacaacaaacaacaacaactctccaaaggtagtatgttgttttatggcttcccaaattgtagaggcttatcatctccatcttgattgctggcccaaatactgacacctttaatttccccagtagagagtctccctagagaaactggcgtagtgcattgtgacataatataagatgggaaatcctgcttccatctcaggactagacagtggtcccaggctacactctaggcaaatcttacaatttccttccccacacagactggattcatatttccacattttacctcacactgctggaaattccattattctagttgccaagtcaaacacttttgaatcacttttgactcctctttttccttcataccttcacaactcttatttgatttatcttcaaaatttatctggaattagactacttagcactaatctacttctaccagactcagtatatatcctctcctgtctagattacagcaatagtcttctaactggttgcctgctttctccttttgcccatcttccctgcactccagcctgtttttagcacaatagccttaactagaagtcagatcatgacaatcctctgatcaaacttcccagtgacttttttctcattactaaaagtaaaagccaaagtccttgcaatggccttcaaagacatacaggagcgtgcctcatggtatttcaccccttattcctttgactcaatctcttaatactcttctcgtaaattattccgccctagacacactgactttctcccacatcttcaaacatgctaggcatgcccctgcctctgagcccttgtaattgctgtgtcttctgcctagaatgttctgcccacaagatttgtgcaggacaattctccagatggccttggactgaccaggtttttctccctttcttgcttgtagttctcaacagtaactgtatgatggtctgataatgtaacttactgagatagagactggctagaagagcctaggctctgtttcagtctcaccagaacagcatgtccttcaatgatttagcacagtaagtcatgtgaccccaggatataacacccagggcaggctgctttccagggtcccttatctgctatgcaagtgggttacatgcaattgagactccatccaccctaggcagatttctgagccttgggggagcagctcacaatgagtcctaggcttctgatgttttttgctgcctatctgtaagtaataaacccatttcccataacttgcatatgagtatgttctgtcacacaagttggtaaccagtgcatggtgagcttgcttcacaagttgcagggcatgtttccttcccaatttatgactttactcaggcataatcctctctgtgagaccttctctggatatcctgtctaaattgcatctctacctccccccaccaacactccctatcttcttttgtgacattattttcactttaccaacacctaacatattttataaatttatcttattatcttgcttattggctgtctcaaacaccactcactaaaatataagctctatgaaaacagggattttttttttttttttttttttgagacagagtctcactctgtggtccaggctggagtgcagtggcgcgatattggctcactgcaagctccatctcctgggttcacactgttctcctgtctcagcctcccgagtagctgggactacaggaacctgccaccatgcccgggtacatttttttgtatttttagtagagacggggtttcaccatgttagccaggatggtctcgatctcctgacctcgtgattggcccccacttggcctcccaaagtgctgggattacaggcgtgagccaccgtgccgagcccggatattttcttttttgttttctactcagtgcctagaacaatttctggcacacagttggccaccaataaatatttggtgaatgaattaaattaacaaactgtcttctctagactacccttctattttactttttctccctaatcctacactaatactagtcctaaccattttcttcctcttacttttatttaggctcaggggtatatgtgcaggtttgttacatgggtaaattgtgttgctgaggattggtgtataaatgatcctgtcaccaagatagtgaccatagttcctgataggtagccttccaaaccatagctccctaccacccttcctcttcaagcaatctccagtgtctgttatttccatatttatgtccatgtgtattcaatgtttagcgcccacttataaatgagaacatgtagtttttggttttctattcctgcattagttcactcaggataatggttttgggcttgatctatgttgcagcaaaggacatgattttgtttggctgtttagtatttcatggtgtatatgtaccatggtgcatggtaccatgcatgcatatgtaccatgtctttaaccagtccaccactgatgggcatcttggttgattacatgtatttgctattgtgaacagcactgtgatgaacatataaagggatgtgtctttttcgtagaatgagtgcttttctcttgggtatacactcagtagtgggattcatgtctgttcatattatttgcccattttaaatggggttgttttttgcctgctgatttggttaagttctttacacattctggatattagacatttgttggatacatagtttagaaatattttccccaattctgtaggttgtctgtttactctgctgatagtttcccttgctgtgcagaagccctttgcttaattaggttctatgcgtcaatttttgtttttgttgcaattgctttggggaatttagtcataaattctttgctaaggctaatgttcagaatggtatttcttaggatttcttctagggtttttatagttttagctcttacatttaagtctttaatccattttgagttaatttttgcatatagtgaatggtaggagtccaatttcaatcttctgcatacagctagccagtgatcccagcaccatttattggataggaagtcctttccccactgtttgttattactgactttgttgaagatcagttgagtgtaaatgtgtggctttgtttctgggttctatattctgtttcactggcctatgtgtttgtttttctaccagtaccatgctgtttgggttgctgtagcctggtagtatagtttgaagttgggtagtgtgatgcctctggctttgttctttttgcttgatttgagatctttttgattctgtataaattttaggatgcacatttctaattctgtgaaaaatgaaattggtagtttggtagaaatagcaatgtatctgtaaattactttgagtgatatggccattttaacaatattgattcttcctgaccatgggcatagaatgttcttccaattgtttgtgtcatctctgatttctttcagcagtgttctgtaattcttacagagatttttcacttccttggtaaactgtattcctagttattccttattattatttttggctattgtaaatgagattgtgttcttgattttgctctgagcttggacattattggtttataaaaatgctactgatatttgtacattgattttgtatcctgaaactttaccgaagttgtttatcagttctagaagccttctggtgcaatctatggggttttcttggtatagattcatatcgtctgcaaaaagaagtagcttgacttcctctcttcctatttgggtgccctttatttctgtctcttgcctgattgctctggctaggacttccagcactacattgaatacaaatgaagatagtggatattcttgtcttgttccaattctcagaaggaatgcttccagcttttgcctgttcagtatgatgttggctgtggatttgtcatagatggctcttattattttgatgtatgttcctttgttgcctaacttgttcagagtttttaacatgaagggatattgaattttatggaaggctttttctgcatctattgagatgatcacttggtttttgttacttctgttgatgtggtaaatcacatttattgatttgcgtatgttaaaccaaccatgaatcccaggaataaggcctacttgatggtggttaattaacattttcatgtgcttctgaattctgtttgctagtattttttgaggatttttgcatctatgttcatcagggatatgagcctgttgttttcttttattgttgtgtctctgccaggctttgatatcaggatgatgctggctttgtagaatgagttagggaggagtaccttctccttgtatttttggaataattttaataggactgatactagctcttctttgaacatctggtagaatttggctttgattctattgggcccaggacattttttggctggtaggctttttatttctgattcaatttcacaatttgttatttatctgttcagaatttttatttcttcctggttcaattttgagaggctgggtgttttcagaaatttacctatttctcctaggttttcttgtttgtgtgcacagtgatgctgacaatagtctctgaggatattttgtatgtccgtggggtcagttgtaatgtccctttgtcatttctaattgtgtttatttggatcttctctttctttctttattaacctagctagcagcctatcaatattgtttaatctttcaaaaaaccaacttttgttttcattgatgttttgtatggattttcacatctcaatttcaatcatttcagttctgattttgattatttcttatcttctgctagctttgatgttgtttggcttttgtttttctagttcttcttcctttcctgggtgtgatgttaggttgttaatttgagatgattccaactttttgatgtaggcatttagtgctataaactttcctcctaatactgctttagctatgtcccacagattttggtatgttatgcctttgttttcattagtttcaaagaatttatttatttatttatttattatttttttttattatactttaagttttagggtacatgtgcacattgtgcaggttagttacatatgtatacatgtgccatgctggtgcactgcacccactaactcgtcatctagcattaggtatatctcccgatgctatccctcccccctccccccatcccaccacagtccccagagtgtgatattccccttcctgtgtccatgtgatctctttgttcaattcccacctatgagtgagaatatgtggtgtttggttttttgttcctgcgatagtttactgagaatgatgatttccaatttcatccatgtccctacaaaggacatgaacccatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagccctttgggtatatacccagtaatgggatggctgggtcaaatggtatttctagttctagatccctgaggagtagccacactgacttccacaatggttgaactagtttacactcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcatttcttcatgtgttttttggctgcataaatgtcttcttttgagaagtgtctgttcatgtccttcgcccacttttaaaaatatggaacgcttcacaaatttgcgtgtcatccttgcgcaggggccatgctaatcttctctgtatcgttccaattttagtatatgtgctgccaaagcaagcactcaaagaattttttgatttctgctttaatttcatttttttatcccaaagtcattcaggagcacattgtttaatttccatgtaactgtacggttttgatagattttcttagtaatgatttttaatttgtattgtgctgtggtctgagggtgtgttgggtatgatgtcaatttctttgaatttgcttggacttgctttattcctgagcacgtgctcatcttagaattatgtgccatgtgcagacgagaagaatgtatattctgttgtttttggatggattgttctgtagatgtgtaattagctccaattggtcaagtcttgagtttaagtccagaatatcttcattagttttatgccctgatgatacgtctgacattgtcagtcaggtgttgaagttccccaagattattgtgtagcttcctaaatctcttcatagatctctagaaacctgttttatgaatctgggtgctccaatgttggatacatatacatttaggatagttgagtcttcttgtttgtattgtaacttttaccattatacaatgctcttctttgtcttttaaaaaattatcgttggtttataagaaaagctacccctgcagttttttgttttccatttgcctgatagatctttctccatgtctttagttttagactgtgggtgctgttacttgtgagataggtctcctgaagttagcagacagttgggtcttgcttctttatccaacttgccattttatgccttttaagtggggacattagcccatttacactcaggatataaattgatatgtgagaatttgatcctgttattgtgctattagctgctaaccatttttaaaggatccaagaacacttccttcatgaagaccaccatgattgcagatattaaaattaagttgcactttgaactctggatcattttctctagacctctctctgacactctatataccttattatagaattgtgggaatacttcaggggagcagagtttgaaacatccatttcccaggtcagtcttataacctacctttccctatttaacatgctaagtaaagaagaggttactcacacgatccagaagattgggtattcagtgacaatctctgaggccacacttatgtgctttaccttgaccctaagccatgttctgcaactctgcctcccaaccactatcagagttcagcagtacatgtttttctggctgttataaaaggtgggtttgagtctcattcttttatttttctctcttttgaacagggtatggagatctatgtttgaatcctgttatgtgtcttcctggctctgtggcttggacaggttacttcaattacttaacattcagtttaatcatctgctaaatgatgacccttcttttacaaggataatatgagaattaaatgttatagaaaagtcataggtacatcacacagagcctggcacaagatgcttcctaagtagtaactgtgtcaaaatgtaaatcataataacctttagtcactatatatttctggtcaagactttagagtataaaagtaagtgaaaggtctcacctgatgggatgcccattagactctcaggcagtcactatttagcttttttttctgattttgatttatgcctggtccacaatagacagcaactggtgcaaaggcaattttgagcctttttaatttgtaaattaaatcacagtgtgtagggcatgcttactacactgtttattgcattgaatggggacaatattgacaatttgcatttgcttggcacttttcaacataattttgcatgtatctgatatgtgcctaagcactacaagatagacctgcacagcagaaactatccacactgtatatataaagaaactaagctgtagacaagtgaagtcgattttccgtggtcactcaggcggtaaaaatcaaaagtagacagaaacttgtaatgtcatgactagttttcttgttacactatattgctattcattggaaagaagaaatccctgtatcacctttttaaaaattattctaaataagagataaacttagggaaaacaaatggcaacgatattgaatttttcctacacagttccatgtgtctgttctcttagataatgcctgctagcactgcccaagacctgggcccaggtatgtacagaaggggccgatcaaaacaagatcttaaaagctgacggatgtacatgtttgttcacagttcattaaatcttttgttattattgagcatctgggaacaactggcctatttgagcagcattaggatcttgtagaagtgcctggtgactatttttcctaatcacccagagacccaagtgattgcaaactcctccccctcaaaatgataataataaaaataataataattggaaaaccaacaaaataccagaagagaacaaatagaagtttaacttttgtaatttcttattaagtcattttgatgcttatgtattttacagaaagacatcatgatttgtttcagcattcatgaggcatcaggacttcaagtcatagaaatccaagtttaaattctgcctgtgccatttcacctactttccagccttcttcctccaccagagaaggaagcacatggctgacctttcaccttcttcaggtagctgagacagctccattgaaatgtgtgctaacaaaatcaggactttacaaaatgctttaatctcataaaacccaatcagctaggggctatttccactatagattaagaaactaaaaaaaaaaaaaaaaaaatcaaagttactgtgaatagctggcaagcttagctttttttttaaattggggccagatgtggttggtatccacatttataagagacatttgttaatacgttagtctcaatattatagatgtggtgaatatattggtaaattggggaattttcttgcctcttatctctccaggtttaggtccccatctatcttcactccctccataactccacacatggctgaagggggtgaatatgcaagatgacatcgcactttgtgtagagaatgcctctcaactattaagagcagcagagcagagcatataagagcacagattctggaagtagacagaaggttataatcacagttctgccattttcttgctgttcattgttactagcaagttagttaacctttctgtgcctgaaaaaaaatggttttaaaaatagtatctagcagactgagatgatacttaaacaagttaatactaacaaagcatttgataaaataaattgatttatggtacctggtccctgacccaagttttgttaataataatatgatttcttcacattcaaaatataaagatctgggagaagtttgttgccagaggcattagcaagtgcaaatatgcctaatatgttctttgaggaataaaagaaatgctgaaacataacaaggggaagagaaataggatatgaggcaagagagatgggggttggataagatagggctttggagtgtttttttttttttttttttttttttaccagagaaacattacaatctgattttcattaaaaattttttactttgctgcatggaaaatagaacaacagtggaaaaagggggaaacacaggaaatactgtgacagaatgctgagagattatggtagcttagtccggggtaggattctgaatatattttgaaagcatagagaatagaatgtactaatggataggatgtggagtgttaggaaaaatgaagaatgaaggatgagtccaagtattcagttaagtaagtagacggattagagtgtcattaattgagaagtgagaaatcactaatacataattatgtttctgttctgttttcctataatactagtactgatttttatcatatattaaacattcaatacaaaaattgcctgtttacataactatctctaacctggatctaaggctcagttttgctgtcttgtaacattggcggtgatctgtcactgatttccaggacactgtgggctccctagagacaaggattctgtgttcctcacagatgtagcccttgtatctagcatagcacctgacacacaattggctctattaatatatgttaagcacatgaatgaggccaaaggtatgacagggtgcctcaaggagtgtgatcaaataacaggtctcattctcagattgtcaagtcagtttaccagacagaaagcattcctttgtagaacagcacttgtttaaacaaaactaaacatagcaatgccaatttacagcaggatctgttaggtgggccagacaaccccattaagcaatcttgtgtatttttaccatctaataaaactacatgggaaaaattttggtccaatcaagatggagtaagcacactctgattctcccactgaatacagctaaaaatcctggacagagctggagaagctagttgagaactctgaaaaataagtagtaataagtgaattggggaaaaataacagaactcaaaacatcactgaatcatgcatgagtttcttggacctttttccccaatatcttcagatttagactcaaaagcagccaaatcgtggaactgtgcaccagatgtaagcagaaaaagctccaacagaagtttatttccagtctgaggaaaagaaaatgacaccctacaaatcagagagcatggagaaaattctatttttgtttttccttttcttctagctaagcccccaggtaaccctggcaaggtgatgatagtaagcggtgggtgcaaaggcaacagtgtctgggtggatgcttataactctaaggatggaaacccttctctgtgaccaaaggaactgtatcccaacagtgtgcgggggaaaattctctgttggtttgttcctttctctagcctttccccacttggttcccatggcagggtgatctcagggacagaaagtgagaggcagaggtgaaaactaaagtctcagatttctagccagaagaccaggaggtgggtgggagaggctggaacctggagtgggacagggagacagtagggcagtgaggtggggagtgctaagaaagtagtcctatagcattgagtatgaactcttagtttccccctaagttgtacaggcattgatttgactctggtcagcataccaacttttgagaactcaactatgggatggaacaatgcccagggctaaagactgaccactcaatgaggcatatgtttgataaactttgatagcactgcaaaggctttgaaaactgacagttggaggcgcagcctaagaaggtaagtgggaacttacagactaaactaaccaggttgtttgcctatacttaaaaaaaaatcagtattctccattagatttaaacagcacccaagattgcataacattatatttgaaacgtccagaatatggcaactgtatacaattatttggaagtgatgtaaagagcccagacacttttactaatcttcttgcttcatttttaaactcagactgttgataccatctttctttaaatgatttagtagaattcactgagttatattcaattcttttttcttgctgctttggccctagagagaaactctggctcattaaataatttattagttgactcattcagagattaagtcattgattaaaaagacatttattgagtacttactgcatgtcagacactgtgctggatgctgctgacagaaacataagtaagatgaatctgtgtcctcaaaaaaaaaaaaacgattcaacatataagtatgggctcagtggtagaagcttgtggggaccaaaggagtttcatcttcttaggcaaactttaaagtcttaagtgcgcataataaaatggttcgttttattcaaagttcttttcttatccagtaaatggtaggcatgttaattagttggcatgatagtgcaccaaagaacaggacttcattcagtagtatttactttgttcaacgattattttttagggtctgctatgagccaggattaacctagccatgaggttctgtactaagccgacttgacttgccaggtgctctctggctggatctgcctcacagcagcatgtagagaggaaatggaagcaggaaagggctgcttttccttctttttttctttattcaaaactacatccttgagttagaccacttaacattcactcctaattttcatattgtttaaacaaatcagaagcctccaaaaggattagcagaaactacaactctccaatctgtgattataatttaactttacagccgctcaaaacatgttctttaattcatcagggaaactggaactttgaagtagctgttaaacaaaggaaaatcagactgtcttaacagtgcagaatcaaagaatgtctgagatgcaagagatttcagagagcatctactttacaagctgaagaaaggaagcccttgggctgaatttggcctttagatatgttttatttggcctaaatgccattttatggaaatctcacattaatatcaagctttgtggattctcttgataattcagaagatgtgacaacactggctccatattctcacatggcaaatgctctggaccctgtctcatccaagattgtgaccttctaattttgtccaataaactaattttaaagataaggaaaataagaccaagaggacttccctaaagtcatacctctagttagtagcagctagcctcagaatacttgcctcctaatttcttgggtagtgttattttcattatgtgaggctaaggaaccactgtttaagaatgatttggcaaattaactcatgaccatacaataataaaacaagcagcagtttatttttaaaaaatctggagttaaatctttgtgttagttcttattctaggtactaaaatactttcagattgtcctcactgtttcttctgtacccattagtaaggaaaggatagtaaaaggaaggaagatataagggaagggatccaagtattttcttggaagatgattatacatctggaaaacaccactggataacatactataacattgcaatgaaaaaaaaaactgcagtgaatcaaattctccctactgtcatttattttgtgaatctactcattctttatgcatatggcaaatggatttcagttatgcacagtggatgataccatattttttctgctgtgacagaagggcagaacatccctccctccaagccagaattaatcttttgccattatatgctcccacagaaatgtgtttatatctctattacaacacacaatactttctgtcatgcattagaattatctatgtgcttgtctatgcccaccacagagtaggaactccctgaaggctaacatttgtcatgtttatcttggatcttccatagtttctaacaccatggcttagactaggcaatccatttcttcattttgcatttgctaaatgcctattctgtgcaaaagcctctaaacatatcatgggattcagagattacttcagagtagaaaatcagcactatgtggatcagacacacattgatcttgtttatcattgtatttccagcacccagaacactgctcgacattgtcaggaatataccagtggatcatacttatgatggttgaaggtggaatagacttactgtatggaatctaacataaagtgggcccaacagagaaatgaatgttgtaatgaaggtgcaggtagctttttgggaacatagatcaagtttaataaaacaaatgactagctattgatttagggcttgggcggtgactggtgttgtagggaagaaaacaaatagtctatgaaaagggtggagtaactgatgacatcacataaatcattcatcctatgcctaacactatactgcctattctttgtcaggcagcatggcaatactggaaacccagagctgtatccacatgcctgtagagacaccagttcataatatttgcagtgtctccagtttattttgtgcctgaaatacaggcagttgacctctgaatgctcatattgaaatgcaaatgaacacagcagctgcagaaagaagaggcttcttcagggagcttcaaaaattcaacagggattgcacacttctccgtgcagaacatcaaattttaaatttaaatgattcaccatgaacagccagttggcagccctctgatggatatattattttagataccatatctctcattcacattacagtattttgcagaacttccatatggtgtgtaaatgaaagaattccacagggacatgagggctaatggttatgatattatttaaaagattgtgtggcaaaaaccatagcattagagtcttcttactatactaagatcaaactcctagaccagacttttcccacttggccctgtctgtttatcttcatcgccaccattcttttcaatgagttatattttaactgtgttttataatgtttcctgaagatgtggctttctcatttttgtccaattagcttcttatcatacgttaaaacacaatctagtggtcactctacgatgaatccttgatagcctttcccaggtagaattgaaaatgattcttttttcagggctccctcactttgaaaaggagaaaaataatactttcttttagagttgtgagaattagagataatacatatggaagttatgaccccacaacaggtaccaaataattagaaacttgctaattgttattgtacatctagtacaatttacatacacaagatcactattagtatatttacataattaacactttccatctttgaaaatttgagaattactgtgcttatttattcacacagtgttctagagtttatgcttctgacaataagagatgcaaaaaatttaagttcgttcaagattttatttctaattaaaaataatgagcatgctaaatgaagattccatctcttataataagcactgtaattgaaatgaagtagaaaattgcaaaaacgaattacattgcagtatgtaaacctacaaagaattgaaccagaaaatgcagagttcacatattgcacacatgagagattaatcatcatctctaatacaagagatttgattagggtagaaagtagatctatataaaatgattaatattgaatcatttttatcaaaaagtatttatgaagctccctcttctgagtgtagtggctattgtaccaatggtgcaaattttgtaggacatagatattcctttaaaatcacaacactattttcaaccatggcaataattattttctataagccattttattctgaaatatttcaaaggtagccattaaagaagagataggagaggaaagtagcaccacaggtgctacattctagatgctttacacacttatgacctcatgtagccctcacagcaaacacataagctaagcatcattttctgcccttgcttagatgagatccaagagttagaataaaatgctaaatgacataaagctaaaacatacttggggagaatttcaaacccagttcaatctgactctttcaactatgctatctgcagtatacctaaaacgaacattttctaaattattatcatgtttagaaagaagtaacaaagataagaaactgcttaaatacactatccaccttaccactatgaatacacatttatttcattataacccagacttcaattcctttgatttatgggatcacccagctcagcacatagctcaggagctgcatgctggagggagctacgaggaaggggtgggggcggcagacacctgccttctgacatctgatcttttaatcaaaacatgatatatatgcatgtatttatacaacgagtatgtattgagcagcaactgtgtgccagggtgttctagttaacagagatttcagtaaatatttgttaagaatctagtgtgtcctaaaatccgtaaaattgcagtagaggaattagtctcatgcgtatgcatatggtttagcttatttggagtcatataacctaggtttgaaactattttgccacttactagttgtgtaatcccgggcaagttatttactctgtctaaacattattggatttttgttaaaaggacactaatagtaattatgtcataaaatttgatgggagcataaaatgagattgtatagggaaagtgtgggtaagaatagagcctagcaagcaactgcttgttaagtgttaattatgataatgatgatggtaataagatcacttattttttattttttatttttttgagacagagtttcactcttgtcgcccagtatggagtgcaatggcacaatctcagcttactgcaacctctgcctcccaggttcaagcgattctcctgcctcagccttccgagtagctgggattatagctgcccaccaccatgcccggctaattttttgtatttttagtatttttttgtatttttgtattttgtaattttttgtattttttgtatatttagtagagactatgttggacagtctggtcttgaactcctgacctcaggtgacccgcccgcctcagcctcccaaagtgctggcattacaggtgtgagccaccgtgcccggccagagaccacttatattgtcctcaattatcaaattaagctatagaaatcttcatgattgggctgcatagaatacaaattgcttttctaattttgatggaccccttattttacctagattatggaaaactattattctttcatttgggaaattgaagtagcttttattctcctgtattccttttacttgactgccaagcaatgggaatgtaacccaggctcagtaaattggcagctgtattccaggaatctggagaaagctaagtacagcaaaagaatgatcagtatttatttgcaatcaagttcacgatagggtgcaaatgtagtcatactctggccaaattgctaaaagcagagtttcctgctgcctggaatcctttggacctgggccaactttccaaacttggtcttctagctactagtacatccaggtggtgggggtgggcaatattctttaaattaatactatttacttcatttatttatcctaaaaaagtcaaactaaaattggtttttagtgattgcaacaaaatctctgtcatgagtcaaaatgttgtttggaaaagcaacctacagtcaactggatacatatttactaattatttaagttccaattcaactattgattttcataataattagtggcttggctctattcagtgtttgatgggcttgtatgaaggcctatagtccaagagaattacattattcaactttatatcaaagtagaaccatggaccaaaagttttcctgagccaaattattaaagaaaatgcaaacatcaaattcagttcactactggcttctcctgatctggaatagcataggccttgcaccctggaacctgatttcacaagggagaataccttcccattatctgtgactatttgaatctagtaattctgtgtagagaaagaatcaccagatgaattttcttccttttcttgtctgctgaataaacttaattaaatattgcctgagaggataagagaaaacccggggccatgccttatggacgtactcatgtatgtactccaaagagaatgataaatatgggaggaaggaacaatgacaagagggaaactgaaacaagaaactaaaaatttcaggctgggtatggttgcttatgcctctaatcccagtgctttgggggaccaagacgggaggatctcttgagcccagcagtttgaggttgcagtgagctatgatggcaccactgcactccagcctgggcgacagagcaagaccctgtctgtaaagaataaaaatttaaaaattcaggcatcaagggaacccttattgcagaaaatttgctatgtgcttcttagacaatcaattaaaacatatgttttgctttctaaatttttccatgtgatgttcaataatacctattcaggatttttaaaaaatccccctttgaagttatttactatgtttcagacttaattttcctctgtgctagagacagaggtaagattttgatacaactaagatggtgttattgctaggggatctaggaatacagaattctataaaactatagccactgttctgcatgaggtttacttatgtgatacagtcttaccaaacaatgactgtacctcatatgtgaaattaaaatgccttattattcaaaacatggtcatttggaatgaaataaacctaaattttacatcaaggggacctattcctcagcctcagatgcacatcttacaatagtaagatttggcagctctacagggaacaggttaaagaactcaagggtgccgaagttccagagagccaggatttctacctcactcagagaacagggaacaaaatggccaggcttgcctccagataagaatgtgccccacttcaacttatttccatagcaagagtgtatgaggaaagagagaaaaggctatacccgtgtccctgactttgaatccatagtacctctgcactctatcacaggtggcccagtaagtatcctggaatctagccaaattattatacaaagagtaattttttctaaggaaaaatccttagaaaagaagtatttggtggattttcttctccaggggtcacaatttgaccttcatatttaaaaattattaagcactagcatcgtaccggcattatcctatagaattgtgggcgtgaataggccatgcaacttactcttaagatgttgtaacctagagggaatgtttaattggagagaaagggaggggggcaagggctgaagaactacctgttggctactgtgctcactacctgggtgatgggtctaaccataccccaaaccacaacatcatgtaataaacctttgtaacaaatgtgtgcatatagccccaattctaaaataagagttgaaaaagaaatgaaaataaaagcaacaaaaaaatcagacaaacagcaacaacacaaatccaaactcttcctagaaaagaagagataatttgtagctttggtcaaaggagaaagctataatgatttctcccgtgccacagtctaggcaaaacacaaaaattccaggtagaattcagcggcaacaggcagtgagctctaagaaatgtcacacatatagagcaggtcttaagtgactagcttattttttttttaccagattacctcacactaaactttcacagacatacttcttggccagtatttccaaaaattttgtaaattgagagcagcctttacaatttacaccaaatatagagagatttaacaacttgcccaaggttacagagatagaaaatggcagagaagcactactgctacacacagctttgtataatgccatggattacatagctatagtatagataagaggttttagaccataaaacattcttaaacgttgcttttatattttgctagaatttcacagatgtaaaacgtgacaattaaagcagaatatataaaacagtctaatcggaaaccttctggcaataagagtttgcacttagtttataaatgcacaaacctctccactgtgactcatagagatttctgacttgtgtttatttgagtttcatttctccatacaatgtaatttttggttgaattctttcttagatttacattcttttatgtgttcggaagtgttgtgattcttggctctgtgaaattgctaggaaaaaagtgcagaagaaatattcctaatattgttgtaatttattgagttttattaaatgccagagactgtgtgttatggactaaattacgtcccctcaaataccctcaatatgttgaagaaactctaattcctagtgtgatggtatttggagatgaagttttgggaagtaattaggtttagatgagctaatgagggtagcctgttcatgatagggttaatgtccttaagagaagagataccagtgacttgataaagaagatacaaaaaaaatttgattcatgccctgaatttctctccctttctgccaagtgtggacatagcaagaaggaggctgtctgtaggctggaaaatgaggcttcaccagaacccaactatgttcacatcctgatctccggcttccagcctccagcgctgtgaaaaaaaaaatttgtttaagccactgtgtcaatgttattttcttatggcagcccaagctgacttaacactatgttaaatgcttcataggtactattccatgttcttctcataatatctctatctgctaggcatttaatattatcccaaatttacaactgaagaaagtgaagaaagagagtttaagcaatttgtccagtgtcatagagctattaagtggcagagccaggatataaatctagcctgtcaaatgccaaagcttgtacaaaaccactttactgtgatgtcttcagtgtgcataacttttcatttccataaacccaccactcacaaatcaatcaatttaatcacattatcacatttattaatatgagatacatgagtttaccctataatttctttgtggcacatattttaggtctgatggacccagcttttcctgcagttactatctgaaagatgcacattagggatagtttctagccttctattcactcttagtaattttgcaccagggattcttcattaccactgcatgtcattaagatgtcagatatactcctcctaattggctgtacaacagccacatgtgcatatttcaaatttgaaatattttaagcagaactcatcttctgtacctcaatctcacccctttccctatttctctacttgcaaaattttctcaatcacctaaaattgaatcttttaagtcacccttgtcttctccctttccttcagccctgcagaggatcaccaagtttacctcattcttctgtcacctaacaataacttctgtgacaccctcaaattcccagcagcttaataaaataaaggtaatctctccctcacccaacaaattctgaattatactgtcagattaatatttttaaatatggtttttgattacctcgttttcttcaaaattcttcaacaattaagatatagaagaaaattccccaaatcatggtttggcatgcatggttaaaaacatcttttcaaacttgcattcccagccttatttgttacaatctatgacactgagtaggacatgtattttctcaactccattattcagtttgccaaactgtttaagcttgaaatactctgcctccaactccctgtctcacagcccaactaaacttcaggattcaactcaaagactagctatgtcattaatccctaatttccccagatgcatgcattctctacttctctaatgcctagagcccttaagtcacatttcaactattttctacttatcatgtgtaaccttgtattgaaggtattcccagataaattataaaatacctgatggaagagattaaccgctaactattcttggcctcctctcttgtaactcttaaaaccagttcagaatcttgcttaatggatgtaagaagtgataatttgataaagaagatatgaaagaaatttaactcatgccttgaatttgtatcaatacttcattggaaagaaatcatgtgccatttaggttatatttaatatctgctctgatagtcatgaacccttgagctgatcagtaaaatgttttccaagcaacagctcaaatatcctggatctattccaaaataaattgaattggcagggtcagtgggaatcactatggtaacagatggatcctttaactcttgtagtcactttggtgtagattggcatttacatatcatgacaaagccctgctgctgtccatcaggagcaggagaaaggtatatcaagtcagggtaattaacagtagctgctatgacaacagactcaaataaccagtagcttaatacaataaaagtttatttcttgcttatatcacaatctaatgtagattgtgaagtgctcctgagtcttttaagtgactcagagagccaagctctttctaacacatgattttgccatctttggatccctttttttctagtcacatgaatgtaggagggagattgagaccaggatcttttgtgaatttttagaacgcaggcctctaagtagcacacatcactttagctcatattctatcaactaattctagtcaggtactgcaaagtaggtttgtaaatggtgctttcctatgtgctcaggaaaaggaaatggatttgctgaacatctagcctatctttgccataccaaagcttcagcacctgaaggaatttgatatctggatctgatggttattattctggaagaaggaccctgaaaaggcatttgccctgggtctattggtagcggcaaaattcttttaacataaaattccttcaaataaccagaccttctttagtagaattccatggcagggctatgctcagtaatacccaacaactttgcattggtattcattctctagctcaaatatgtcagctatgcgccgtacatatctatagtcagctgcaccttacctatcccactttatttctacctatgtatagtgtcttctctccttgttttaatcttcctaatccatttctgtctgtgaacatggcaggcaaattctgagaccccctccagaggtagagggttttgggaattagaatgccttctttattgatcacggacaaatagaaaacctcttcatgatggactcttctactccagctccacttccctatttcctcaggctattctctctacttggccacttacccataccacactcgcttacccacaggatacccatgctgtctcctccaattgcccttggatactctgacctgaactgatttctcctgtccacagacttccatgacttactctttgactcacacattccagtgatgtttgataatcagacaatctgcttacagctccatggcagtcaatgttatctgctacaaaaaaggccagttcaagtcctgtctttgtctaagtcctctagtggcttcatgtctcaattgagtaaaagccaaagtcagcacagtggcccacacagctttccaagatctcaccttctgtgacctctttgacattatcttctacttgtttccccaacttactttgctccagccactttggtctcccatctgtttccttacctatgacagttcccacacctctccaggctttattcctgtgatttccttctcctgaaatcatcttctcccttaacgacttgggtcacaccttcctcactttctgggctttatacaaagtttctctcttcagtaaggtcaccctccccaacattctaaatcctatctccctgatttatttttcttccagtaattatcaccatctaatatagtatatatttcacttatctattttgttttactctgtctcccctaacaggaatgtatgttccacgaaggcaagaatttttgtctgttttgtttacttctgtaactccagtatctaaaatgcctactgatacatagtagttattcaataagtatttgctgaagggataaatgactcttctagttttaatcttttagtatatcttttattccttagcagaatgtagagaccctgaagttaagtactagatcatatatttgccttgtattccactccagggttgcccaatgttgcaaagggcttaataataatttactaatgtaatacacacacacacacacacacacacacacacacacaaacacacacacacacacatattatgatggagtttcattcttgttgcccaggctggagtgcaatggtgcgatcttggctcactgcaacctctgcctcgcgggtttaagccattctcctgcctcagcctcccaagtgtctagtgttacaggcatgcaccaccatgactggctaattttgtatttttagtagagacggggtttctccatgttggtcaggctggtctcgaactcgtgacctcaggtgatttgcccacctcggcctcccaaagtgctgggattacaggcatgagccactgtgcccagccatttattatattttataagtcaagatctttcacatcatttcttagtgaccatatctttgatagaaggctctcctgtcttcagtaccatgtcacagctgtggggacagcggtttctttatttagtagccatctggactaggtgtcagttctctgtaatttttaaaggtagtgacactggcaattactgaaatgtcaaaacactaggccaaccatgagggctgtggcaaaaaccttcccacatagttgtcatggtgatgtgggcaaactcatatatagcatctgacactcagccataaaattgaaattaaagttagctttttataatatcttagagaatggcacctgttataaaacaggtataccgtaccaaaacacctacatgcatatgaagaataaggttatgaataggcagaggaaacatctgttttttgtttttatattaaatgttatattctagtaatatgctgtaaatcatcattcctagcctagatattattgggatatatatttactaataccacatattgtatttcttttccacaacaacctaaatgcaaatattttctaaagcacaatcgattgtaagtgtaaagttttaatataacatttcttgagatcctttcataggatctttacctatatcatgccattttatccccatcatgactctaaaatataattattgtctgagttgtataaatgaagaaggcagggctaagtaactggcccccggttacagagtgagtgaatggtggagctgaatttaacataagtgatcactccaaagctctcactcctgttcatttcacagcatggcttacctgagtcatctgagagactgggagagaatgaatcactgagcagctcaaaagggataagcttagggattaaaagcaggaggagaagaacatccctttgtaaagtaaatttccatttggttacagacatcaaaatcacaaaagatatgagagataagggacttggttatttgctagaattctttgaagcctgagaaataagtctgaaagaggattattttatgttttatagatatatatgtataaaaggacaaatagatatttgtccttatacatttctgaacaggtttattaaagtactattgacatagaataaactgcacatattgaaactgaacactttgataagttttcacacatgtatactctcatgaaaccacacaaaagtcaagatacttaacatatccatcacctccacgacgttcctcccgcacctttgtaatccatcactccccattcccatccccaggcaaccactgatttgctttctgtcactctagattactttgcattttctaaagtttcatagagattgaatcacacagtatgtactttttttttttttttttttggcaggatctaactccttcatcctggctggagtgcagtggtgcaatcctagctcactgcaggcttaagcgatcctcctgcctcagacccccaagcacctaggactataggtatgcgctgtcacacctggccaatgtttctatttttttgtagagtcggggtctccctatgttacccaggttgatctcgagctcctggcctcaagtgatcctcctgccttggcttttctggctacttagactcataattattttgatttttgctgtgttgttgggtgtattaattggtcattcctttatgtagatgagtaatattccattacatgaatatatcacagtttgtgtattctttcacctgttggtgaatatttaggttttttggcgtttgagctattacaaataacatcattttgaacattattccttaaatacttaggagtagaatggctgcaccacatggtgggtatatgtttaactttttaagaaactatcaaactattttccaaaatggttatagcattttatattctcatcaacagtacgtgagaatatttgttcctcaacattcttcccaacatttgatatgaccaggctttataattttatccatactaataagtgcatagtgttatcttattgtggtataaatttttgttttcctaatgattaatcatattgagcatcttctcctgtacttatctgcaatccttatatcttctttgatgaaatgagtgttcatcaatattttgaacaagcatgttttgaatagtcattttatcaaagaagatgtatggttggcagataggtataggagatgctcaatatcagtaatcattaggaaagtgaacatttataccacaataagataccactatgcacttattgggtcatgtatcctgtaaacacataaaccacaaaaattaaaaatgactaaaagaaatggcttttcattttgctcattttaaaaactgcattgttattattttttaagaatttctcatctaccccaattataggtaaattatatagaaattcttccaatctgtgccttttcttttccattctcattacagagcaagtgtttttaattttgatgaagtccaacacagtcattttttcttctactgatcgtgttttgctgtcgcgtataagaaaccttttctaacataaggtcatgaatgggttttcatgttttcttatagatattttatagttttaggtttcacatttatatctataattttcattttttgagatggattcttgctttgtaactcaggatggagtgcagtggtgcaatcatagcttactacagtgctgaactcttgggctcaagcaatccttctgccttggcctctcgagtagctgggactataggcaggcactactgtgcccaattacctgactaaatttttttattattagtttttgtaaagaggcagggggtagtttcactttgttgcttagactggtcttgaactcctggcctataatgattctcttgacttggccttccaaagtgctgagattataaacacgagccaccgtaactagctaaaattaatttttagttaatttttatatacattcatacatcacttaatgacaaggatatgttctgagaaaggtgctgttaggcaatttcatcactgtttgaacatcttagagggtggttatgcacaacctactaaatacataagctatatgatatagctggtttctcctaagctacaaacctgtacagcatgttactgtactaaatactgtgggcaattatacaaaggtgtaagtatttgtatatctaaatgtagacaaagtacagcagaagtgtgacataaaaggttttaaaatggtatacttctataggatatttacaatgaatagagcttgcaggactggaagttgttctgggcaagtcagtgagtgagggtgagggaatgtgatggcctaggacattactgtatgccactatgactttataaacaatacacccttaggctacactaaatttataaaaaatattatttttctttcttcaaattcaccatagtttactgtaacatttactttataaacttttaatttatttttaactattcaactcttttgtaataacacatagcttaaaacacaagcacattgtatagctgcacaaaatattttcttctttatattcttattccataatcttttcctattttttattttttaaatgtttttgttaaaaaccaagatacctacacacattagcctaggcatgcacagggtgaggatcatcaatatcactgtctcccacctccacatctcatcctaccagaaggtcttcaggggcaataacacacggagctgttatctcctatgataacaatactttctggaacacctcctgaaggacttgcctgaggatgttttacagttgactttttatttcttataagtagaaggagtacactcccaagtaatgataaaaatatataatagtaaatacataaacgttattattttcaaaattatgttgtatacataattgtatgtgccatactttcatgcaattggcagtgcacagggtttatttacatcagcatcaccacacatatgagtaatgtgttgcaccatgacatcactaggcaacaataatttttcagcgccattataatgtgatgagaccattgttgtatatgtggaccatcgtttactgaatcgttatgtagcacatgactctacgttgcaaggtgtagactgaattttggtggggaggaagggcacgtggatataaaaatttttcagtagcatttgttaaaaagcttatcctttggcatttagattatttccacctcttggctattgcagctaatgctgtgatgagcattgggtacagatacctctttgatatactggtttcatttcctttggatatatatccagaaataggattgctgtatcataaggtagttttatttttaatatttttaggaaactccatcctattttccataatggttgtaacaatttacatttctaccaacagtatacagggttcccttttctctacacccttgccaacacgtcatctctttcatctttttgatagtagccattctaacaggtgtgagatgatatctcattgtggttttgatttacatttctctaatggttagcagtgttaagcacttttcatatatctgttggacatttgtatatcttcttttgagaaatgtgtattcaaatccttagtccaggttttagatatgttattatttgtgtttatgtgtgtatgttttaattttgctattgagttgtttgcatttgttttatgttttgaattttatcagatatatggttgcaaatattctcttccattccttaggttgtcttttcactctgttgattgtttcctttgctgtgcatgagctttctagtttgattaaattccttgtctatttttgttttcattgctatgcatttggggtcataccccccaaaaaatcatcgtccaggccactatcaggaagattttccatatgttttcttccagtagttttatgtttctaggtcttatgtttaagcctttaattcacgttgagttgattctcgtctatggtgtgaagtaagggtccaattttatttttccacatgtggatatccagtaaatgatactaatgtattaaaattttagtttctaattatttactgctattatatagaaatacaattcatttttctataattcatatcttctattacaaaaatgtaataaactcactagaacttagtttgtaaacaccactgcttttctagaaagacaattataccatctgttaatagagttttactccattctttaaaatctggacatcacttatttttttcttgacttatttcactgactagaacctatagaattgaaagccaacctcctttcctgaccacagggaaaaatatttttagtagattgaaaaagattctgccaggcacggtggctcacgcttgtaatcccagcactttgggaggccaaggtgggtggatcacttgaggtcaggagtttgagaacagcctggccaacatggtgaaacactgtccctactagaaataccaaaattatctgggcttggtggtatgctcctgtaatcccagatactcaggaggctgaggcaggataattgattgaacctgagaggcttgaacacaggaggggaggttgcagagagctgagattgtgccactgcactacagcctgggtgacagagcgagactgtctcaaaaaaaaaaagagtttctgtctatttttagtttgtgagtcatttcatcaaaaattattataataggttttctcattaaaaaatattatatgttaatacaattccatgaatcaatttttgaatattaagccaaccttacatttcaagataaacaccacttggtaataatgtattataatttttaaatgtgttattagtttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctattttggtaccagtaccgtgctgttttggttaccgtagccttgtaggatagtttgaagtcaggtagcgtgatgcctccagccttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcatgatataaagacttaaacgttagacctaaaaccataaaaaccctagaagaaaacctaggcattaccattcaggacaaaggcatgggcaatgaattcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacagtgaactcaaacaaatttacaaggaaaaaacaaacaaccccatcaaaaagtgggtgaaggacatcaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaacaggaacacttttacactgttggtgggagtgtaaactagttcaaccattgtggaagtcagtgtggtgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaacaatgatagactggattaagaaaatgtggcacatatacaccatggaatcctacgcagccataaaaaatgattagttcatgtcctttttagggacatggatgaaattggaaatcatcattctcagtaaactatcgcaagaacaaaaaaccaaacactgcgtattctcactcttaggtgggaattgaacaatgagaacacatggacacaggaaggggaacatcacactctggggactgtggtggggtggggggaggggggagggatagctttaggagatatacctaatgctagatgacgagttaatgggtgcagcacaccagcatggcacatgtatacatatgtaactaacctgtacattgtgcacatgtaccctaaaacttgaagtataataataataaaatttaaaaaaaggtattattagatttgatttaaaaaattttgtttaatatatttacatcagtgttcatgaggtctatatgaggtatattggggtataattgttttgtttgtttgtttgtttgtttgttttgttttccatgagatattttcgtctggttttggtacctgtaattctgtcttcattgattgaattaggaagtatttctacttctttacttttctggtagagtttacatagaattgatgtctgtttttccttaaatgtttggcagcagttcaccagtgaaaccaatctgggcctggagttttctttgtgggaaaatttttaactataaattcagtttaacaaatataggaccattcatattttctctttatcctccagtgaacattggtagaatgttaatttcaatgaatttttttcattttatctaaattaagtcataaagttgctcatagtatttattttctttttcatatctataaaacctgtagtgatgttgcctcacccattcctgatattagtaatttgtattgtttctcttttcttttttttctgatcaatttgatttttcaattttattgatcatttaaaagaaacaggctttaattttattgaattttctctattgtgtttctgtcttctgtatcactgattttcactctggtctattatttactttttctacttactttgtggttaatttgcttttcttttacaaatttcttgaggtggaagctgtggccattggtttgtggtttttttccctaatatttaatgctagaatatgtccttaaaatattgtttgaggtatctgaactacgtgttttttccattctgactccgttaccatatgattgctgggaacagtgttctgttttaagtggttctgtcccgggtcatgcgtgtttgatgaatactccgctgaatgctcaggagggagcctctacacatctccagcattctctcttcacgcagttctctcctctctgattctgtgctctacaaactctagctttgttgacctctctaaactcaattccattttctcactttagaagggtcacatcttttatttcttgtctcttgagaataatgtcttcattgtttgaggtccagtgtcttgcaaacttgttttctgaattttgtctggttttgctgctgttgttatttcaagcaggagagtaaattccatttttattacttcatcttcaaaagaagcagccattttcccatacatcatcatatgtaagcctcatgataatctgcaagttcattttttttttttttgagatggagtctcgcactgtcacccaggctggagtgcagtggcacaatctctcctcactgcaagctccacctcccaggttcatgccattctcctgcctcagcctcccgagtagctgggactacaggtgcctgccaccacgcccagctaattttttgtattcttcaacaagcttatcaggtctcaatttggtgaattttaagtatctttaacataccttgggttcaaattctagtgccttaggagtttgtagaaaattggtctttttaaattaagggctttcttctgggatctcactgagtattttttgacagtggatattcatcattgaaaactgcctgcactaaacacttacttgagtggataattacaatcatttcttaaactctggaatttaaataagaaatgtgtaaaattatttctctcaaaacttccatagctggggctttgatatagctttatgttctatttccttaatgctgactccaacgtggacaaactttcattcctttggcaatgaaacatatcaaaatacaaataattcaagaatgggtattaagccaatagtgtcacatgaaattctaattaattttgtctgatatgaagacacaaatgggcttctgatcgggatattttactacatgcactagtatcatgtgatcaaaatttttcttcaatgtctgttattattgttctagtatagtctttcctaaagtatggtgctaatcagtgttaaataataatgtgagttcagagttctgagagtaaaaacttgaactctactttttctattctctcactcaacaacaatcatcacagaagacttctgtgaccacatgtgtggggttttctccatgaataagcaagcaatcagttctgcagcaaacaccagctgagtgtcctccaattaaattctgatactatctacttggagatggcatcagatcccacaggttaatggagtcctcacaagactaccctccctcttcccaccagtaataagtctgggcctccagaaattgtgaccaaccggcttgaaggtgacattcacatgacctctggttgggttcagttgatttgttacagtggctcacaaaactcatagaaacttacatttaccagttcattataaaagatattacaaagatacacatgaagagatgtatacagtgaggtatagggggaggggtgtggagcttccacgctctccctgggtgcatcatcctcaggaacctccattagttcagctattgggaggctatctgaaccctctctctttgtaatttatagagatgccattaattagacatgactgacaatactgtaaaaatatgattggacaaaaagtgtagattcttcttggcttctgtgttgggggttcttgaattgctataaagaaatacttgagactgggaacttaataagaaaagaagtttaattggctcaccgttctgcaggctgtacaggaagtatagtacaaacatgtgcttctggggaggcctcaggaagcttttactcatggtggaaggtgaagcaggatcacacacatcacatgccagagcaggaccaagagagagagtggaggctgggacaagtgccacactttacaatagctagatcctgtaagaactcactcactgtcatgagaacagcacaaaggggatgctgctaaaccattcattagaaaacttccaccatgatccgatcacctaccaccaagacccacctccaacactggggattacaatttgacatgagatttagagaggacacattaccaaaatatattatgctgcccctggcccctcaaatctcatattctcacattgcaaaacacaatcacttctcaacagtcccccaaagtcttaactcattcctgcatcaacccaatcagcagtcccaagtccaatacctcatctcagacaaggcaagtcacttacacctatgaacctgtaaaatcacataagttatttactcccaagatacaatgggggtttaggcattgggtaaacattcccattccaaaagggagaaatttgccaaaagaaaggggctacaggacccattcaagtttgaaacccagtaggggagttatccagtcttaaagctccaaaataatctctcttgcctccatgtcccacttctagggcatgtgggtgcaaggggtgggctcccacggccttgggcagctctgctcctgtggctttgcaaggttcaacccatatggctactctcacgggttgaagttgagtgcctgtgacttttccaaatgaagggtgaaagttgccagtggatctaccattctggggtctggatgatggtggcccccttctcacagttgcactaggcagttccctggtggggactgtttgtgggggctccaagcccacatttcctatccactcttccctggtagtggttctctgttggggctccaaccctgcaccaggcttctgcttgggcacccagtttgtctcatatagcttctgaaatcgaggtagaggctgtcaggcattcttcactcttgcagtctgcatgcccacaggcttaacaccatgtggaagccaccaaagcttatgacttccattctccaaagtggcagtgcaagatgtatgtgttctcctttgagccacagctagagcttgagtggcctggatgtgggtaacaacattctgaggctgcaaagggcagcagggtcctggaccaggcccacaaaagcattcttccctcctagacctctggacctgtgatggaagcagctgccacaagggtctctgaaatgcctaagcggcctttccctcattatcttggatagcacttggttcccttttagttgggcaaatatctctagcaagtggttgctccacagcctgcttcaatttatcacctgaaaaagatctctttctctgccacacagtcaggctgtaaatttttccaacttttatgttcttcttctcttttaaatataagttccaattttaggtcatttatttgctcccacatctgagcacagacagatagaagcagtgaggctacatcttgaacactttgctgcttagaaatttccttagcaagatactgtaaatcatcactctttagttcaaacttgcacacatctctagggaatgaacaaaatgagccaagctctttgctaagacatgacaaggatgaccttttcactagttcccaataacttcttaatttctatctgagactttatccgcctgaatttcactgtccgtatcactatcatcattttggtcactaacatttaactagtctctaagaagttctaaactttcccttatcttcctgtcttttcctgagctcccccaaatcttttgacctctgcttgttacctggttccaaatgtgcttccacattttcaattatctttatagcaatgtcccactccttgataccaatttcctgtgttaggtcatttttacattgttattaaaaaatacctaagactgggtactttataagaaaaaaatgtttaattggctcgtggttctgcaggctgtgcaggaagcatagcgctggcacctgctgctggggaggtctcaggaagcttttactcattgcagaaggcagagcgagagcaggcacatcatatggccagagcaggagcaaaagacagagtagggtagaggtatggtgccatgctttacaactagatctggtgagaactcattcactattgcaagaacagtctcaaggggatggtgctaaactgttcattagaacatatcccccatgatctaatcacctctcaccagactccacatccaacactggggattccaattcaacatgaggtttgagcagaaacaaatatccaaactatatcagcctttctgtgcagcattccttcctctagaatatggaacaggatcccttctgaaggaagatcttatgatctacaataagattagggaataatccccaaaaatgtaaccatggaatccttttctcacactagattactgttctctccaaatacaatcttgaaaatgttaatgtggtgcaaggatgaggaatctcaaatctgggtgttagctgtagcagttatttaatttaattttatttggctcttaaagtactattccggtattctagctactctctcccaagcaattcttttctttcagtagatttttttttattttccccagtcatattttcagtttgagagatactcaagtgttctgagctatggctaagccattaatgaacatttcaaagggcataaaagatggcagaagacaacattctgatgcataaggaagtatcctctaacaacccacttcaaatactagtgagacatattcatcagagagattgtagacaactctagattgaaacttactttaagagaagaagaaacacttctaagctagtgagactaacctttttgaatataaactctttgaatgtgaaaaacttgcacacattctacaaatattatttgtacttttagtatttttgatttagtaagcacataatggccgtaaacaactatgatttcaataattcttaatttatgattttgtaacggcaacagtttgtacatacacacaagaatatgcaaggcacacttcagtccatgaacaatggtcagttatatgaggattttagacccaggcaaagtatctacagtgacccagagtccctgcatcccacaaattggggactgcggtcctaggtcctctagctttttaacactatgagaaataaagcagcatttatctaacaacatttataaaatgcttgccttatattcaaggcattgggatagggatttggaaaacagagatgataaagatagcgcctctccttgagacatttataatttaatggagaaagatgaatataaaatgtttgcatgctggtctaacaatttgaaaaattctacttatttgttgatgtaatacagcaagaaaaaattctattgactgtagttacttcagcatctgtggatggtatcatttttctttctgcagtaaactactttctgtgtggcaaagtaactttatcccaaagcagttttgggttcaaaaggtgagcatctctgtccaagggtagaatttttgaagaatacaaggaaacaaagaaacagctaaatagctctacacatgaagtggagagaaacttgtgttagtgtgtagaaatactgagaagagaggagggaaagattacagagaaagaaagggagagaattaagcaccacagtggcaaaaagcttgtagaggagtgggagtgtgtacaggagagcactgtggggaaatgctacagggaaagaaatttattttggtcactatattagtgaccaaagggtcacttttataggggagtggttgttaaggtaaacacttagacagtaaagcattaatgtaaagaagttcaaaaaccacaatggtacatgaattgttaagataaacacaccctgataaccaccactgaatcaataaatgacattgctacaacccagagaaatctcattgccaatgtacttttacattgctctgaacccgttcatttaatcttcattttattaacagtagtttggtacacatagagatggttgtgtgagtagttccttgggggaacaaaaaatggggaagtatatctgtgctcagtgtctggattcccttgtagcaaaaagaagacaaaaggtaaatgaggtgaaaagtgagaaaattaaagtcaaagtaagaacagaaaactggagcgattagaaaccatgagagtgtgaattcattggaactgatacatgtcttgaagtggacttttcactgagcaagatttagcatgtacagaaacacaggagcttaactgggcatgcaattttaaaatgaaagatcacaattcatgaaatggtgggaacacagatttcatgggtttaagaaataggagatgaggcataaagaatataaatgaccaatttgaagagttttgactgaggcagagtttggcttccttttgtagacattgtagaaccaaggatgatctttaagaatgggagtaacattgatgagatttgctctttaggtgaagacctttgaaactaatttttagtatcaaatggggaaggaaaaagctgttatcaaaaacattagatagggggattttaatatttaaggtgagggacaataaaaattatactgaaaacagtagaacagagatgtgaattcaggtaacaatgaaaaggagggaacagaagtataaaatggtgtaacaatagaatgaacactattttgtcaccagttggctatgcggatggaagaggtggggactactcactcctacaccttgagatacagcatggatgagtgtatcatttacttcaactggggatataaaaaggaggaacctaaagtttgaggtggtggttatagaagttataatgaagttaattttagatgtttaagtttgagatgcttttaggaaatttaggtgaaaatgtctgtttgttgtcttaagtgacactcctggaaactactggagatgacagggagaaattatagaaaagatacaataaatgaatgtcagcaagtgacagtatggctgtaaaggaaaccatccttaaaaaatagaatagcatagttattaggaaacagttttaacttaattatttgtagcttactttattactgttaaatatactattagagaaaaattatactcttaatacttcttattacttttaatttattattaaattcgacttataatttaagttttccataactgtgccatttaagtaaaacatactgaagtcaggctcactgttaatagtatatatttctggactcaaataataccaagtagttaaaacatttaagggccatagtaatatttagatttaagtttttaaatgcttagaaggaaaacaaaaattaacaaggctacaaacactttagacattgtaagtgacaagctttatttatacaacagcattaggatttcagaagtagcaacaactaagaataaagagtagaggaagaactggtgttaggtaggatggagaaggaagcaaatgaaaattcctttactgcatacttgaaaaggtgaaagaaatgggaaagtcaaaaatcttaaaggcagtgaagatatatagaagcaacaaagacaaaatgaactaacacaaagagaagagcagcaaagaaggagggtgtcatcagcttcttttgttgcctaggatacttgcaggttctgactgcaaaattcagtttgaggatctctcttggttaaaatgaaggaatgttaattttctaaggttgccattacaaaaaaaaaacaccacaaattggttggcttaacacagtagaaatttattttctcccagttctggaggctagaagtctgaaatcaggtgtcagcaatgtcatactccctctgagactctgggtagaattcttcctaacttctggtgatgaccgtcaatccttgatattccctggcttgctcctgcatcaatccaatcactgcctgtgtcatcccatggtgtcctccttgtctccctttctgtctgtatgtctcttcccctctttttataaagacatctatcataccgaattaggggcctaccctactacagtatgacttcatccttattagttatacttgcaatgagcctatttctaaagaagatcatactttgaggttctggcaacagacatgaattgaggaaaaggtagcaagtggtaattcaacccagtataaggcactccttaaaaaaagtataagacactccttagaaaaagaaccagtaatccttttggttattaagatgacgctttataaattccaggagccccaaaagtatggtaaccattttctcccatgattcacttgctgattctgggggctacaagagaggctcaagaatcaattcacgatgcattaaagacttaaacgttagacctaaaaccataaaaaccctagaagaaaacctaggcatcaccattcaggacataggcatgggcaaggacttcatgtccaaaacaccaaaagcaatggcaacaaaagacaaaattgacaaatgggatctaattaaactcaagagcttctgcacagcaaaagaaactaccatcaaagtgaacaggcaacctacaaaatgggagaaaatttttgcaacctattgatctgacaaagggctaatatccagaatctacaatgaactcaaacaaatttacaaggaaaaaacaaacaaccccatcaaaaagtgggtgaaggacatcaacagacacttctcaaaagaagacatttatgcagccaaaaaacacatgaaaaaatgctcatcatcactggccatcagagaaatgcaaatcaaaaccacaatgagatgccatctcacaccagttagaatggcaatcattaaaaagtcaggaaacaacaggtgctggagaggatgtggagaaacaggaacacttttacactgttggtgggactgtaaactagttcaaccattgtggaagtcagtgtggcgattcctcagggatctagaactagaaatacaatttgacccaccatcccattactgggtatatacccaaaggactataaatcttgctgctataaagacacatgcacacgtatgtttattgcggcattattcacaatagcaaagacttggaaccaatccaaatgtccaacaatgatagactggattaagaaaatgtggcacatatacaccatggaatactctgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcactgggagatatacctaatgctagatgacgagttagtgggtgcagtgcaccagcatggcacatgtatacatatgtaactaacctgcacaatgtgcacatgtaccctaaaacttaaagtataataaaaaaaaaaaaagattttcaagagagagattcaaatctctcattgttttgtaatatttgtaagaaaagctcacttgaggaatgtagactcctcacactttagttggccttttcctgaagatataggccaaattttctttctgaatcatagaaaaaagaaaagactacacagagaataagtcatatgtgtgacatggtaaaatggcttaacagcggtgtaattggatagtaggagtggagagagaaatgcagcagaaggaatgtttaagaggaaatttttaaactgatgcaattctttattctacaggcttaaggagctctggaaaccctaagaaagtaatatacaaaggaaataacaccaaagttcattatggtcattaaaacttaatatacataatatataatatatatattataatatataatacatatattaaaatatataatatatattaaatatatatgtaatatttttatatgtgtaatatatgtttattacatatatacatacatgtgtatgtatatattatatatgttatatataatatctatacacatatacacatatatgtatatatagtatatatatcacacacatatgtattacatatatattatatattatatatatgtaatacatatatattatacattacatattacatatatatgtaatacatatattacatattacatatacataatatattaaatattacatatattatgtattatatattatatattgcatatattatgcattatatattatatatgacatttattatgtattatatattatatattacatatatactatatataatttatatattacatatatattatatatatgtaattttaaaattcttgaaattttatttgctaattttatttgctatattgacaccggggaaacacattaagaatgatggctaacttctcaatgaaatcacaaaatctggaagaaaatgaaatgacattttttaagaaaaaaataagaatgaagcaagcaaacaaaagaaaacctgccaatatcaaatgctatactcagtgaaaatatcttttaaaaataaaaggtgaaatgaaaatgttctaagaaaaatatacactaatacaacttcctggcagtatatctgcgtatacaagaaatactaaagaaatttcctcgggctgaaagaattatagatgggagcatggaagtacaagaaggaatgaagaacaatagcctcaataaatataaaactattgatcacctatgataatcataacacagtcctgtggtatacagagtacatataaaagtaaactatatggcaattgcaaaaaaaattctgaaggggtatatagatttaaatatttgcaagcttcttgaatgtgataagaaccaacttaaaatattctatattaaactaaggactcagttggtaatttctgttgaaaactccaaataaattatacaaagagatgaaacaaaaatgttaagagaaaaggaataataaaaattattgattaatacaaaacagcagaaaagacagaggaataaatagctaaataacaaattggacaaaaagaaaacaagtagtaaatgagagatacagtaaggtaataaaaaagccaaacttctgttttgtcaattttacaatttatatagctgacaaaggactcatgtccatactatatgaggaatttttccaatagatattaaaaagataataaactcaaagaaatgttcaaaagtcttgaacagacacaaaagaggataccagctttccaaaaacatgaaaaggagcttaactttgaaatacatcatgaaaaagccaattgaaatcaccgtatgatagaactacacactcacagattgtcaaatacagaagaaaaaaccaggtattaacaagggtgtggaaaaacttaaactctcatacatgatagggaagaaatgttcaattgatattggattacataagaaactagggtcaaaagtagtgggtagtgaatatttgagtaccttttattgcacttcatagtaagacataaatctaataattattttccttgtatctttgaactatatattgactattatataatgcagatttgatggtgatttttaatctgttatatttaatttatttagcatgttggctaaactctagacaaatctgagttcaattttaagttccaatgtttaatagttatatgactggaggaacttattttgtctctctaaatcatgcttttgttatatttaaaatgaggataatattatacatctctcattaagaagaataacagaggcagtacatataaagtgtccatgccaatgtaccaaatgacatctgttgtcagacgagattccaaggggggggatggactaagtggtgctttccatgactgcagtaaagaacagattctgagcagagatcacaccaaggtgctcacatgagagatagagagctacagcagcaaggtcaagggaggattttacagaacggtttccatagaaataatattttcatggaaatcaagtaaagttttcaaggctgtatttaagcaggacttccaggaaataaagagtcagagaaacaaataactattttcaagaggaggcatttcagaccaaaaaacagtgggaaaagaagaaattaataaagaaagagggtgcaggccaactggaaaaattcccttaaatataccggttagtgttgtcactaattcctcataaagaggaactaaagatgaaatcagagctactgcttacctttcagaactccttcaatgaagctacacatagtaataattatacaaacatagaatagaccacagaaggacatatgatccccaaatctcaagagagaaaagaaatctgttgtcttcagaaactagatagaactgttaaaatatgacattagctacaaatttgaaattgtgagccataagtgacagtgctattgtttctcacgtattttgccataaaaaatgaaagcaaaggaaatgcgtaagcatttgaggatttggtcagagttacaaggatctgaagtgggagagaagcaaacatactctcacactatgttgcaatgatttctggatttcattgatgggtgtattatcccacactccagcattcctcccttccccttctacccaaataggaactgatatgagattgctgggttcttgttttatgaagcaattacatttaaaaacaatcacaaaccaccattgactatctccatcatttcccaaaagaacaaactgataccagaaacacaggatgaacatgacctcagagggggaaatctttatgaatagctcactaaattgtttctgtttttatcattttattgctggtatgtgacaacctctttgtggactagaattgggtaatggaccaggatttcaagcccactgccccactgaattctggtgttccagcaccatgggtaaaggcatctataccaccaactaacaaaaacttatcagagcaagtatttactctagtaagattttagataatttattactatttatatcattcaaaaatttgaacaatgtttcatgttcaatttgcattttcctgcaatgcaaatgcatatgggtttcttataacacaatgtaggataagtcagttccaaaaaaaaatcctttgtcaatttttacaaactttaacctttgcaggcacagatatttgatagacagatgatatagatagataaagtatatgctggctctacctggttattagaatcaagattctttttggacatgttacaaataatattaacccaagctcttattttaaacacttagttatcatatcacttataattttcaattgcaatttttgttggcattactatctcccttccaagatagtaaacctttgagggcaggaactagctttctccatcttggtatccttacaactaaagcaaaatttggtacattcttagcatcttataagtatttgttgaatgcttgaatgaatggctctacataggttacgtttcctgaaacatcacaattttatatagcaaatccctggtactattttatggtttattgatggaagtagcaactcgatctgtccttcaacactcatgtattcattctttgtacatatatgaaaccgttactatgtgcttccactgtgctaactactctggataatagaaatgagcagaatgcagtcactgcattcaaggatgtcagaaatagttccattctggagctcatgtgatgtttttagcacaatgccttatggaaatacattcaattttttgaatgatacaaatagaaatgatctaatcacataaaatatcactaaatacttgctctgatatgtttttcctaatgagactaaaacctgtttatcaccataagtggcaatatccactctacttatgtaagagtcctcccttgtaacatattacagccactatccccatgacatggtttacttaaattggaaccttagccttatgcattttaaatgaaataataaatctgcttactattgcaagtcttgttgtatttgctgttctcctgtggaaacccttccagtcggcactgaaaacgatgctgccaaaattcttgaaaccaagggtttcggtggtttgtttctggccggagcttcagataataatcatcaaaccacttgacatcgggagattggagcttgattgtgatgccaccaacagcttctcgctgatatccatctgtcacatcatacctgtcagcccagccatcactgtggggaaataaaaaaaccctcagcttagaacagatatctcctaagcaaatgagtccatttgctttccttttgacaagattagtcattaaatggctacctcaggccccatgatggtcctatattacaccgacatgattattgatatagaagcttgttagaataaaaagtgcaataacaccatggaaattttgggcctaagagtgctaaaaggcactaacctcacttaccttaaactgcagaaaataacctggagattctggcacaattttactggctgcaaaatatagtatatacatggaagctgcataatatcatcattcacatttttaatggacatttaatagccaggtaaagttaactttaaatacattattttctttggctttataataataattataatgatcataaaataagaattaaaaatattctccaacatacctaatattaatttaatcatcctgtgacacaacatttttgatcaaattttacaaatgaataataggtttaaaaaaccgtttgccgattatggttactctattcaatgttgatttcccaagcctcgaactgaaatctttgtagtccatagtccatacactattttctatcccatggaatctctaaaatacattaaaaatgtacatctgaaatcacattttatattagagtgcccaaaagaacttctgaacaatgtgccatcaaaagtggtgaagggatcatactcctcaacataactatcattctatgcactgctcactcaaagttatttaggaattttaagataaaagtttttgaaatcagagggctcataatataatgctagaggagagtataacagaataagaaaaagtaaagtcttctacaatgatttggaaaatacatgaaacattgtattggaaataaaaataaaaggcatgaaaagatgtttgtatacaatttgggtacaccctagggcatctaaggaagaaggaaagtgacttgtccctcttcactgccattggtatatacacagtttgtgctgtatatctgctggaacccagtggtactgtctttccctggaagaagtgcaagtgcttgtaaaggaagtatggggaaagggaaaatttgactaaattacaagtaacctcaaagagagaagagaaggaatatagagagatttaaggggaagaacagactagagcctcctaaatgcaaagcaggaaaaagtgttaggaggtgagctgggagtaggggcagtgggtagtggggagaggacgtgggaagagatttacactaccaatcactgcttacctcggtgatattcaaatatttccatttaacagaatgttaatttatttttactttcctttcaatgcatttttgcccttaacatttttttttctatgcagaaagcatggtccaatattttgcataaaaaatcagtgccgagaaagtattatgtaagtaattaatttaaattatacagaaagcatgcacttttttcagtatgcagtgctgtgccaactttgatataaatattgataattgggagttattccaaatgtcatatattacttattaagatatcataagggcttgagatgacttgagatattagctagggcatcagtgggtggagagaagggaaaaaataaacagaaagaacactgtttttctctaagtcctccatgacaaaaagatattaaaaattacctatagtgaaatttcaaaaacttttgtggcagatcaagacaaaaatatagtaatgtagtatgttttgtcccaatgttgaatttggttacttcacacattatcttccctcaagtttcccattttcagctccagaagattttatttaaagctgacaagttgaaatgaagtgggcttgtttgcctcattttctcctctgttttggagggtttattatatcactgagatgagagtgtgggtctcattggcactcgaggagcagcatgggcgtgttgcaaatgggacaggaagctctgtttgttcaagcagagacccattctccaaggaagtgggaatttaaattgctccttttgttaacattagctcgctcttatgtaacactatgattatgaatattacataagaaatgtaagattataatggctccaatttacccttcacagttcattcattgaatttaacagggattgtaaaaagtttgtcttgataaacttttttgcaggtgatatttccataaaagaaaactgtcaggatgagagtgataatttactgatctctcatcatgtactttctctgttttttttttttttgaggtatatatcttttctgtaagtttaataacttagaaaactatgatgttttattattagccttataagttagagttgtgagtttaaaataatttttgtttcagatgtttccaattaacagcacaatataaatcataaaggagatagtgtgtaaacagaaaatcccaatatctatgtgacaaaacagggtcattctatttaaatttttggataatatctgctatgttaatcccaaaaaagacaacactggctaaattagagggtgctgtattgactttagcttattaaacattaacatttttatataaatatgcttttaagatttgcattaagatgatagggcatctttaagtatgatgcaataaattcagcagtaaaatgaaatgctaagaaaaaacctttctgccacctaatgctttctattactttgatagagtggaccttcaatttaattttttgggtgacacgtattttaccaaagcaagagaaaacaaacggataaagatggggaaggaaactaacatttgctaaaagtctaccacatttaaggcactttactagatttattatttatccatccatccaatttctccctcttctcactggtgggcattttgcccaactcctcataatccattttattcttttccgttgtttggatttacagttgatcatcattatttacagattctgcatttacaaatttagctacttgctgaagtttatttgcaataccagaatcaatattggtggcatttttgcagtcattcatgggcatgcagagagtggtacacatttgagactactgaagttcatgtccccatctgaggttgaaaaaggtgactctgctttcttgtttcagttttcatactacaaacttacagtatctatttagcgccatcttttgcatgttcgtgttttttattggtgatttcagtgtttaacttggcctccaagaataaagctgatgtgttatctagtgtttctaagcacaagatggctgtaatatacatagaaaatacagtcagcccttcataactgtgggttccatattcacagatttcatcaataattaattgaaaatatttggaaaaataataatacaaataaaaaacaagacagtataatgactatttatataacatgtatgttatattagggataataatctagagatggtttaaagtataatggaggatgtgtacaggttacatgtgaaaactaagctacctggtataagagacctgagcatctttagattttggtattggtgggatgagaggaggaagtgtcctggagccaatgctctgcaaatatcaagggactagggataactgtatatagacaatacatatgttaaataagttgcatgaataaagtgctgttgctgcaagttcaatgttagtgagtcaacaatttatattaactaagatgtctttaaacaagaacacacataaaacaaggttatgttttgactagttgatgaacacgttgtgactaaaggctcacagcaacctaagcttgtatttcctccaggagtaatggtcattattcactaatttactgtttgctgcatgtttatagaacattactgtgaatgataagaattggctgtaattacatatagtcttaatctggatgttgttttagtcaggtttgtagcctttctttggctgtggaatcagagtaacttggacatttaaaatagaaaaatcattcttaacttacttagcttggcttaactaaaggaggattctttatacatatgtactggattctcaaaacacctcactagcagatacttagatcctttaaatattccctgcagacatcttaaggacatgctaatctacagagaatttactttcactttcttcccaagattgcattaccaaaaatatactctctttctctacaatctactcttcccctttctcctttcaactctaattcctatgatttctcataaagagaaactcatgaaagcttaatttttctttcttttcaacagacagttcttgtttaaaacaaaattgactcttgaattaccctgctattttttttcctaggtctctataaccttccttcttttcttcaacatttattaaatatctacccatcttagactaaattattttgtcacaatcaatagtcccagtatctcactggtatagaacagaagtttatttcagcctttatattcactgcagatggcctataactctgttctatgtcatcttcattttgagtttgaagtctaaaagaatagtctgtttctgggacataccaatcttgtagagcaggagtccccaaaccccaggtttcagaccagtacctgtccgtgtcctgttcggaacctggctgcacagcaggaggtgagccctgggtgagtgagcattacctcctgagctctgtcacctgttagatctaatgcagaggcattagattctcataggatggtgaatcctatcgtgaactgtacacgtgagggagctaggtcgtgcgcttcttatgagatggaacagtttcatccatgaaaccagtccctggtgccaaaaacgttggggaccgctgttgtagaaggaaaaacagatgataggggaatcatacaatggttcttaagattctgcttaaaagtggcacatgttatttctgctcacgtttcactgactgaacaaatcacatggctaaacctgacctgaatgggacaggcatccatggtttttcccacggagaggagcagtgtatattttgaagaaaatgcaattgacagcatcactgtgtgttgaaattgtattgaaactgagaaaaaacatgagttaaatagggtttagagactctgctccagcagttcacaagtctagtggagggatgagaaaggaggacagatataaataagtaaccacatacaaatgattattatgggcatgtcctaaatgcagtgggagagcagatcaataaataattgaccaacacttcttagggagataagagttgaactaagtttgaaaagtatggataatagagtgataccagcattttgaaatattgttttctatatattgaaaaaaattgttaatcaaggaatagtgaatatggagcattgcagctatgtagggtgcacaggtcagagaagtaatgagagggtgagctgaagagaatcagttgtgagtgttcttttgtgccatcctaaagatttccaactttgtcatacaggtagtggggaaccagtgatggcttttaaagtgggaaatgatacaaagacatgatgagaagtagaggaactctgctaaaagcttacatgacagattagagctgtcggagatgaaggttagggaatcaagttagaaaatatgttgcaatggtcaaggaaaccaatggagaattgaattaagggagtggcagtaagaatgaagagccatatttataaggaatcttaatgtagaacctccaaacttgtggggcatagaaggtaaaggagcatttttaatgattcgtgggaggagaataacaacattgcatgtagctccatgtcctaggctggacagtattggaaaagaacaggttttttgtgaaaaaggaagaaaatgaatatgagttgggatctgtgatgttcagatttatctttatacgatctctcacatttctttttctcctggatttctacatattctctccatatgcaactggcttgaatgttaaaaatgcaagttaacaatgttcgtacctgtggttccagtatgatattaacctactctgttgtattattgtatgtatgtttttgtttgctgtgcaatagctgttggcattcaaaaatatgagagaaaaatggtaattatacatctgtaaagatttataccttacaccattgtatgcttatactaaaagtattttaactttataattatttctatcattcattatattaaatttatgaaatataaagcagaccaatagttatagttataaaataattatgataggacttaacaaccaataggcagaatatcacaatctatttttgctagaatgtgaaacctcctgagtgctatatgctaacaggaatatataaaaataaatcttagacaattacgaagataaaagtctaaggattatggaatgttagggcagcgatgccaaataatttaaaaatctatctcccttaatgaaatctaaatccataaaatgcagacaatataattttttctttcttcatttcctatccatatatgttataagttattgctatggaaaacagaaaaatacatgtagccctgaaaattgcattgagtgatcctttagtaacagtctcaatgttttattcatttcaatttattaattcactaaacatttgaatgcctcctctgtgccagacactggtaggttccaggccatgccctcaaggagtcaacagtccattaggcatgacctgcctgaatgggcattgccagcttccagtccattgggtttttctcacttatccttcaaattaaacattccctttcctttttactcaatctttccataaacagtagaaatcattagatttccagtcactgaattatcatttactgaaaatcacattcctttcttgcctccctaagattattctctgatcacctcaattagtattctggatatttccaagttcttaattcttacatttataatctcttgatttatttatatggaagactaattatatacaatgggcatggattttcactagttgaactctcaaatggcaacatggttatttattaatactacaactccatggagattttaggaaggcatcccatggtgctacctgccataggcaaacaacataagtacattctgtacccaaaggagcaataccaatctaaaaatgttggaatctgaatgaatattcctagaagttagtggtcattaaacttgtgtcaggaaatataactatgtgtggggcatgctagggccacacagttattcttgcccactgaaatcattagttatgcttatcatgatgaaactggtactgctgagacgaacctcacacatcctgttgatcggagacatagaacattgattcttattccttagatatgttaatagtttcacactcctaagcctttgggtgtgctattccctctgcacagagtgccattcttttaacttctcacatgttttctgatttgataaaatgtaattcatcaagcagacagatttagcttgaatgcaacttatcaaaaagctcctctgggcttaatggttccttctgctctgcttctaaaatacagtgacattcattgctttattcactgaacaagtattgtgtaactaatattctaaatatgtggatatagtggtgaacaaggaaggcaagatttctgctctcatagaggtaacatgatgcttttagttttgcaattgtcattgtattaaagatagctacatttatttttgcttccccaaagtagactacaaattttatactttgcacatctttgtatccttaatgcttgttataatgctcagtacataccaaatactcaagaaatgtttaatgtaacttgtttaaaaattaggttttaaaaggaaaacttcaaataacacagatttcttttcagataactacatctactcatttgttaattgagaaaataacactgtcaaatgtgccttataaatgactctgaaaggctgagttgattcccccgtgcagaatggtcctcttgttatctacctgatgttattaaggttaatgaatgtattcattaggctgcatctcagtattttttttttcaaaatctgtttgcaacccacataattattatggaaactgctgttctacccacatgtaatcatcatcctgccaaatctcttactaatagattttaacagatattttgggattttaaaaaattctaatagtgggagtctacggactacttggctgttttcacataatattgctccgtgcaccccaggaggagtaggaagtctcaaatctctacacactagtgaaaagcaaggaaaaatattgagactctattttattttattttatttattttttagatacagtctcagtatgttgcccaggatggattcaaactcctgggctcagcctctggagtagctaggactacaggcctttgcaactgtgcctggctttgaaattttaaattaaggttcttatgaatataccccagccaacactaatgaattaattccaaaaagaatcaaaatttagaattgttcagaaaaagataatgttatcaactgaaaatcaacttatttctgaggtgtataaatctcaatatttctcatttcaaaggattcataaaaagtaagtagaggtagattggaggagtgatatcagaacattcaaaagaagggaaaaagtcaggaacttgaaatttgccacctgtatatcataagataatttccactgtatgactttttctaaagttctgcaggccttagagataattattagccctagtttttacatctgaggaaactggaggattaactagccttataactgaggaaatctgagggattaaataacctactcaaaaccccatgacaaatgtagaggggatataaactcagatcttgctaattctaaaactccagcacatttcatacttcataaacctgctaagtaatgacatacagtaatgacagcagagaactgtgtcttgatgaattttatttaagagacatgtattggaaaacagggatcagattgtatattgaaaatgtgtaggtaagattctaaaatggcatccaagatctctgatctttggggtatacacacctctcttagttattcaatcaaacactcatctagataagtgcttctctggaaggattttaaagatgtattttaggttccaaacaagctgactttaaaatagggatactaccctctataaatctgatctaactaggtgagtcctaaaagggactggtgatttctgatttaaaaaaaagattcaaatgagggggacttgacatgagagagctagaggagaatctccgttgttggctttcctgatggagggagctacagggaaaggaatgcaggtggtctctcagaaatgagtatggcctccagcaaacaaccagcaccagaatggagactcaagcctacacccacagaccaccaaattcagccaaaaacttgaatatatttggaagcagattcttccagaaagcctccaaaaagaaatgcagttcgccaataccctgactacagcctgtctgaccctgagcagagaacccagttgccatacccagactcctgacatccagaaagtatgaaataatacacgcatttttctttaagcttctaattttgttataatttgttacacagcaatatgaagttaatactcacttcccaactctattctgcatttcttcacttggaaggccaatgcctgttaatatttgaagagataaaatcttaggcggtctgacctaattctgggtgtggtcagtatagactgacttacaaagacgtggggattacaggaaataacagatagtaagaaaaacctattagaatagttggaatatccatcctgtcttgattttggtcctaggatggcaggcattatctcctctggtttaatgtcttgtggctccagggatgcttccacgtcatatgcatgctttaaataggagaggctgataaatatctttataaatagattgattacattgtgtgttacccaatcttttgtttctctcatcatattatagccatttggagaaatgcaaaaattgaggctattgtataaaatgtgcaacaatttagtaagcaaaatgatccatttcaacagagaaaacactttgaatgagctattgtatccatagctttatataaccttgtctgttttttcatgaagtttcctttcttaggatgatcttccagttttcatgctataatcccttcttccactgaattggactaattccttctgttaagcttgtaaatttttatcagtgggactagtgcttagagtttcctgttacatgactgtgctgggataacaccttttcaaaaatatttctcctcttcttaattgcctcttttatgaaggccaaacagcctctgagagcacaatcaaggtgattgcacggtgctaagtgcaatattaaatcagtaatttttttattgaacacctaagcaataagacaggcttcaagaggatatcaatgaatataaacctcacctcccagtttgttttatttctttttatatcataacaggtcactagggacttcataatttcaaatctatattttcctcatactttcctcaaacttcctgcattatttaacattactgattcatttagtaaaatctaacaagtaacattgtacttgctaagttctctgcagagtgctgcatatgaggaataaagagaagaaaaattatcattcccttcaaccttagagtcaggtaaatgaaaaaaattacttgaatgataactatgataatgtatgtagtgtttttttcctaccaaacattgtcctaagcaatatatgcttatgcctatattctgctaaatattatatatacagttggccctccatatccctgggttctacatgtgtggaatcaatcaacccagatttaaaaaaaactggaaaaaaaatggatggttgtgtctgtactgaacatgtacagactttttttcccttgtcattattccctaaacaatagagtatggcaactattcacatagcattttcttttcttttttcttttttttaaagatagaatcttaaaaatcttgctgcccaggctggaatgcaatggcatgatcttggctcactgcaacttccgcctcctgggttcaagcaattctcctgcctcagcctcctcagtagcagggactacgggtgtgcaccaccatgcccggctaatttttgtatttttagttgtgacggggtttcaccatgttggccaggctggtctcgaactcctgacctcaggtgatccacctgcctcggcctcccaaagtgctgggattacaggtgtgagccacagtgcccagcctcacatagcattttcattgtattaggtattataagtaatttagggattatttaaagtatataagaatatgtatatactatatgataatgatttgagctattataaaagtgacttgagcaaccacgaattttagaatccactgagggtcttagaatcaatcccccacagatactaaggaaagactatatgtatgaaactgaagtacataattttacatgttcacattccacatgaggcaactgtagcttgcaaagcaagcaaattgcccagggttgcacaatatttaaacccactctatctaaatctagacattaaaactgaactagaacaatgtattaaatgtgatctttaatacaaatctgtgtccaaaggtatatacataaaaatgtagatagaagagataatttaatttatttacacacacacacacacacacacacacacatccctcttggaatttctttcttttttttccttctacctgaatcgtcaaatagagaactgccttaaaccattaaattaatattctgataaaatgtctatttctgtattgttcagtaccctgtcattgttagtaagagtctctctaataacatggaaaagaccaattagaagatgcttaagagaccttgatttctgtacataaacacagaatgggctcatttccattcacatttcactttgaggcaacatgtttttcctggacaaaatatccccacgacactcagaaacctattgtgaacttctcacatttatttaatatagtttccaaataaaacgtataggtatagaggaagagtaaataatcaaaaattacactgggattcagattaagttttagaaataatcattgtacaagaagtgacacaaaattcaaaacctaagttcctgaaaaatttaggtatcatatgctcaataactaatccaagtagacttaaattttaagtcacataatagaaactgaacagctacttccacattttcctgtgatagattaggcaagccctcctctgaagacaactagaaaggctgaatattttttttttaatttgtttaagttgtcagaaagctatctagtcagccagtactgagggggccatgatccaggagaaaaaaaaaaatggactgaagaaagactttccctttgaagtatgtgacaattcattgaagttgaactcattgataagaagctaagaagttgggacagaagcaccaggtgagctttgaacatttttgagttctgggctagtattacatttaaaatcttatcagtgaatatctgggagggaaaagaagcacagatatctgaagcagatattatttcctcccttgaattctttgctaatttgtaggcatttactgaaaatgtcagaagtggctaagagattggacagatgagaagagctttaggcagtcatactgaattgaagaaaaaaagaattgtaattgttcattagtctatttcctgttgtttataagagaatgcccacaactgggtaatttataaagaaaacaggtttattctattttttattcggcaggctaagaagttcaagggcatgcctctagcttctggtgagggcttttgtgctgtatcacaacaaggtggaaaaggaagtggacacatgcaaagaggggaaacttgagaggtgttctgactttataatcactcactcttccaggaactaatccattcccatgagaatcaatcgagtctctcaagagtgagaactcactcaggaggagagaggagcaacaagccattgatgagggatctgccctcataacccaaacatctcccactaggccccacctaacaacatcacaggggggatcaaattccagcctgagttttattgagaacaaacaaaccattgcagatagtaaccactttgagtttttatttgggatcattacaggctatattttagttgtaaagacaaactggaaagtgataggctccaacaaaaatggaaactgcttcagatcctctcactatcaagctagcttaaaatggtcttcctctcttttaactgctataaacaagcaacagcaaattctctctggatgaacatacaaccagatgtagccttagattacctctacaatttttatacatgttgtctatcatttcagtagtaaatggacagacatataaagcattaaagaaaaagaatgaaatgattgaaaaccaggaaaaacagtcaatgaaatcaaccccatcccaatcattagaatcaatagagtgaatttaaatacaaatatgaataatatattcaagagaatagatgaaaagtcagagaagtaagttgaaagcagtaatttttttaaaaaagagaaatttaagaaactaaacatttaaaaatttaagaactcaatggatgtgtcaccttcagcagaataaacacaaccaaaaatgaagtttagaaaacttagaggaatagaatatatccagactgaaacatggaaaaacacaatttttgaatatagaaaagtataaaatatgatgaaaacatctaagtcagataattagttttccagggggagaagaaaaaagagaatagagtagaaatcatatttgaagagataatgatggagtatttccaaaaccaaatgtgcaaccagcatgaaacctaccaaaacacagattaataagtatgatgaatccaagcaaaatgaatatgaagtaattcacactcaggtttatcatagtaaagctgctaaaaatgaaaggcaaagttattgaaagtaaaatgcaggaagtgagaaaaagaagcacattaaaccctccaaaactagaggtcatagaaaaataaaaatttatggagaattgcttaaaaaaagtatagtagaaagaaaaagttaggccaggcgcagtggctcacgcctgtaatcccagcactttgggaggccaatgcaggcagatcacaaggtcaggagttcaagaccaccctggccaatatggtgaaacaccgtctctacttaaaaaacacaaaattagctgtatgtggtggcaggcgcctgtagtcccagctacttgggaggctaagacaggaaaatcgcttgaacctggtaggcggatgctgcagtgagccgagattgagctactgcactccagcatgggcgacagagggagactctatcaaaaaagaaaaaaaaaagaaaaaaaatgttaaagtcaaaattgattctttgaaaagactaataaaactgatgaacatttatgaacacttggcaacaatgaaagaaatgagaaatgcacaagttatacactaaaaagtaattgtaaaagggcagccaaaaagaatattgtgaaatatgttatggaaataaatttgaaaatttagataaaatagaaaaatccctacataagtattaaattatgaaacagaaacaaacataaaacagaataattttatatctcttaaatcagtggaagtttatttaaaacatctgcagaaactcgcacacacacacacacacacaaagacagaataattttatatctcttaaatcagtggaagtttatttaaaacatccccagaaactcgcacacacacacacacacacacacacacacacacacacacacacagagtctggcccaccaacttcactaacaaattattctatacctttagacgagaaataacaccaatactcaacaattttttttcaaaaaaaagcaaagaggaaaacttcattttataagtccagaaaaacagtaatatctaaatattaaagtgatttcaaaataaagacaaaatgtaggccaaactcttataaatatcaatgaaaaatctcaaataacatattaggaaactgtccagcaatgtatagaaatgccaatactcattcaaatttggtataccccaggaatgaaaaattattattgttattattgtggtaaaaacaggtaacaagaggtctgtcttaacaaatttttcactgtacagtacaatattgttaactataagcacaatattgcacagcagatcattagaacttattcgtcttgcagaactgaaactttgtatttcttgaatagcagctccccatttccttcatccccccaacccctggcaaccacaattcagtttatgcttttatcaagttgactgttttagtcatctaagttgaatcatgaagtatttgttttcctgtgattggcagacattatgttatttcacttagcataatgttctcacagtttatccatagcaaagtggtgcaaccactatggaaaacagtatgtagcttcctcaaaatattaaaaattgaattgccatatgatccaataatcctatttctgggtatttattttgaagagatatatacaccctcatgttcattgcagcattgttcacaacaatcaagatgtagatacaccctaaatgttcactagtggatgaatggataaagaaaatgtggtatatacatatataattattttaattttcgaaagctggtcagcttaatttaccacattaacaacataatgccgtcaataaattaaagaaaacgtgacaaattcaacatcattctgataaaatgaccttggcaacctagctaaaaaagataacttccttaatctatgccagagtctttacagtgaagataacacaacagtaaaatgttgaaatatttcttcctgatatccagcataagtaaaagatgtcttcactcactactttttcccaatattttattgaaggttctagcaagtttaataaggaaagaaaagaaataaaaaggagtaaactgtcattagccaagaataatgcaattatttacctagaagatctgaaataatctatagatatactacagatacactattacaaataacaaaggaatttagaaaattggtgcatactagtttggcatacataaatacatttaatttctatatatccaaaacaaatacaaattaaaaatttaaatatattacttaaaaaccacttaatacaaagaaataagcctaaataatatgtgcaagatctattcatgcatgcaagataaattatgggagattttacttgataaagagttatactgtattcataaattggatgaatgaataatgtacagttaattctcttaaagtcgattacagatggattgtaatctcaatcaatattccagtgggttttccttggtggggtttaggtggagacgatatttacaagtaggttctaaaatttatagggaaatgtaaaagttcaaaaatagccatgataaccttaataaagaacaaagtttatttgaaaaatgtagtattagatattaaggttttagaaaattagacataatttgttgaaattatgggaccaatagaacagagtcccacatgcatacagagacttaatttctaacaaaggcaacactgcaaagaagtaggaaaaaatgttctaataaaaaagattctaggtgaatcatatgtctttatgaaaaaagagtcttgatacttaatccacactgtttacaaaaatcaaaattcaagatagattgtagacctaaataggaatgataaaataataaatcttcttgataataataaaaggagatattttcaccatagaataggaaagagttttcaaaaagggcatagacagaactattaaagtcaaaattgttaaaagtatctataatataactaatagcttattttcatcgaaagacaccactaattgaataaaaatgtaggccacaaattaggagaagatcttgtagtgtgtgtgtatgtgtgtgtgtgtgttgtgtatacagatgacagataccaaaatgatagctagataggcaaaaagtctgaaaacgactcatatttaaagtatatgaataatttctataatttaatataaaaatagaaaatcctatagaaaagtaagtggtcaggaagcttgaacacttcacacctcacaaaatatgatttgaaatgaccagtgaatgtttttaaagtggttaactttaatcattaggagaatacaagctaaaaccactacgaatagcactactcacagaccaaaatggcaaaaagttaaaaacgatcgacatagttcagtataaaatggaaagcaactgcaattctcaatcattgattttaagagcataggttggtacaactgcattggaaaactatttggcaatatctcctacaactgaatataagcatacaatataacccagcaattctggccctaagtatgtttctaacagaaatgctattaaatacacaccaaaatgcatacagaagaatgttcactgacagagcaggagcatcgccatcttggacaagcccctcattctaaagttcaccttaataaaaaaccatctaaatccaaagagcatcagcttagtgggtaaggtcagcacgaccataaaccaaaaataacatctccaacaacaagaaacattccaaaatcctccccaagcagagacatgctagaccctagataaccccagtccaggccagaaagatgtctgccccaagataacctccccttctcccagacagattccaactctgccataaacttctccacatacacaaatattccaagcttataataagtttgcttaccctaaaaccaatatatactcttagtctgtaagagaaagtgctcctgaccaggatcgtccaagagcacctctcaggttttgtctaaagtaaacctgtctttaactgccagctgcatttagtgtttgtttcctcttttttcaactcttacattcacagtagcactatttgaaatagtctcattttaataacaaccaaaatgttcatcaccagtagaaaggataatgaattgcagtttatttatataatacagtagtagacagcaatgaaaatgaacaaactaccgttacatgaaggaaaatgaataatataataaacataataccaagttaaagaaaatatacggaaaggagaagattatacatattccacttacataaaattttgaagaaggcaataacccagaatattggaagttaaaacattggttccttttgaagagtgtgttagacttggaatgagcaagctggaacgttgggaccttgctcactggagcactggtaaagttttatttctggatctgattggtgtttaaatgggcttgttaatttcatgcaaattcaatgtactacacatcatggtttctgtgctcttttggttgtacattataatgcgttaaaatatttttatttaaacagaaaacttaaaatttaatttctgattagtcaagaaatttataatgctgacttgtaaaatttcagcagcaaattctgcttaaaggagattcatcattaattcatttcattcttaggagtcttcaaatgctcaggcatctttaagactgtcttggagtccttggccatcactttttcaaaaatccagtgatataatgataaaaccgattatagctaacattaagttatattatccatatttaggcttaaaaattgaaatttgtaattcttagaaaatccttttggaatctgaaaatagtggaccaaattcagtacagtccaagtacatcaacatttattaagtatctactatgttccaagcctaagtcaaatttgatgacaaacatattatatctgtcctaaatcaagcttatactctggtggaagacttgaagaaagaaagacttgaagaaggaaagactacagaaaagtataatttaaatacaattgaataatatgtataacaaagacctatacaaaatgagacacgagaaattgggcccatgtcttgaagaaaagttattttattttttataagttgatatctggtctcaaatctaaagtgtcaaagagctgacaattggtgaaatgtacaaaagtaaggataattttgagaaaactctcttgctgaatacagcagaaatatttttactcaaatgtgataggagcaaacactatggtccaggaaacaaatgttcaaagtaaaatataaaattctaggccatatttatataatacataataattacagcaataatgttataaaaagacattgctaataactggaaaaactgaaaggtactaaaaagtaaaatggacatgattgagacagaataaatcaatcagcaaatacatattaagtgcctgttgtatgtgaagcagtttattatatgctgagggtacagtggtaatcaagacagagaagttactgtatcgagtcttgaagtttttgcaaaattgtcagatataaaaatggagatggcatttgcagcactgcaaatatcatgaacaaaggcaaagaggcatgaatccacatttttttatgtaaggaaaattccagccacttaattttcacagaaatttaaaatgtgaacatgacacagtctaatttatactattttatagatgactcttatttgcgaatggatttaaacgttttccattttcaagtacttattaggaggccatttccataagtcaggtgagaagtgatgatttgaaacaaggaagtgattataggatggaaaataaggaactgaagtaagaaatactgtgtttatgaggacaaagaggcagggttttgtgactaatattctatggagtatgaggaaggaaaacaaatctagaatgacaccgaattttctgatttgagtgattagtaacatttactaaagagaaatacgtttcttggggaagtttagttttaaacatgttaactttgaaacgcttgtgaaacaatcaagtgaatgtcacaaatgcagttacacatataatctgaaatgtagagaagtctggcctgagatatttaattcagatattatcaataaatctatatttggtagaactggtaaagggaatgtgatcacccaatgaggatgctgcatgttatgagcaattgagaaattcatttattataattttttagtctgacaaaatttcttttctagtttgtattgcccccaaatggtttaactgtactggctgttcatacttgaatgtccagttagagcataagtcatatctcagacagaaagagataaaaatctgtttagggagatgtattgagtagaaaacatgaacccaggctacaagagaagcgtagagaaacaggcagtgccaaatggttcatagttcagtatctgtaatttcagatcaggggatgtgacactattttgaaaaaaaaaaaacaaacatactctagagtataattaccaagcatttctgttgtaggttgtgtttggaacaagcagatgtgagggtgaagcttagacctatatagagagaagcactgagaggattcaaacaagtacgagggaagaatcaacacatctcatttgtatgctggatctaagaaatgtcagtgtcagagtaaagtgaagaatcattcagggttgtatttaggtgtgagagggagtgttgggagtcactgacctttgctgcatttgagatggttgactactttctcctggaaaatctcatcccatggcttctatagtaacaaattctcctaacactcctcttgccaccctgttttcttcctctctatcctctaggtgagtctctcatcctacaggccgagtttagatatttcctagagatttgtctttgaaatttttctattgcacttttgtatagtttcccttttggattttatcctatgactccaattaccatttatatctaattacttctacatatctatctttagccttgttattcttcctgtgctctagattaaaatattcaacacctactagacagcttgctccagaggaacctccaataaaactggcctaaaatatcagtactgttcatttcaccagtagaaattattgccctttctgccatatatctctaaaggaatgctaccattgttcctctaattgttcaaacaaggattataggtttggggcagtgtcactctttctcaccaggaatctgctccttccagagacaaagtcatgatgattccattgactcagtgtcttgggaagctatttttttcccttgactgtctcagtgatggctttattttgaaccttattatctctcacttgaattaggtgctactgttctccctttgctgttatgagtgagatttctaaaacacaaatgtaataatattacatctctgcttaaacatttaaatttggctctctttgtctttaaataaagtccaaactccttgaggaggcacgtaagatcctttatcctgtaatttctcagtagtctttcttttcattccccttttctttctgtatgccacattactgtaggtgcctgcaagatatcacattttttattaatcatccctactatggtaccaatgttcacttcatgttcacttagtccagtgctttttgttttcattttcctatattctggctgtttttctaaccccatttcagatgccttttattctaagtcttctgtgatcctacatgtgggaaagagcagttttgtactttaaacactgtgtgcttaattctgccttagcgtgaatgacattgtaattttaattgttatgtgcttctctttttcaagacactatttcattccattgtcctagcacttcactggattcattgcttgtcaataaagaaggtgtctttaatattgagtaaatggacggagtgaggcaattgttagagaagaaagactattataagaagaaagagaaagatatgtcggcaatttaaatgagtaaggatctttggaggttatgctgaggtttaggctcaaggaagatatgagcctgtctgcaagaaaattagagtatttatgtcttcaagaaaattagagtattttggttaacaaaattttgatatagaaaacaacttagaacaacccgaagctatatataagcaaatggcagttattataatgtacgcattcagaggagttgaactgtaaggttatttacaggaataaaagtagtgagagtaagctttaaagaaaagacaagacttaaactgagttttctccccagttagttactctgtttggacttccgtcacgtcatcctaacccaaaaccttggactcgttgtcccatgtttctcacagagtcaaagacgtgtaataggcattctgtaaatgtttgtataatcagcaacaagcaagaattgggagtccaatgtggccatgtagaaagttaaacacaggattgaatatggaagtacagaaataacagatggccatattgagagtctaagcattctcacacgtaagagaatcatagtatttgtagagtgataaacatccaatgctgggaactgcagctctggttccatgaactcttggataaaaaccctaaggctagttataataaagaactcagcaagggggatcattaggaaagtcaaagtattttatcctttagggaagttaccatcattctataaagataatttaatgtcttgcattttattataacactctcaaacaattcagtttataattcagtgttttattcccctgcttgattgattttttaaccatgattgattggagccccactctcagcacttccagagaaactgagtgagttgtaaagttcttcaaaggacattatttattcagtttcacatgcattatttgtaaaggtaacaaatatttattaggcacctattatatgcctatgctatcatttgagatacaatgacaagctgttctttattcacctctacctccaccaccaccccatacacacttgaagttccttgggggcaggaattgtatattgaatatatttatattccagtgcttggcaaatagtaaacattgaataattatttattaaattaatgaatgacaatttaaacattataaatacaatgatttaaatatgcacaagatgctatagaaactataaaatgaagaataattacttactgcctagcacaatatatttcagagagattttcaattgtgttgataaattttggaatgaataagtgtatgagacaccatgaatccctcaattcaaatactccattgttttctagatgctatataatgaaaatacttttaaagtgaaaattatagtcttgataagttaatgcatcttcaaaacttgaagttaattcatttaagtaacacatttttatgtagcacttactgcgtgcaaggcattgcatttaatgcttgtgctcaaatggggacaagaaaaagtcattttgttgaaataactcggtaattcatctgaatttgtagaacagctaattatatgagaaataaaaatataatctcttctgattacctaagtgcttgaaaaagtacttgaaaactgtggaagtatggttagagtaataggatgaaaggttgtatggtaaattaattaagaactctacacttctttgatgggccacctataatttcatatttgtatttatgttaatgtccagtaaagttaattttactatattcatttatgtgactagaagatatatatacaacatgtaataacttttattcagttgtacatttacagcattatctagaagccctgacttttaatataatgggtaatgtttttcttccaatattcactcctgtcctctcctgtagtaaattcatattttaactctagagggtccagacttgtctctgtcaaccagagtaattcttctctttgctttagttattagtttaggtaaccttagtcaagctgtttagcacttagatttctcttagcctactcagaacatttcctgggaattgtgggacacagatattctctttctctcactggacaatagcatatgaggttgtaaggctggtgattgctacagtgattcttctacaagagaaattagcccaagaatgaagttgaaacatggagaattacaaagaaatggagccagaatcctgatcaccctataccttaagcctgaccactttgaactttttaattacataagctaataaatcctctttaatgctgaaaccaatctacaatgaattttccattatttacatcaatgacaaaaatattaaatgttataaggaggtgttaaattgagatgtgattatcaatttctcattaatcattaggctgcatctttccatttgatttgctacattaaacatttaattataagaaagagacatcttattgaatattagaaattggcaagattttagcttgataatgcatattaccacaatacatggaatgctgttactatattcagataattagttaccaacagttgggctccacacatttaaaaatgttgaaattaatagatagtattgaaaattgacttaaattaaaatcacaatatataaagtggaattaagattacaaacgtgatgcatttttattcatttttaatttctgaatttttttttttttagagacagtgtcttactctgtctccccggctggagtacagtagcataatcatagctctctgcagcctcaaactgctggccttaagtgattctcccattgcagtccccagagtagctagaccttcagaggtgtgccaccatgttcagctaattgttaatttttttgtaatgatggggtctttctatgttagccaggctcgtcttgaactcctgggctcaagtaatcctcttgccttggcctcccgaagcactggtattatggatgtgagccatggtccccagccatgttgcattttcaactgctctagtccatcttgaacttcaccttatttgtccattatctggaccacaccatctacataattacttctttcatctgctcaccatcagtactcattttcaacctttcaacataggttagcaattagctcatactttctcctccataattttctcatttattctttcatctcttcaactgcatttatttagcatatcctgtatgccagtcattgaactcaggtacaaaatacccactgaatatagctttgatgccataagagttgagaaaaatgctaataccaaatttaaatgatattttttcattacaaattgatgaccacaatggaaagaaatataatgaagaaactgattttatctactctgaggctacaaagaattccatgaatagtgaacatttaatctcagatccaaagatgagtggtaattaactaggtgaagaaatatgccagtatttattagccaggtaaatcaatatcccaggaagaaaaagtatcccatttgaagctctgtggtaaaaagaagcttgactcatttaaaaaaaaaaagtgaaagaaggccagtacagtgaatgaggaggatagtggcaaaagacaaactccacatcatatggaaatcacaggccattttaaagagtttagttttcatccgaagttcaatgaaaatacatgaaatgtaaataggcaatgagaggatcagatttatattttagaaacaactttctatatatgttacaatatgaaaaattacagaacagaggcaaaagtggaagatgcaattgcaaattaagtttcagttgcactgattcaggagagaggacactgcagtttggatcatggcaatggagatgggaaagagtgaggacatttaagaaatactgaggaatggagctatggaattttcagaagattatatgacttctaaatttcttgcttaaacaaccattaagaaaaagaacacagagaataactagctttgggaacaagattatgagatttattttaagtatagtgacttgatattcaagtagaaacattacatatactactttagaatttcaaatattttacattgaaaatatgaatctgagaatgatgagtcaagcctcttttggttgcagtatatatatagtatgtatattcaatctatctatccctctatcatctattatctatctatcagtctatttggattttattgccttgtattactagaaagttgactcaaagttagcttcacatatgataatatcctggggctcaaatacttttatacttttatgagtccctttaatttagaagctgagaggaagctagattgaatttggcaattctggaaggtgaatagttgaacagcatgtgtcattattctcagcaatatctctgttgctgtcacttagcttcaccatacttgatttatattaattcagtaagacaaaagctttaccacatgctcaacaaatcgattttaaataaggcaccattctatttatgaatacactttctcttaaaccttagtttcaccttcctcattcttcatcttcttaatctgtttaataaaaacaaatagacaaaaacgcctgagagttgaaacaacttcaattattaaaccactaattctcttacaccaaatgtagtctattctctgctgttgtgctggtaatctatgggggttaattctgtgacattctcaacatcaaactaatttttttaatttttgtttatactttaagttctagggtacatgtgcacaacatgcaggtttgttacacatgaatacatgtgccatgtaggtgtgctgcacccaataacttactcgacatttacattaggtatatctcctaatgctatccctccccactccccccaccccacaacaggccctggtgtgtgatgttccccttcctgtgtccaagtgttatcattgttcaattcccacctatgagtgagaacacgtggtgtttggttttttgtccttgcaatagtttgctgagaatgatggtttccagcttcatccatgtccctacaaaggacatgaactcatcattttttatggctgcatagtattccatggtgtatatgcgccacattttcttaatccagtctatcattgttggacattttgtggagaaataggaacacttttacactgttgttgggactgtaaactagttcaaccattgtggaagacagtgtggcgatccctcagggatctagaactagaaataccatttgacccagccatcccattactgggtatatacccaaaggattataaatcatgctgctataaagacacaggcacacgtatgttattgtggcactattcacaatagcaaagacttggaaccaacatcaaactaatatttcacaccttgatttttcatcatgtctacatcccaccttctattacatcacccttattgttttccttctagggctttcctgatggtctaaaaagccctctgaaagaattacataaggaatatggagaaggaggagtaacaatatgagatccaccctgtaattcatcacagcgtcaaatactatgtgagaaagatagctgagaagtacagatgagagacaattacagtaggaagtatgcaatattctgtggtttttgtaagatatcctcatgactcattctatgtctcagagtcaatgtcttcattgtctctacacctcagatttttcccttcaagacacatgtatggacttggtctcagaactcttgtcagtatttcaatttttctcattgaatttcaccatttcaccctttccaggacattcaaatttacacaattctcaaaatctttttttaaaaagaagtcttaatttgctctcatcccctcctgagttatatttctctctttctgtttactttcaaacttgtattaatggagcacattttatacttccattcctttattaattccttgccttctgaaagtcatcttctcttcaaaacttcctacaaaattgctttgttaaatgctaacattcttttttgcaatttactttttgctctttgatttctcttgaaccctttctttttgaaattccttcttctcttagcttttgtatcccagtgctatttgttttggaactactcttctgaattcttatttttccttttcatttctggatcatatttcccctactgtttataaactcaagaggttgagttcttccttttttttttttttttttttttttgagatggagtctcgctctgtcacccagtctggagtgcagtggtgtgatcttggctcactgcaacctcccctcctgggttcaaacgattctcctacctcagcctcccaagtagctgggattacaggtgcccatcaccacatctggttaatttttgtatttttagtagagacgtggtttcaccatgttggccatgctggtcttgatctcctgaccttatgatccacccacctcagcctcccaaagtgctgacattacaggcgtgagtcactgtgcccagccctctttttgttattcatgttgtatactcttttctttttgtgaaagtggaaaaccattttcatggttattccttgtcctactcattaaatgatccaaactgtagccaccgactatactaccacacatttagctatgaaaaatatactgttcacctaggatagcaagattaccaatacttgtagtacaatttaaaaattatggttactgtttgatttaaatccaataaactgattttaagtaactgagagtcagggcctccaatagataacttatttccctatggatttgacaatcatctctattgatattgattctgaaatttattgtatccaggccagacctctctgcttgagctccagactcatctactctctatgtatcagtatatgcctatttaggacaccaggaaggtggctgaactaaggaggcagggcctgtgagatgtaaagcagcatcatgcaactttcttgtgaatagaatataaacatttagcaattacctagccttggggaataatgattttaagtgctgagcttacaattcaaaccagaaaaaagcaaacaatggctataatcaggttatgttgttgaatataaccatgtgtatcagtaatacacaggacagtgagatacctatctacttagctatatgacaactatcaccagaatatcagttactcagcaactgaaacatttttttttttctgtttaaatcttgctttccttcaaggatatattctggcattaattactttttgacagttacccaatcctcccttctctcaataatgaatttatttttcatatatctgcctatgatgctttgtttatatttctgttaatgcagttctctctaatcatagtaagacaggatatattaggtgtttacctgtgcatgctacagctaatttctgatctctatgaattaaagaaatatggactttttccctcctttctcacttcttccctttctcttcaccttcattctttctttttttctttgtatttcccacaatgtctggctcattataggtgctcaatagcttactggtgtttaaacggaatagtttttttttttttaagtaatcagctgacatgttaggcaaccatttcatattaaacattttacatcaatttcattacaactttaagtagttaatttcttaactcataacagaaaacaagatacttccctcccagcttatatcagtattatgttattaataaaatttctatcctatttttccaggcacttttccttctaatagttgctgacaatgagtcatagctacaatgccaccacaggcaggtctcaggggatcattgtccccacaaggcagtgcattaatttcacactgtggttcattaatggtattgtcaatgcccccatggggtatgggtgtttgtgaatccctgatgtttcctgattacttggtttgcactctattccttctccaaaaagtcattcccactatgctgtcaccagcgaaaacactgcctagtggtacatcatgtaaactatgcacatagtcacattctattactttagcattttatattgcacctgttgattttatttataaattgattttccttctgctaggctaaagcatgttaatgattttctgggtataatgtgataagctatgcatggaactttcagatgaatctgtcagttctcattgtcttcaaaactcactaatattccctcagaatattttgaaaagccttatttggaaattagtttaccatataaattaatttatagttggtagtttaaaagtaactctttctgctcttgtgtgaaattcaacatctactttaggtaaatgtaaatttattatataggaaaaaataatttaacagctaaaaatatttgataagtgctaatatgtgtcaagcacatgtccaggtactggcaatatatgataagagataagaagggtgtttacttttatggggcttttgttagagaatttagcagaaaaaacaaatacacacatactcatagatagataatatatttagatagcaatacatgctgaaataaaacagtaaaatgcgatggagtagataataatgctggaggggattgtggcactgcagctagactggtaaggaaattgcattctgagatggcggcatttgaactaagaccaaaaaaattagaagagtcacatggaggtctatgaaaacaatgtcctgggaagaagacacaatgaatgaagaggctttggtgcagaaataagcagtggtatgttctaagaatagaaggaagaacattgcggctggagcataatgtgccaaagggagactagtaagagattactttgaataggtagagaggaacacgatcacatttgatttgtaaatcattttattctaaatatgatatgaaaccattggaatgttttaagcaggggaattatatgattaatctacgcttaaagattattccaggtactctgtggaaaatgtactagagaggatctaaaatgaaattagaggatcaattaggaatctaatatgctaatccaggtaagggatgaagatagcttggaattgagaagtgcaaatgttagcgatatattttgaaggtaaacacaatgtaatttgctgttggattggatgtgcggagttataaatagagaggagcaaagggtgagcttaaggtttttggcttgaagaaggcatggtagaaacataactgaggtggaagtgtctggtgctgaagcaaggtttagaggcatagactccaatatagtttggctctgtgtccccacccaaattgtactcccataattcccacatgttgtgggagagacctggtgggagataatttgaatcatggggcagttcccccgatactgttctagtggtagtgaataagtctcacaagatctgatggttttatcaagggtttctgcttttgtatctgcctcatttttttcttgtggctgccatgtaagaagtgccttttgcctcctgtcatgattctgaggccttgccagccacatggaactgtaagtccaattaaaactctttttcttcccagtttcgggtatgtctttattagcagcatgaaaacagactaattataataaattggtaccaagagtgggatgttactgaaaagatacctgaacatgtggaagcagctttggaactgggtaacaggcaaaagttcgaacagtttggagggctcagaagaagacaagaatatgtaggaaagtttggaacttcctagagacttgctgaatggctttgaccaaaagcctgatagcgatatagacaaataaggtccaggctgaggggttctcagatggagatgaggaacttgttgggaactgaagcaaaggtgactcttgttatgttttagcaaagagactggcagcattttgctcctgccctagagatttgtggaactttgaaattgagagagatgatttagggtatctggcagaagaaatttctaagcagcaaagcattcaaaaggtgacttgggtgctgttaaaagcattcagttttataagggaagcagagtgtaaaggttcaggaaatttgcagcctgacaatgtgatagaaaagaaaaacccattttctaaagagaaattcaagccagctgcagaaatttgcataagtaacaaggagccaaatgttaatccccaagacaatggggaaaatgtctccaaggcatgtcagagatcttcatggcaggccctcccatcacaggcccaggaggcctaggaaaaagtagtttcctgggcctggcccagggtcccagtgctgtgtgcaggctaacgacttggtgtcctgcatcccagccactacagccatgactaaaagtggccaaggtatagcttgggctgtggcttcagagggtgcgacccccaagtcttggcagcttccatgtggtgttgagactgcaggtggacagaagtcaagaattggggtttggaaacctctgtttagatttcagaagatgtatagaaatgcctggatgcccaggcagaagtttgctgcaggattggggtgctcatggagaacctctgctaggacagtgcagaagagaaatttggggttggagcccccacacagaatcctgactggggcaccacctagtggagatgtgagaagaggtcgactgtcctccagaccccagaatggtagatccaccgacagcttgcatcgtctccctgaaaaagcttcagacactcaacactacccgctgaaagcagccaggagggaggctgtaccctgcaaagcaacaggggtggagctgcctaagaccatgggagtccacttcttgcatcagtgtgacctggatgtgagacctggagtcaaaggagatcattttgaacctttaaaatttgactgccctgctggattttggagttgcatcggccctgtaaccactttgttttggacaatttctcccatttggaatggctgtatttacccaatacatgtacccaaattggaaccaggaaataattagcttgattttgattttacaggctcataggtggaagggacttgccttatctcagatgaggctttgaactgtggactttcgggttaatgcttaaatgaattaagactttaggggactgagggaagacacgcttggttttgaaatgtgaaggcataagatttggaggggccaggggcagaatgatatggtttggctctgtgtctccacccaaatctcatcttgaattgtactcccataattcccatgtgttgtgggagggaactagtgggagataatttgaatcaagggggacctttcccccatactgtccttacggtagtgaataagtctcacaaaatctgatggttttatgaggggtttccgcttttgcatcttcctcattttctcttgtggctgccatgtaagaagtgcctttcacctcctgccgtgattctgaggcctccccagtcatgtggaacctccttttcttcccagtctcaggtttgtctttatcagcagcatgaaaacggactaatacagactctcatggcactgaccagattttgcctcctattacagttttaagatttatctatctcctctactaaacccacagagaacagtcacatctgagagttccattcaggctgactagaaatgttatttcctttcccaagccctgactactcccagcatttcatctggcctatatttattcatttggctatttcctccccaaagccttccttcatcctaccccaccatctaaattaggctctggtacaactctagattcacattctctgacagtaggaaaatcattcagaagttcatcataaaaaatatattctggccaggagcagcggctcgcgcctgtaatcccagcactttgagaggctgaggcaggaggatcatgaagtcaggagacagagaccatcctggttaacatggtgaaaccctgtctctactaaaaaaaatacaaaaaattagccgggcatggtggctggtgcctgtagtcccagctactcaggaggctgaggcaggagaatggcatgaacccgggaggcggagcttgcagtgagccgagatcgcttcactgcactccagcctgggcaacagagcgagacttggtctcaaaaacaaacaaacaaacaaaaaatacacacacacacacacacacacacatacatatatatacacacacacacacacatatatattatatatatatatatataatatatatatatatatattctccacatgtgcctacctgatggaggaaaatgaattatacgtgctctgcatctaaacctatttctatatagtttcactaggaaaaatggtaattttcaatactatatatacccccgtatggtgctttatatttacaaaacctctgtcagcaacattatttaattaactcatctgagttctcctgctagttaactatttattagtgttactaaactctatatgagaaaagtaagggtcaagactcttcagacattttaattaagattatgagatagtgatagtactgagaatcaaatttagaactctgttacaattgcaatcttccttccgccctaacacagctttttctgaagtcccaaatatttaattttaaccttgatttaatttttaatcttttgctttccttcactacatgtattcacatacacacattcacaggttttgcatataaatatccatttacattaagaggtcaagaagcttgggcactttggaaaggtcttggacaaagtgaggagagcagtgacaagtgtgattatagtcctgtaaaagtgaagctctataaagatcttccctcagtactggatgtaaatactaaatatttaaactcagaatcagtttaaatagatgtcctgcaggcactaaatagtggataaaatatagtttacattttaacaactagttattatataatctctttcaattttccttaattgtacttaatattaaatcattttattcccactattggggtatcagaggatatttacaactataataagtgcaaatggacaataagaaaactaattttctgatgctttggccctatgaagcccagataagaactgagaaaaatatactgtggatttcagtacaaagctcaatagcatccataaaatattgactaaaagttggaactcttaaattttaataaggcctatttgctttcttaattaaatatagcctaatgaaaagtaattaaggtacatagagagatctggctagaaatttttttactagtcctgagaattttgtttagttatatagacaagttccaaaggaaacaaaatcatccaattatttattcactattgtcaaagacatcaaagatgaacagaatctctcttttatttgctcacaaaattagaaaattatattaattatatatattcatagttgcatagtagggaaataattgtctttggatcagagagacctgggtttgattctagcacctcatcttgttaggcgattagacctggaacagttagttaacctccatgagacatgctttcattagctgcaacatgtgagacaaaagaaccaaatctacatatttattgttatcattaatgttaaaatactaaaagcacccatataaaacggacacgaaatgaaaggggtcattgtaagattaaaaaattaataacgtaatgctcacagaatctagtacagtacctgggaacttgataaatatttgttgaataaataaatactagatactgctaactgtgatactaaataggctactcaatgtttcagtagtttccttcccatttgtaaaaacaaaacatgcctccttatttcattcaacaaatatttaccaaatgcctgctctgtattaggcactgtgttaagctctagctactgggaataagttcaactttcagaaaaattagtaaaacacatccctgaatgaactatttccagacactatgatgggtttggcagcacaaagaacaatatgaccttatagaaagtgttcccagtgtagttttgaggtgtgaagacttcttagagaataactgagatgtataagccatacaaaaatggcagaagaactgaagtgatgaaagtaagttataggtgaaaggaacagtataaatactaagaaagcatggcttattctgggctcgtgtggttttggtgtgaagaacttgtatactgcagataaactggctaattttcttaatttgtcactcatcaacttctttagatgctgatcttagacagtccctaagacactgttgttttccctttcatccggattcagctttagcagatcactttctgatccccagctctgtttttcttctacctgctcagctttaaggtcacgcctatgccttctggtgtctgacgtcagttcatgaccttcactgacttcctacctgtgcactgttcttgccaagaagtcagaggcttggctgtggagcatagcgatacgaataaccagcagacactatctaagactaagccaggggggtataaacaggcctgatctctttattccaaaattaaaagaacattttttttttgttttgtcctttattgaagagatatatttaaagttccttccttatgccagacattgtcataggtactggggaatcaaaataaactgtcctttaggagcttgttctccaactgggtaaataacataaaaccaaatacataacacagcaagggaggcgctgataaaaatctatgaaaatgtctataacacagagatgattcttatctggtagtaaatttttttaaactcagatacataagaatacaactgagcatatataacagaggcatcacagttttattattttctgctttatgattaaatcaactttttttattacagtaatggttttacaatatgagaaacttgctttaccctgaatttcagatatttgattctaacttaattgtccacattttgtttttgaacagaaatccatttgctttttgggagaaaagaaactccatcattatgggaaggcatattataaaccttgaacaaaaaggtaatatcatgaaatagattcattcattaaaataggatattatgcacaactccccagtgatatttttattcatgctgctttattttttaaaaaaaaatgagttctgaaatgaattaattacaatttatttttaaaaatttcctaattcctaaggatcatcataatttggcattgataggtaaataactaaattctgaaaactgctgagagtgcctattttggatttgatgtcacactaggtgtggagatgcctcaaatgaatgacaaggtccctcccctcgaggatttgtcacttcagtcacagacagataaaagctgttctgatgtggtgtgaaaagtgctcttttattataaatcaggttgggttggcagtaagagggggccatacaaggtttcttggccagaggtacaacctgcactgagaattaaaaggaaattctataattgtggaatccacattcaatttcgacttcacctctttattcatctttctgctcagtggttttgtttagctctttagatggaacctaaataggtagagtttggacaagaagcaatttaaaaccagcctatggatcaattttttagtctgatatgtgaagtttgtaaagcacaaagaggctccctgcctttaaggtcttctgtaaataagtttccactgacacttgaagagagggtggaaactaacgttaagcccttcaaattgcagagaatgatgggctgggaagagggctggatgaggagagcagcacaaaaggtggtgtaggaaaggatagtatatttctaataaagttaaatagaggcttaaatcaaacactttttctaccataaccatagttttatttttttcttgatcactggagaaagggtcacatttttacataatttaattattgtatttatccatgtagtcattttcccatatttgtgagaataatgtataaatgtgtcaaaattttggtgtgtggtgtttcaaaaaataatagttactttagccatgtagaataaacttaaagtgaccttcttattaaaagtacaaatcactatgcagccaaagcaattagaaatacggttggatatagcaaagatttcacctacatccatagttttaaccaatatctctttatcattgactgttttatacctcctgatcatacttctcaccttctctttgctatgtctgctctctgccatctgggtattttacagacttcaatctcaacatctactttcattttgtattttctaacactgtgatagatgtgcatccactcatgtatttaagctggaattttagggtttatcctgagttcccacttgtctcttttctatgacttacacgccccaaaaccaggcatttaatcaggattctgttctgttattctatcataaaaatctcttaaacaggagtcttttcctattagacaaggaatacgacaacaatcgacaatctggttctacaataaactttttataatgtaaattttataacatgatcctcccctttgaagcagctccctgtgagcaacaggaaagtccgaaatacttgcttagcatggcctatgggcttcaaaatctggccttagctggtgctcagttctcctaatctgctatacctctctccagagaaatattctgccccagaaacactggaagctgcacaccattttcttttgtttcttgttaatgcctgctaaagtctcaatgttcagctcaaacctcatatcctttatgagattgttctagacccaggatagttagaacctctcttttatcctttcttagctcccttaccttattatagactttatcactaggtactatactaattcattttctgatctgtcattcattgtgggctccttaaaggcagaaacaatgatttgcctatatctgtctttagcaattcctattggattttatacagagtaagtgcccaataaaagcttattgaatgttttaaggcatagatgcattaatggatgaatgagtgagtaaatgaatgaactaggttattattagctacagaatagcttcaaataaagacgaatgctgaatgaacaattccaacccccccacaggcccttatgacatccgaaagtcccatcactgatgttctctgtcacctctagtgagtcacttagtctctcatctgtaaagcttaattagtgcttcagcaataagctcaagctcttaaaatgctaggtgttaaattcattgcttcagaaaaactgtcatgttcatagtcatttggaataaaactgtaagatatgcaacaagactccattttctgttaaaaatgctaggtttcctcatgcctaaaatagacttaatggcagctggctcccagctactcctgaagatgtcacagcttcaaacatgggggtattgccacttctgagactcgaagttccttctcttaatttcagggccaccctccatgcctccatcctggaggcctgcacagggtgggtaatcatagtcaacgtgaggagaaacaaacaggcaattctcctaatgggaacagttaactggctcactgtcagtcagaaggctggcaattttatagcttctccactgtgcctgaatcactgcactgagtggtctactgcagagaggagaaaatggagtttgtatctcctatggttcttaacagactgcagaattaaggaaaatataaatggaaaaaaaaagtttaaagctatacacgaagattacatagcacagaaacaattcaattcaattcaattcaattcaattcaattaaacacatgtgtttttgaggtcctactacctacaaaacactatgttaggtactatgggagaagcacttataaatgggtgagagaaatagttctgagcttctacagtttcatacagagttgtacaattttccactaatataaatgaacatgtataaaggctagtatggaaatacaaagtagtgaggagataggaaagggaaaggtgatttctgactgggggcctgggaaaagcctttcgaggaagcagaacctgggattttgggcagcctctcaaacagtctccctcattcctgtctgattctgaaaatgttgagaaacaaaagatggaggaaaaaaagtattcaccataaataccgatgacactaggctgggagcttagtctaatgtcaaatgggtttgctgaaactgacccctgaaaataggcagacttacccaccgatcacggtactaggagactgggctcacctctccatatggatgggctgcccatgtaagccttagaaccccaggatagctctttctctaaaagaattttcagtccctaaggaaataaggtaaagatgagctgagcctagttactcttctgaaacttacaaaataagtcactcctcctcctctgagaaaagcctagagccacactaattgatctccttctaaggaatgaaatgttaggtgtgggaaaaatacattcctaatgcgtgataggatcttaatggtgagagggaaggaaggacatctcaggctgggtaatagataaatgtgaaatttgtaagcaagtcctgaggagacagaaaaatgtcatgattaagaacactctttttgtagtaaaacagacatggtttaatcttgactcttttttgatctgaataagtcacctaaatgctctggcctggttttctaatctgcaaattggagataatagtacccgtttcatagaactcaataaatagttgcaataatatttaaccaccagcataattgagcatggggatatgctgcataatcagacacttcctttacaaattaattttggaattttaagttttattaaatgatctatttccttttaatttatcagcttggtgagatcaaattcctgtgtattgtgtttttcttgaagtgaactgtaccttttacacaccgttaggtctcctatattgctattttatatcagtacaggaggagagtggtatggattgtggggacaggagagagcagcataggcaggtacaatgaatagcacacaacaaaatgtagaggtgaatgcaaggatgtgacaaagtgtaagtgatgtggtatgaatttaaatgaagactaccaaaggggaatacaggtggaaagaacagcaggcataacttcatttccagctccatccttcttagagaactatttttttttttttaacgagagcatgccaatgagcttgaaaagtgttaaactgaaccaaaaaatgatatctctaattcttcagggtcccagatgcttttaaatgcatgattggacaatcataaaactatcatgaccatataactgaagatgatttaagaatgtactttcttggttatttagagagcaatgttatgggtgtttttcttttattatatagatatgattgcttatgattgcagtatcacattaggttattgattacatggtactctcgggacagattatttctcttgtatatgtatatgctaggatgctaaaggacatctaccacacagataatttttgaagaagatgactacatgaaaaactgagatcttcaaatggaagcatttttaaactcctcagtgaagcatctactctcacatgagctctgaacttaaccatataaaacatggccttgtaccaatttaatgactgatgcaagagagataagttatgcatgtgggtcaaaagctatggaataattgagagggtttattcacagctctctaggtatgacatctgacaaggagagagaaagaaaatagcaaagagcttgcatgtctcttcgtttccatcaaatatattttcagaagcagaccaaaaggagttgtctctgaaatttaataacctctagaaatagttacataacatgtagaaataagtttgttttataatatgcagttcttagatgttgaaaaaaaaagattgcttgatcatttcttaacccagccatcttccaagtatgtacttccattatttatatagtggagctgtcctacttgctttgtaaggcaaaatactgaaattcactaaaaagaacttctcacacaaaggtacatttctactttgtgtgatattacttactgctttgaatggcctcaggtcagtatttttaggaaataactatgacttttttgactaagtcctctagatcccaagtaatttttatctttcccattgccaaagaaacattcatatgagtctaacaagatgacttagattaaattcacttttatatttgaatatttcctggggcttttctataccttccaaatacaatggtcctgaaaggatatttgtaattgagttttcaaggaatcaacacctatttttggtagttgtgttattgaaacgggagtgtagttcccttatccctctcacagggcgtgagacagggtgtggctcgcttcttccatgctctgctgctagaagccctaggggaagcatgcagaagggtaggttgtgtggagcatttatgggctcccaccccatcggcgttgtccagggttgagtgtttgcagcgccagaaacctcagtaggcatgtgttacagtttgctctttcagttttgccctcttcaggcgacttgtgtgaatcagctcaattagaccctctgccttaccacaaagacagaaggctttctgtatcctggattcttgccctagtgtaccagaaaaattgggtcacacttgggcttggaggatagatacaaagttttattagctgtcagtgagatggatggggaggccagaagggggatggagtgggaaggtactcttcccctggagtccgattgcccagcggtagggctctcctcccactgctcctggctgaatttcactgttgatggtctgccagcgtctgctggtttctgtctgtgggtgttctcttctgctcctctccatgtccaactgcttgtgtctgtgcctgctagggtttccggtgttttatgggcacagaatgggggcatggcaggccagagtggtcttgaaaaatgcaacatttgggcacaaaaacaggagtgcctgttatcacttaggtctgtggagcctttgtcagggaccccacccttctctacccagcacttccctgcctccctgcctcccttctgtggttaagaatgacatgtgatttgaacattaaataatcataatgtccaccttggtggggtatgtggtttaagtgaagtggtcatctgtaagataataattgggatttccaagtcagacacacctggattccgacatttgatatttgataatgaagccctgctgggaaaattatgtaacatttctgactctagtttattttttagcagaatgggttttataatgttacctatctcattgaatggttgtaaagattaaatgacatgaagtacgtaaagtgctagcacagtatttggcatgcagtaagccctcaacatgtaatttggtgttattacctttgaataagataaatggaagaaatctttgataacttatcactaaactccaaaaaaagactaaatttcgtgtcaaatgattgtgagattttaaaagaatctttggagaaggtgatgctgtatctctgtgtatgtgattttcctttaaaaattttttctttctaagcctaccagctgcaacttaagcacatatccttttttcaatatttccagattggcacaagagctgatttggcatataatttatgtctcatgtgtatacagtatgtagtgtatataattgctatatatagtattttttataaaatgttcatcatggaattagattctaagtcagcaattctctttcaaacgcagctgcatccaaatgactctttccctggggaaggaaattttttattttcccctaaggtcacacaaagccataaatgtgaagagcagctgacagaaggcagtttttctctgcggcactttttcctgacagtagtgccatgatgacccttgtgtttggttctgtcactaggattgatgcgcttttgtatgggttcccagaggaccatttatgttttgcaattccttccacagattaggatagtgctctgcaagtgctcactcaatactcatttgttaaccaacagtaaaatactacaaatggatacctgtagaagcaatgcaagatcatgttctttatcttccaagtttgtttactacaatgtacaagtgcagccacaaggtacacattataaagatttagtggtttcctagcctcagatccatggactacataaatgccatgtgatatgaaacttacttgaatgaagcagacccacaaaatacatgcacaattgtgactaggaaagtgcttttgtctagacagaggttttataacttttattaatttcctaaaggatgaacaattcaaaaatcagggatcatagcactgacaaaagctctaaagtaatagatttctctttgtatgcaagtgaaatctttaaatatataatcacattttgcctgagaatgctttcatgtttatatcttggcactacttccattcaattgtgctaaccaaaaacccagagagtcatactggacatcttcttgctcatatgtaatccagtatcaagtgctgtcaactttactgactaaattctgttcaaatccatctgcttttctccagctctgctagcacagttaatccatgctatcatcatctttcatcaggaaaacagcaatagactcaaaattctttactgtcattcagactcgtcctctgccaatccattctccacagggtagctagggaaacttttaaaaatgcagatctgattattaactcccctgaataaaaagtggtttcccatttctctcagggtaaagacaaaagtcctgaacatgaccctatatggtcgggccctgcttgtcctgcagattctctttatgccatgctcttgtttggtctctctattccagctagaataaccttctttttattctttatgtgtgtcatgtcctcttctaccaaggcttctcagcatgtattgtttcctctgcctgaaatacttaaaaacattttttctacaaattcactcttagtgcttcttatatgctgcacatattactttagcaaaatcttccatgacttccactattatacaaattcatgaaaccatatgctctgtttcagagaacttgttaccttgctagcacaatgggctcaagaagagagtagttattggctacgtatggattcaatagcatgggatcttattctccagatttgatctagttactgccaccatcaaagggtctgcctagaagtaacagagaccacagctgagtcccctgtgtggcaatatgtttttatttccttgttaataatttgatgaatgtgaatctttccagttagactgcagtctcagtgaagggaagtattcttaatggtcaaattttcaggtcttggcattgctcctggtacagagaagacatccatatgaacagactgaatgaatgaaaaaatggtctccttcattaagcataatatttgtaaaagtagaaattatgaatgtatggtggattgaacaaagtggagaatttacaaccatcttccttgagatcaaatgccctttccatctgctctctagctatatggtctcagattatacaagtggttacaacctatgagtaaggactattgctatttcaaggtacagatggagaaaactgagacttagaaaacgaacaattctgcattagtctcccattccgacaaaacaaaaaacaaaacaaaaaaaaaaaccgagttattctctaagggtcattcttacttacggcctctaagaaatttgggaatgacaatgtgttctatattcacattctttacatgggtcagctgtgaaagtgacttagacttgtaggtagagacagaggctttgaacctaacttttcactacagcattttttaaaaaaagcatatgaatgaaaaactcatcgtggaatcagatcccaagcagggttgagagtttccaaacttctcccatttcctaggccttatctctttcttattatcctttaaaatgtgtgcagtagaagctgtgaggtgccataaagatttctcttcaggaccaaggcagtcattcctttggctgccaggagtgttgattgctgacaactcacagctgagtctctgtctgggcctctccatcatcttcatctaagagcagctaggaagctgccttaccctaggcactcccattccatggggacagcctgcttcgaatgaagggtatatgtacaagtataaaagctgccctcttacttcaaatagagacaactctggagggggcagtagaatttcattataagatgtaaatgtgatacatgtggatcaagcatgagcaagactagtagacactaatttgctgcacgagcagagtgtccaggtctaatgccattcacttaaatattgatttaaatacgttatgtcagcatttctcccagagctgacacctgtggctgcatgagaagtctcctatgactcgatgtcagaggagacaaaaggtaagcttgattcatgaatgagcaagttctgtgtatgtttatagcaaaagagatttgaggatgacactgtgcagttggaggcattctataccatagaccttaggggagtcctgaaagataatggtaacaggaaatcctcccaatggataaaactttagtgaatatctacttcatgagggaagaaaagtggcccaaagtgaataagtatgaattattggacagagttgaatggcttggctgattgattaggaaaggcctgcaaataaaatagataaaaggtaatcaggatcacccagaaagactggggaaaaggtatatatgtgaacctatgggagtggccagggtatgaagatctttgtatttcatgttaaggtttatcagagaccatctagtacacaggaggtatcaaacaaccatttaatattagctatcctctgttatcaggcatcccattgctagcatgatgggctcaagaagagagtagctatgggtgatacatggatctgaaagcatgggatctcattcttcagaattgatatagttactgccactttcaaaactacaacctagaagcaatagagacaacagctgggtccccagtatggcacaactgctcaaggagaccaaccagctatttggtggaatgttgtctgcattgtacttctactttgaaagggcaaataacttattttgactgaaatcaaaagtattttccatgtgaagatttactgttccttttcacagggtctcagctagaaccactatggcagctcatagagtaatctaccaccatggcatcctttataatgttgcacaagacaaagggactcacagaacagccaaggaggtgtgacagtggtgacatgtagatgggacccactggtcctacacatttggcacctaccagaaactgctacacatatacagcaatgggacaggctcttcaaggtacaactgagatactggcttaggtacaatgccctgcacggatggggtgccattttataagatgaaataaacagctttaaccaatacagtgtttctgtgtccctaggaggcagaatacgtttgtgcagcaataagacaattgatatatgagtggtcccacttaaccatcactccaagtgtcccatttgggttttctgtgcttttcatccctacaaatctggattctgtggctccagaggtcctgcttcccaaggagggaatgcttccagcaagggacacagtgagtttcccaataaccttttagatttagctgccactcagccactgtaggcttcttgaatgaagaagtcaacaagcaaggaaagaaaccaccatcttgttagagcagtggggctgcagatccacagtttttaccatgacagggaagagtataatcactggggtgtcttttggtacctccttgccatatcttgacagaaaattgacaagtacagtggtcatggactaagaaggacatggtgatcaggaagtcagacctctcagggatgacattctgggtcacaattagataagcgatcaagacaagcatagtcaagggttcttggaagagtgagggaactttagaatgcaccggagaggataacaatagcaacagctgaggactcaaggtcagcttcagaggtggggcctgtagtttgttccaccaaacttgctttgtatattttccctggaaaagaaaccaaccagaatctttgagcagctatttctagtacagatagttaggtcatgattctgtcttatacattttagggaagtagaagttacagacaaagtcataaatcgatacatggaggttacattggtttggcccaaaaaggtagaacatcttgaagcaggggcttacaggtcataaatgcgttctttaatttgcaattagttacaggagtaaaacttttctaaaaacttggagtgagaataaaggaatgtttaggttaagacaaggaaggctgttaaccaatgtactgggtcagcgtgacctgtagggttacatgacttaactcttgtctggcatacttaggtaatgtttataatttgatatcttattatcaaaaagagtgtcttttgttagtctcatgatctctattctaacattaatgctggccagttgttgtgtctaaagtccaaaaaggaagggataaaatgagtcatatttgacctcccttcctattatggtagggaattcagttttaaggttgtctgctgtcccgttagccaagggggcattaattcagtctgttggttgggggttaggatttcatttttagtttacacactatctagttactatgaagtaactatatctaccatatagcctgtggtagatagatacaaggaatctgccttatctgaggtattccccatccatggcagcaatcttccaatacagaggtacaaaaaggaataaatacctcaaactgggcctaccctgaaaggttatccagctcaagagtttcaaatggtcagtgaaagatctctgttgcaactgcctcacagtgcagcttctctttctgtccagtcctgcttcgctcagctctcacaggtgtcaccaaaattactatccaataaaacccctatatttgttgtgatcccaaaaagaaattcagctactcctaaatgtttggtgtttacttggctttctgggaaggtaacatgtagttgacagtaatatgaaagatattttagggccatttcatatgatcacaatcatatgatccattgaagactcattgataaggtgttatggactgaaatgtgactgcccaaaattcatatgttgaagcccaacctccaggaccttagaatgtaatcatatatggagataagtatataaagaggtgattaagttgaaatgaggctgtttttgtgtggtcataatccaatgtaactgatgtcattataagaggagaaatatacaccaggggcaccatgcacagagggacagccacatgagtaggcagcttgaggtcaaccatctgtaggtcaatgggagaggcctcagaggaaactaaccctgctaaccaacttgatcatagacttctagccttcagaactatggaaaaataaatttatgttgtttaagccattcgatcggtgatattctgttaggtcagcctagcaaactaatacctaagcatgctttaaattgggggatataatatcttgtttgacttaattagcaaatattttctcaacatgggcaatccaaaatgaagaatccagtctaaaatgttgttgtatataaactctaaagcattggtagatgtctgtaacctggagaaagcgctgggtcctctccccagataacccctttctgtcccatgttgtaaaccctctacacctccatggaataatcaagatcactaagacaaatatttaaagaaagaataattctcttttcaatcacaatagttcctatttattttactatactctaaagaataataattgcaatcttttgcaaagaaacttgtcacattgggatagtactggacacctgagggatggtatgtagacatctcatgttaccttaaaacactttgtccccaatctgtgatcacagtgggactatgggtcaaaccaaacctagttcaattaggggtttttagtttgaaacaaaaggttgggcaaatgacaagcaatatgggttgggtctgtgtcctcagccaaatctcaccttgaattgtagttctcataatctccacatgtcatgagagggacccggtgggaggtaattgaatcataggggcggttaccctcacgatattcttgtgataatcagtatctacccctaccaactcctaattgtgtggtttctcacatcctggctttttgctgtcatcagtgtgaagtgggaaggatcaaactataatcattaaaataataatacaataaatgcagtacgacaatacaaggtctaacttttataagcactgacaatatgctaaggtcctaataaattcatgtgcctcaacctcatcaacccttccaatacctggaatatacctatcttagtcagtttgggctgctttgccaaaataccagcgactgggttttttcaacaacaaacattaatttctcatagtactggaggctagggagtccacagttaaggccctagtagcttcagtgtttggtgagggcctgcttcctggtttactgtcctctcactatatcttcagatggcccttttgtggtgcatgcatatggaagaaaagagatgtcttgtctctttctctttctataagggcattaatctcattataaggtcccactttcactacataatctaatcctctttatcttccaaaagcccacctccaaataccatcacattggggcttagggtgtcaatatatgaatttgagggaaacagaaacaataatccatagcagtacctattttaagaaaactaatgctaaaagcagtgaaggaccttgccccaagttaggtggtaagaaacagggcctgattttaaaaccagaacttactctccattgagaccacactcttacacacagagcatcagtaaaagtcatgtctacatagaacaccaaacctaggatgagaaccactgataattcctctgccaaagaaactcaaagccatttctgccagaaaaataagcccagcatataagaggaactgcacattttgaacattattttctcatctctgagactgttcagccagatttaatggaccaaggagaaaaagcagatgagtaactgcttgacccttttgccctctccatgcctgcctttcttccatctatctagaccttaaataaaacatgggactagtctatttgcaaagtgctgtccttggtgctgaggatggaaaatgaacaaattaggcacagccctttgctttcatggaggatttttttttcttcctcttcttcgctctatactttttctgttctctcctaactaccatttccccattcaccctggaaggaagctagtttttcctatgataattagccttgtcttcccttggtctgtgaaatgaatgcatggtctcacttcatattgtttgcataaactctccctctacctcttttcctttattttgtaattttcctttcatctcttattttatctcaccatctctagcatcagcataaacataacatatgattgtatatcaaatgttcaagaggttctaatcttgttacaagtgtgtaagaaactacatatgttataggtaagacagttaacacaataattacccatatcataaaagaagcagaatatctgagactcactttctactctgtccagtgtggggttggatgagatcaatgggggttcttcagcctggaagcacattagaatcacctgacgagcttgaagactcagcagtgcttgagctgcactcccagggacccttactcaattgacaaagtgtgagtactcaggattggtattttgaaaaatctccccaagagattttaatggcagccaggctgcagaaccactggacttgaccattcctttaggtattttctggctttaggattcagtcacctctaaatgtatcttttaaaaacagatgctagaagtatcactgttttgaaggcccacatttcatccccacaccttattttggttaattagcttttgtggtgaggatgcactatagcatggtgaaggtgaaggttttgacatggagttaggtggtgctgcataaaatgtttcctgagtagagcagggttttttgtttgtttttttttctcctaccttgctgccattcatcatcgactgcaacatcttttctctctgctttctgctaatctcatatatattccatcttccacacacttgccaagaatgattaatctctaaaaaatccaatctgatcttatctctcctctatgtttctctccccttcaataattatttcccttaggatcaaatgcaaacttcttgggtatgtcacccaagaatctgtctccatctctcaacttatgacattcaaaatacatatatcaaacttattaaaccaatctattaaagcacttactatgtatcacacactttttagagtgcttaaatgtattaatttactgaagcctcaccacaaccctaagtgttagattatcactattctccattgtaccaatgaagaaactaagactcacagagattcactaacttcccaatggcacacagctagaatttcatagtcttgggattcaaaatctgacattcttttcccaaatcctgtgcttcttgatgagtatgtgttaatacctgccttacataacccatcaaagttcacttgttttccttctattttgaatgtttatcttccatcagatcttcgagtactgatcaatatctgtgatctttgaaggtccagttgtgttaccattcccagaagcagtccctaagccctcacccttcctcactcaagatttagggcttcttctctactatccaggcacattgtttcaacatctgtgttctggcatttattgcactatattgtaattttctattaaagtatctcccttaaagcagagtaaaatccagtctgtgaaatccttgaaggcagcaaatatatcttttatctctgtattactatcctccaccacattgaagagtgaagtccccaatatgaaatgttcttttagtaatattgcgatacaatttatcatctaacccaggaaattttggaaggtgctattaataattttcctgtgatgataggtatgaacctggatggatggtcaccttatttttaaaactgctttctaaggtgatttttctaatgccttatctaccaaatcctcccagaaataatacagaaaatgttctgcctttaagtatttttttattttgtgagtcagattgtacaaattctccaagatatgaatgcttataattcctcaacatctacacctttgcttgtagcttagtgtaagaattagtaattgaatggaatcagtatcttgttaaaggaggtggtacttagttaaaatgacaaatgaatggtgtttttgagggaaagttcttgaagttgacgatcttatatttaagtttattgctgattgacatgtacacatattgcaatgtttgaggatcagtgaagtagaaccttctttctgtgtcttatttctgctggaagtgctccaaggaatgattctgcatcgctctgcacaactcatttctgagtccctccaggagaacacttgtggatgatcagattgatcctggcttagtgattaagagtgtggtattggtacttgagtgtatggggttcactcctcccattagctgtgtgatcttggatggattacttaactgtgcttcagtttctttatctgtaaaatattacagtagctatcacatatagaattttgtgcattaagttaatatctaaaaatacttaggtcagtgcctgggatttggtaggttctatataagtatatcctaattaaataaatggatagtgtcactgtaaacataaaggcattcttctcttttccacccacatgaggggagatagagatgtcttcctatgcataactactccacttctctcatatatgacacctgtccatatatttttctctgcatctggctgagtgtgttggtcatcacttcaagtttctatgccacagggcctccagcagataatataattttgaggtttaaatcatctagaaataatttaaagtagacaggaggatgtgtgtaggttatatgcaaatggtacaccattttatatgaggggcttgagcatctgtggattttggtatctgtaggaatcctggaaccattcctctgtagataccaagggatgactgtggccagctaatgaaaagtgttactttccatctaatatataagttctttaggattatttggagagaaaggacatttagcagtacaagatttgaaaattctttgcgcctttaactaatctcatattatatcattaaaaccatatgcttttattgactgaagagcattaagtagtgatagatcaaagaaagatcaggtagcctacaaacttataattactctgttaccatcactggaaggcatttctgattttccagattatggtctttcttttatcaccttcatggattttaccttatttgagaaccacctgcactacaattttcctcagttttctttatattccatatttgaaaacttaaatatgtttaaagaaaacactatgtcactactataaatgtaggagcaaaattgccatttagcttatcataaatagaagatagcctaaaaataaatatgatgacaagaaaagagtgattaagcagatactcctgcttgccaacatgttgagtcccaggttcgctccccttttattgcaaaaatactttagcacatttttgtaagtaaatgtgtcccagcaccaaagggagactgtcttctagagttgatctaaaaggctgaatgaaacagggaataattttttcagcatgagattcagtggtatttagtgctttttcttttcataaatctcttgtagacatctcacattttgggaaatattgagaggaataggaaagaagcaaagcaacataatataaagactaaagactttgaggtatgagtattgttttcgaattgtgtctctgtcacttaacatgtagtttgatcttacaaagtattttccttttctgagattgtttccatctccaaacattgaagaccacatctacagcagggatttagtgacaatcacattagacaatgtatgtaaaagttcctcccacactaagcctcaaacattcagggtttagtaaataatttactttttctaaatttatttaaaatttatataggaaaattagctttttctatatccagctcccaagattttaggagtagtaaagacttgctttcctaattctatattggatcatatctgaatactctagagataccacctggttcatcacccataatatctcttttgctaattggaaaaaaattcctaggagcctaatacgaaccagacattgtggtaggaactaagttacagaagtgagtgattaaacacttgtcggcaaaaggtctaatggcagaaggaagtaaacagaaaattataataccatatttaatcagttctggttagcccatttttttttcatattttcacatttatgtgaaatgtgccttatatttgatgccatcttgtaaagatgaaaatggtaagtactattttggagagaagtccctggacttctggtgctcttggcagggcaggagaaagtagccctcagaaaaagcactccaaaggaggagttgcttagtgatatggaccaagggaggaggaaattggcaagaaagggagtggcatgtgcaaagacatagccatgtaagggatcatgttcagggcccatgaagcattctgtgcagcagcagcatgaggggagaatgaggggatggaccatgaggctaaaaggtgagttataggtcagatcatggagagccagggtaagggatctggacttttttctgaagaataagaaatcctttaagcaaggatctgggatgacttgatttgcaatatccatagatttcactgggtcactggcatggaagaaagtaggcaactacactgaggagcaaaatgaggaagagacttatcagaaatcaaaatccaacccacctctctgaagtgaactaatcaaggaaatgctctggagaggaggtcacctcagtgtcatcctgaggggtcagagcaggagccagcatgctctagacatgaatctgtggcactgggtggctgggctgtttgcctggactcaccctaagtcaacagaggctgtatttccatcaccatttccgggcaagcttgtgcttctggcatcatctccatgtgccctgggggcaaatttagctgagttttgaatgtgtgaatgccccattatatctgagtgtctgaaaatctctctcttcacaaacatgcactgaacaaacagaatctgttctcaataggaaacaactgtgccactggagttggcaggaggaagttggaaagaaagcaagtcacagctctgctgcctaccaagctgcctcttccagcttcctgttgaaggcccctttggttctctctccacaaaccagagggaaaatgctgggtattcgcattcacaacttcaattgtttcaaattaaactcccccaggagccgaattacctgagctaatgtatctcattattgtgcctcagtgcaatctaagaggtttcagataagatttcctgaagatagccattattccttcatctgttcaaaaataaggcacttgcaaaattgcaatcatgttcaccacagaaagtgttgctttgtttggtttcataaaagtagtgggtagaaagaacatattgacaacaaaatagaaaaagaaaggtctagaaaaaaatagtctccaccacatccgttaaatattttattgaagccccttgtatttttagggcctgacagaaaacctttgttgagcagcatgcagaacagtgttgcctgggcctgcctcgctagggagagcccaagaggcatgaattcaagcagacctgggattaaatcatggtactgtcacttactaattaagtttttctttttaagcaagtcacttaagttactcagaactcagctttccactcccacagaatatgtgttaggaaaatataatatgctactataaactgctccataataataggactctaaaggataaaaattgttcaagaaaaatttgaagaaggcagtctctggcttttaattctgcgaattaacttgaaaaatattgagatctattatatgtggcaggtaggtttgttgagtgtgtgtgtgcatgcatgcgtgtttgttggggtgaggggagcagtgagattgagaaggtgcattgcaggtagaagaaacaggatacgtaaaatctctacaaaaagaaggtgcatccaagtttgaggatttaaaaaggctcatgtgacagtaatgctgaaaaatgaattagaaaaattagactatacagggtgagttgggaccaggaatgctcatcatttagtgctttataaaactggtatttatctcattccctggagggaatagatgggacactcaggttaaaacaatttagggaaatttgaggaagataaataaagggactgtttataaaggtgtcagcaaggtgcaatgaaatcactagtgatagtgcaccattggggcctacttaccagacctaaaacaaagggataatgggagggagcaatggccttgaagagacccagggatacgaaagtttgaatgaagaagggctctgacagcagagtttgtgaaaggaacacagacagccctacaggaaggaaactcaacaaagccataaatattctgacctcacttgccttcctctgtctatcctcttgctggtaccttccactgactgaattctaccgcagccaaaggcaaaagagcctactgatgccatgatccacttgtgtcagctcccaaggcactagccagggcaaggaaaaagggagagtgggtctggaggaacaaatgaaagggacattctttctaaaggaatatgtctaatcaaatggcaaagagaagcttctagcctcaaaatcctttgccttctagcacccatggttctcatgctgacaggtacttctccactctgattgcttgagttgatggcctgtactaagcacttgttggctaagtaaccataaacaagtcatatcatctctcagtttcttcatctataaaatatgaataacaatagtaattttgattgggattattgaaaggataaatgcaataatacattgaaaacatgtaaaacagtgtctgacaaatagtaggcactacaaaaatgcttcctctcctgactcagattattgacatttcaaagaataaggaacaaaagtttagagacttttccaaaaacatcatataactagccaatgtgagaactcagagagagagacagagagagagagaaagagattccacttcaaaatagcaagtctaataatggtaatctacactctccctgaccactctcctacactgtgaattcctttaaggcaagcattatgtctcgttcattttgcatctcaggaacccattacgcacaagagttttttctcagacagtgtttgatgaatgagtatataaagcacagtgacagaaggtatagaagtaattactggaggacagaggagaactttccttgcaagtcgaaaatccttctctcttgtcttgtataactaattctataaataacaagatataacttggctttttcaacaaggtactgagattcagtaatatattgtaaaaaattaacatattgtatgattactctgaggtccattatttttgttgaatatttgaatcaccatttctgaagtagccccgtctccaggacatcccatatatgtcctacaagcagagatgatctatatcttgtaggagcatgttagagccaacattctctgcagtctagggtgtttgttatggtttggtagagaaatgatgtcttatttaacatatgtttttagtggtctcattggagttttatttatttcatcttgcactgaaagtatgacgacagcctggggcttctctgtgaaattgagtctgaaagtgtattaccaaggtgatcatcttaacatcttacttgcatggaaataaggtaggattcttaaattatagtagaggcaactcagtcatcttagggttaaaatggtcttataatgaatactgttcgtagtttgatgcccataaaaccacacagaaaatagactaggagtcaggagacacgggccatgtcattgatagtcagacagttgtttcctaaacattgaatagttgtcagtttggcttcatgtgaattcagagtaataacttgccttgccaccatctcagcaatgacattagaatcagatgcaattttatctgtgaacatgctgtgaataatataaagaataatgtaaagccaaagttattattcttctgtttactgtatttgacaaatatacattctttttcctatgtggtatctttgatattcagtgaggtttgtttcttccgtttggtcaaggcctggggctatgacaagtgtaggtaggctccagtttacaaaaaggaataactgccttctattcccttctagatttgggtagatattagtaggtttatggcaaaattttggaatattcacagcttgcaattgtataccagaaagcatactgctatattgtgcctcttagtcacagtgaacatttagtttaaaaaaacaaatatttattaatcacttattaaaagtcaggtgctgcattagctaaggggtctctaaataaaattaataaaatttgctgtttcctagggatgttcatggcttattacggtgcagtgcagatatagagtaagaactttgggtagataacctgatgtctctccatacctccatttccatcatgtgtaaaatatggataattatatctaccacttaatgtttctatgaagatgaaacaagtttggtcattataaagctttaatacattgtatgtcatgtaataggtgctgaactaatgctgacgagttgtttattattaggaaggacacacaaagaaacagatctctctatatctgctacatagtgacagacagaaatgatgctgttatatgaagaatatttacccatcttcttttactctcccagggtggaggcatgttttcttgtacactcaaatattagaatgtcacagacatgaatatgatgttgcagaaatcatagaaagaaaaacaacattttttctccagtgggaaatacatgtgtttctgttggtccctgccagcatatacaggtactctctgatgaagggacattttaggagacttaaattcatttgggggcctaaatgattaaaatgctacaaaagaaaaaaatattccaattatctctaggaatttcccaaaattttgattgttcttcatgaaattaagaagaaattgaaagcaaatttctttcaattgctttcaattgaaagcaaaatatatttcaaggactatgcagaaacaagattgacactttgtaaaattttaagatttatgaatcttatgggctataattaacttatcaagaatctttttgagttcaaataggtggatgtttttctgtgcaaagaacatagattttagctttcatatctttcaattctaatttgatatatactttaggattttgttttgttgtttcagttaaccagtgacaaagtggcatagagaataacttttggagaaacttagaaggtggggaagtcacaacaggctacagtaggctgtggttttctttctaaaggatacaggccatgtactgggtttttagggcccattaaggcagtggtaggtgaaaggggaggggtaggaaggtttctcagtgagcagtaaaggcatccctgatgtcaggcatgcataaaggtggtgggtagagggatcagcagacaggccagctgcaaaatgtgacatctacatccatctttgggaaagcattgtgttcattcatggtaaaaatgggggaaaattattgtggtagagacattgttaaaaaagtgatggaaacctaaagcatatatcatagtttacatgtataaccatatagtattacaaatctggacagtcctccaaatccctataatctcttctttgagatgtagttgcagtttgattatttcctagatggtaatgaatttgcctctgctgcttgcaagtgcatttacagtcacttcataaagcccttaaacacacttgtgaaggagcttcatgctcatcagaattagtctggactcatgtttcctgtgatgcatattgacttcatctgtagtacagctgcatctacaactctgtgaagatgcaaactgctagttcttcctgaggacaagtcaacgtgaaaaatcccaaatgagactgtaagttccactagcactgcatgaaaaatcagagcctagatacaggccaaagacctgttttggaccctaacctctgactgagttttcttcagaattagaatatattttcaaaagggacatagaattattttcacaaagatattttggggtctgtacatcacttgatgaaaatgaaagatggggaagggaattaacatttattgaacgactgcaaatatacaaggcttgtatgtatatttcgccttcataaaaatcctctgaaatagacataattatgccttgtaaataaaagcattactagggcagtggttgttgtcagtgcttaaaatagtacctgttacatactataatagatgctcaattagtatttgtgaaaaagagtaattgaattgaatcttgtagctgaagaaatagtagtaaagaaaagttaagtacttttcttaggaacgacctgcagagagactttgggctaaggcatggtgcatgtgggaagtgagaaaactcagattgggatgcaggtctatctgactgcaagacatatgattcttcaactatattttaatatccctccctgatggcattttttcatgaaaaaaaaaactatataattctcaataaggtggatgttactgatttctaagttatctatgaagcaggcagagctgctgacctccctggattattctacaacgaaatcctcccctcctgatcagtagaatagagatagattttacacgaatctttgtcagctgcctcaaatccttttttaggaacaaggatgagaaaacataatcacacaaataagtaatgctgacggtgtactgtgatttcattttcatttcaacaggtatttactgtgtgccaactatgttttcctgctttgggtatgcagtattagaaaaggaagatatagtggagaaaagatacaattcctgcctgaatttgctcagttttattttcggtggaaagaagaatccaatcagtgcttttaaaacctggttgtatataagaataacccatggtgtttgctgaaagaaccgaattagactatctgggtttgggtctgggaatttctatttttatcaagagccccagatcattctgatgcacagccacatttaggaaacactgaattagatgcaagctagaatcccttccagcttttgaattctatgactttctatcattacagaactttctcacaaaaatagggagaaaaaagaaatgtatgtttctgccaacagagcattaaggcaaaaaaaggatgagagtttgtaaggcagagattttgttctgtaaggtcaagggcagcttgggccagcaccagcccaaattctaaatggttcaggccagatgtagattccctaggtacttgataggaaagagcatggattatgttggaggggtagtgaaaagtacaaaagagtaggccaggaaggtttaaatgagtgcatttagcatagtgtattgcacatagtgaactgtcagtgaatttttgcttaagcgatgattattattagggtggtgggtgggtgattaggctgagcattgagataggaaagcacccacatttgatcagcagttagaaaggagattgaattggccccaatgaggaatacccaaaggaggttttaaataagacaaatgaagctgcattccctcggcattctatgtagtgtgtgggtgatttgtattgactgcttaatgctttcagagtgctagtcaacaatgttaagatacaaatataataaaagaaatcaggagaggcttagtatttcttgagcacccacactgtaccaaatactgtaaagtggcttgcatgttaaaccatttaatgcttaaatttacccactgaggcaggtgacattagtctcattttccagtagggaaactgagactcagttatatttaacccatggttatgtgaaagccatggtctaaacttcaggctgagttgagaagtacttaccattctcttttaactgtcacttagaaaaatcaccatgatggtttttattctagcatatgccttagtgaccataaattcactcattttttctaaggcccagaatgccccactgttttatttggtttgctttgcactttagttcaggtgtggctaactcaagggacttaaactaattatgaagaataagccagccctgttgcttgtacttccaatggcttttctcttagtaagatagtaaattatcatgtatgtctataccttattagcaaagctaaggaatgcaactgttttccttctttagaaaaaagaaactcagtacaaaatcaccttctctagacaaagccacttaaataggaatcagttctcttcattacagataatcaatataatggccattgagaattacatgctttaaaaaaagccatttattagtctttgtgtaggctagggttgttttataaacactaaaacataggcaaacagttgttaatgttttattatagataaatgacatttgttaatcgtgttaatgatcatagtggctaacattatttattgaatggttattgtatctaagcattaggcttttgaaatgctttccatattttatttgaatttcataaaaaccctatatactagatctcttttgatctccattttactgatgaagaaattaaattttacaaagattgaattcctttaaataccctgctagtaaatttaatgcaaggcctaatttggtttaactcttcagcccatcttttgaaacacatcactgaattagctctaagtaaataaatcttttcatatagcaaaatatcgttctacaactatgtaattatgtttctgaataatatttaaaggcatgagaaaatgtccatagcacaagagtaagggtgtatgacacatatcaaggaaatgtatatatacatttaggaaaatacttcaaggaaatacattgaaacattcacatttttcactaaatggttgaattatatgtgtactcttgtgttctgctcaaaacatctctgttttcatattttctataataactatttatagttagaaggataattacgtattaataattaaaatagaatctattaatgtagtaggattataaggaaatacatcaaaataatgagaaggttttatttaggcaacagactatgaaaatgcaaaaatataattcttttgcttataattttgacaggctcatcatagaaaatattttaaaaattgaaatggctgagttaccatacaagatcctttgtagtctagcccctggctacctttccagaattaattcttaaaactctctgtaagataaattctacttcctgattttaccatatcacttgaaggtactatactctttcacaagtcaatgcctatatatgtgattccatttgcctgcaatcacaaaactgtaatgtttttgagagcaaaggtcatatcatcttaactctggcatccaattttcctaacacagtacttacaatacagtaagccttttaaaatgtatatttgtagagcaaatacgtgatcttctttcacctgttcctccctctattttcagtttaacaaagtgattagatgatccaggctttagagacagtggaattaaaagagtggtgtataacattcacatttactctatgctttctgtttcaaagttttacagtgcaaatgtattcatatattacttatataatttaaaatcaaaagaggaggaaacatattttattaaaatgttctctacagaaaagttgagatattattattaggcattgtcatcttttaatcctttgttcaaagactgcctcttttctaaagcctccctgaattcctcataggctcagttcacttctctatcttcctagtttccattttgattttgcttctatacctacacattctgcatgaaatttttctataattttctataatgtgagtgaaagcacagagtctaaatcacctttatagactaaaggcttaactcatagtatatattggctaacaactgaacatgcacgtggaatcctttctcaaagaagtcacagattctgtaaaagacttcactgagaaattgacttttgattaaatgtttgttttgtcttctccttgttattctcagtgaagcatgtttggccaccctatctaaaattgcctcatgctatcccttgtcaaacaaacactattccccttccctcttatatttttctccttaacatttattatcatctgacatacttttttttttaactttagtttaagttcaggggtacaagtgcaggtttgttacataaacttgtgtcgtggggatttgttgtatagattatttcatcacccagatattaagcctgatacccattagttatttttactaaccctctacctccttttaccctccaccctctgaaacacccagtgtatgttgttcccttccctgtgtccctgtattctcatcgtttagctcccatttataagtgagaacatgcagtgtttggttttctgttcctgtgtctgctgaggataatggcctccagctccacccatgtccctgcaaaggacacagtctcatccttttttatggctggatataattacatggtgtatatgtatcacattttcttcatccagtctatcatgatgggcatttaggttgattccatgtcttttctattgctaatagggctgcaatgaacacacatgtgcatgtgtctttataacagaataatttacatattttggggtatatacccagtaatgggattgctgcatcaaatggtatttctgtctttaggtctttgaggaattgccacactgagttccacaagggctgaactaataatttacactcccaccaacagtgtataagggttcccttttctcccaaacctcatcaacatctattggctcttgactttaataataaccattctgactggcatgagatggtatctcattgtggttttgatttgcatttctctaatgatcagtgatgttgggcattttatcatataattgttggctgcatgcatgtcttcttttgaaaaatgcctgttcatgtcctttgcccactttttaatagggttgtttgtcttttccttgtacatttgtttaggttccttatagatactgggtattagacctttgtcagatacatagtttgcaaaaatgttctcccattctgtagcttgtctgtttactctgttaatagtgtcttttgttttgtagaaactctttattgcttgactctcttccctaaaatataaaagtcccgtgaagacagaacctggcatttaggaggtatccaattgatagttgttgaacaaatccatgtcacgtacaaaatcacagagatatgcatggaagacaggaaaaatggaaggtctctactatacaccatctaagcccttttttgaatattgttttgacaataaatgagtggctgtgaacttttaagataatacactggaaaaagctttgaggggaaagtgtttatacctatgactgagtgcagatatgttttcccttgcagacaattaagtgaaggtggaagtaagcatcattttattacatataaataatctgctaagaggccactctcagcctctggtacaaggtaacttgagataggagttgcctgcgagccagccttttaccttaaaatcctgttcaggatcctgccattcataccaactgggtgaataaggctatgaagtttcaccccacaaatcatagtcaaaacagttttagctgaaaacactcaatgcagaaaaaaacagctactggccacttttttttctctgtaatagggagacatattcagcttatccaaaatgaacacattttagaaaaagttaaaaataatattggagagcgtccttctgtctaatctccattaaaattgttatgtgccctgtgcaaaagccatttatatggacagactcacacaggtttgcaggaaaatcattactctgtgtgtgtgtgtgtgtgtgtgtgcgtgtgtgtgtgtgtgtgtgtgtgcctgtattgaatttatactgcttggcacaaaaccagtctctatcaagagcaacaaaatccagtaaggttcacaatatctcagatgtgttttttcataatttaaaaataaatacacagtggttaatgtgggatagccatcacgtagcatttctatatgtggcttcaaatcctggctctaccactttaccacttgtgtgattttaagtacattctttaaccttcctgaaatttattctccttaggtgcaaaaatatggtaatcacacaaccttaaaataggattcttagggagattacatgagcgaatacatgtaaaaacatttagcaccacgatggtgatacaaagcacactcaacaatcgttggctataacagtgaatattttcatcatgaaaagagcaactaatttttctcctttctagaaattcaatcttttttggtgggagtgcaaggttgagaaaggtcccgggaagagttcgcatcttgtcattaaagccacccctgcatcattggaatatttgaactaagaatgcactatttcatattttattgattctattaactgaagaatatagcactgcaaactgtacaaaagttagaccactcttcttaatttctaatgtttaccaagtatctggtggttacaaaaacacagtctaatattacagtttatagcattatctttcataagtgactttaatcatacatgcttatactgttaatataaatgttaataattattccaaacaagaataaacatctccagattcatactgttacaaatgcacatccataacttgattttgtgccatttgggtaagtctccatcttgtcactgatggttggaaataagtgaaaaacatcctatctatgaactcactttcagtaatgaagtttttatgcctctcagtaatgaagtttttatgcctccaaggtgaatatagataagaacatcctcttttactgaaatcatcaaatatgtgaaaagaaattgacaaaggaaaagacagcttttgttctccacagtactggatgcaaatgtgaaagactgttcacttttatgaagatatacctcattacttcttaatttctttccagaaaaacagactggggatgtaaggtgtgactaaatgactagtgatatctaattttcacaagctgaacacatggcccgacactgggtatttggtcaattcacatttctaaattaattagcaaagcagtgagaaggaaatatcaaataatggaatattctcttggttcacatttggtcaaaatttcattgcctggctgagaattactaacaattaacacctgtgcatttagcctgcaaccatatttggcattatgtttggttttagcctttactggagggtggaatagcagaattatactgttaaaccactcctctaaaactgtggaaaaatgagttggtatcactgtaaggatgccctgatgacctggtgtgaaatctgcctccaaccatttgtagcttctcagggaatctgctgagctttctgacacaactccaacctgcctcagggcccttgctgtgactgcgttttcaacacttctccaagtgttgagcagagggagaactcggaagtgagaggaattactttatggtaacttttgtacatttcagaagccataacatgcagaaatctcagtgcagctgctctacttcctagatctctcagatttgtccaggagggactggcacaatcaatctttatatactaagacaagggagatacctggacaaaaagctagacatatactattgtttactgtataacaaaatggtctgttttgtttggattttccagcaattcatggctatgctataatttctttaataagtagattttaatttttagcatagttttatgtttataaagataataatgcagaaaacacagatttcccatataccgcctcatccccagtttcccctaatattaacatcttgtattattgtagaatagttgttacaattgatgaatcaatattgatacattattattgactgaagtctatagtttactttagggttcactctgtgttgtacatgctatggcttttgacaaatttataatgacatgtatccaccattatagcctcatacacaataaaatttcaggccctaaaaatcccctgtgccctgcccattcatccttcttctcctgctccctcctcccttgaaacccgtcaaccactaatatttttactgtttccatagtttttctttattcagaatgtcatatattaagaataatacagtatgtagtcttttcagattggctttttttttttctcatagcaatatgctctcaaggctcctccatgatttttcatagcttgatagctcatttcttttcatcactgactactattctattgtatgaatgtgccacagtttataccattcacccactgaaggacatcttggttgcttccaagttttggcaattatgaataaattcatgaatacatatttatgtgtaggtttttgtgtgggcataagttttcagctcaactggcaaaatgcaaaggggcatgattgcttgatagtatggtaagagtatgttttgttatgtaggaaactgtttgttcgtttgtattccaaagtggctatgccatttcgaattcccacaagcaatcaataagacttcctgttgctccatgctttttttcttgcttgtctctcaaacaaatggttgttactatggaagaggtcattaagctacatgagttctacaaaagatgtgggaaacctctgaacactcaagcaactagataacaacttttcactgtggaacattccttccccttatcattgaggttttaaacagcagtgtcaacctttgtgtactcactccatcactcttcatagctcctagcatgatccttatcttagccaggcatcaggaccctctaacctcatgcttactcttgtagcatcacttcaggctctttgttcacttggcagccaggatgccctttttatttatttattccttacttcttaaatcttgtttcattttagattcagggagtacatgtgcatgttgctatatgggcatattatgtactgctggggattgggcttctatttggatatccattacctaaatagtgaacattatactcaataggtactgagaatgcccttttaaaaatgaaaatccaaatttaaactctcttaggagatagttcaaatccttaatataatctatgaggacttacatgtgctcgtagctacctattcctccagatccatctttgaccattttctttcctgcttagtttaactcatctctattggctgccttctcattccacatgagtgttgttactaatctgccactgagcctaagcacataccatccctgatagtggaaaggtatcttctttcctacccaatcttcacctgttaaaatcatattctttcttcaggtctcctctgcactgaccttttctcaggaggccgtcggtccctgccactctgcttacactgtgtcctaaagttacttgcttcccaatactccatatacttactcctaactaactgccctccatggtgttattgcacagttcttaacttgatatttatcttcttctctagatagtatgttttgtgatggtagggttgcatctattttactcactagtttattctttggaccagtaatagtgatggggcattgtaatatattaataagtacttacttactgcatgaatggatggataataacaaacataggtggctggcaagatggccaaatacaaacagctccagtctgcagctcccagtgagatcaatgcaggtgggtgatttctgcatttccagctgaggtaccttgctcttctcactgggactggttagacagtaggtgcagcccatggagggtgagctgaagcagggtggggcatcacttcttccgggaagtacaaggggttggggaactccttcccctagccaagggaggctagggctgtgctgtaagaaacggtggattctggcccagatactatgcttttgacaaagtcttcacaacccgcagaccagagattccctcaggtgcctatgccaccagggttttgggtttcaagcacaaaactgggtggccatttgggcagacagtgagctagctgcagtttttattcatactccagtaatgcctggatgccatgatacagaaccattcactcccctggaaagggggctgaagccagggagccaagtggatcccatcctcatggagcccagcaagctaagatacgctggtttaaaattcttgccaccagcacagcagtctgaagttgacctgggacactcaagtttggtggggggagaggtgtccaccattatcaaggcttgagtaggtggttttcccctcacagtgtaaacaaagccaccaggaagtttgaactgggcagagcccaccacagctcagcaaagctgctgtagccagactgcctctctagattactcctcactggtcagggcatctctgaaagaaaggcagcagccccagtcaggggcttatagatcaaactctcatctccttgggacagagcacctgggcgaaggggtgactgtgggcgcagcttcagcagacttaaatgttcctggctgccagctgtgaatagagcagtggatctcccatcacagcactcaagctctgctaagggacagactgcctcctcaagtgggtccctgacccccatgcctctggactgggagacacctcccatcagggatcgacagacacctcatacaggagagctctagctggcatctggtgggtacccctatgggatgaggcttccagaggaggaaacaggcagcaatttttcctgttctgcagcctttgctggtaatacctaggcaaacagggcctggagtggacctccagcaaactccagcagacctgcagcagaggggcctgactgttagaaggaaaactaacaaacagaaaggaatagcatcaacatcaacaaaaaggatgtccacaaaaaactccatctgaaggtcaccaacatcaaagaccaaaggtagataaatccacgaagatgagaaaaaaacagtgcaaaaaggttgaacattccaagaaccagactgcctcttctcctccaaaggatcacaactccttgccagcaaggaaacaaaactggatggagaatgagtttgatgaactgacagaagtaggcttcagaaagtgagtagtaacaaactcctctgagctaaaggagcatgttctaacccaatgtaaagaagctaagaaccttgaaaaaagatgagaggaattgctgactagaataaccagtttagagaagaacataaatgacctaatggagctgaaaaacacagcacaagaacttcatgaagcatagataagtatcaatagtctaaccaattaagcagaagaaaggatatcagagattgaagatcaacttaatgaaataaagtgtgaagacaagattagagaaaaaagaatgaaaaggaacgaacaaagcctccaagatatatgggactatgtgaaaagaccaaacctgtgtttgattggtgtacctgaaagtgatgaggagaatgaaaccaagttggaaaacactctttaggatattatccaggagaacttctccaacctaggaagacaggccaacattcaaattcagaaaatatacaaaaacaccacaaagataatcctcaggaagagcaatcccaagacacataatcgtcagtttcaccaatgttgaaatgaaggaataaatgttaagagcagccagagagaaaggtcagattacccacaaagggaagcccatcagactaacagtggatctcttggcagaaactctacaagtcagaagatcatgggggccaatattcaacattcttaaagaaaataattgtcaacccagaatttcatatccagccaactaaacttcataagtgaaggagaaataaaatcctttacagacaagcaaatgctgagagatgttgtcatcaccaggcctgccttacaaaagctcctgaagaaagcactaaatatggcaaggaaaaaccagtaccggccactgcaaaaacatgccaaattgtaaagaccatcaatactatgaagaaactgcatcaacgaatgggcaaaataaccagctagcatcataatgacaggattaagttcacacataacaatattagccttaaatgtaaatgggctaaatgcctcaattaaaagacatagtcaggcaaattggataaagagtcaagacccatcagtgtgctgtattcaggagacccatctcatgtgcaaagacgcacataggctcaaaataaagggatggaggaagatctaccaagcaaatggaaaacagaaatcaggggttgcaatcctagtctctgataaaacagactttaaaccaacaaaggtcaaaagagacaaagaagggcattatataatggtaactggatcaatgcaacaagaagagctaactatcctaaatatataagcacccaatacaggagcacccagattcataaagcaagttctaagagaccaacaaagagacttagattcaaacgcaataatagtggaagactttaacactgcactgtcaatattagagagatcgatgagacagaaaattatcaaggatattcaggatttgaactcagctctggaccaagcggacccaatagacatctacagaactctcctccccaaatcaagagaatatacattcttctcagcaccacatcacacttattctaaaattgatcacataattggaagtaaaacacacttcagcaaatgcaaaagaatggaaatcatagcaaacagtctctcagaccacagtgcattagaactcaggattaagaaagtcactcaaaaccacacaactacatggaaactgaacaacctgctcctgaatgactactgagtaaataacaaaattaaggcagaaataaataagttgcttgaaaccaatgagaacaaagacacaacgtaccagaatctctgggacacagctaaagcagtgtttagagggagatttactaaatgcccacaggggaaagcaggaaagatctaaaatcaacacattaacatcacaattaaaagaactagaaaaggaagagcaaacaaattcaacagctagcagaagacaagaaataacttagatcagaggaaaactaaaggagatagagacatgaaaaacccttcaaaaaaatcagcgaatccaggagctggttttttgaaaagattaacaaaatagaccactacccagactaataaaaaagaaaaaaagagaagaatcaaatagactcaatagaaaatgataaaggggatatcaccactaatcccacagaaacacaaactaccatcagagaatactataaacacctctacacaaataaactagaaaatctagaagaaatggataaatttctggacacatactccctcccaagactaaacaaggaagagttcaaatccctgaatagactaataacaagttctgaaattgaggccttaattaatagcctaaccaaaaaaaaagcccaggaccagatggattcacaaccgaattctactagaggtacaccgaggagctggtaccattacttctgaaactattccaaacaatagaaaaagaggggctcctccctaactcattttatgtggccagcatcatcctgataccaaaacctggcagagacacaacaaaaaaagaaaatttcaggccagtatccctgaggaacatcaacatgaaaatcctcaataaaatactggcaaaatgaatccagcagcacatcaaaaagcttatccaccagtatcaagtcggcttcatccctgggatgcaaggctggttcaacatatgcaaatcaataaacacaatccatcacataaacagaaccagtgacaaaaaccacatgattatgtcaatagatgcagaaaaggccttcgataaaattcaacaccccttcatgctaaaaactctcaataaactaggtattgatggaacgtatctcaaaataataagttatttatgacaaactcacagccaatatcacactgaataggcaaaagctggaagcattccctttgaaaaccagtacaagacaaggatgccctctctcaccactcctattcaacatagtattggaagttctggctagggcaatcaggcaagagaaagaaataaaaggtattcaaataggtagagaggaagtaaaattgtctctgtttgcagatgacatgattgtgtctttttagaaaaccccatcatcatagcccaaaatctccttaagctgataagcaacttcagcaaaatctcaggatacaaaatcaatgtgggaaaattcacaagcattcctatacaccatgaacagacaaacagagagccaaataatgagggaactcccattcacagttgctacaaagagaataaaatacctaggaatccaacttagaagggatgtgaaggacctcttcaaggagaactacaaaccactgcccaaaaaaaaaaataagaggacacaaacaaatggaaaaacagtccatgctaatggataggaagaattatattgtgaaaatggccatatttcccaaagtaatttatagatttaatgctatccccatcaggctaccattgactttcttcaaagaattagtaaaacctactttaaaattcatatggaaccataaaagagcccatatagccaagacaatcctaaataaaaagaacaaagctggaaaatcatgctacctgactacaagctatactacaaggctgcagtaaccaaaacgcatggtactggtaccaaaacagataaatagaccaatggaacagaacagaggcctcagaaataacatcacacatctacagccatctgatctttctttgacaaacctgacaaaaacaagcaatggggaaaggatctcctatttaataaatggtgttgggaaaactggctagccatatgtagaaaactaaaactggaccccttccttacaccttatacaaaaattaactcaagatgtgttaaagatttaaatgtaagacctaaaatcataaaagccctacaacataacctaggcaatagcattcaggacataggcatgggcaaggacttcatgactaaaacaccaaaagcaatggcaacaaaagccaaaattgacaaatgggatctaattaaactaaagagcttctgcacagcaaaaggaactatcatcagagtgaacaggcaacctacagaatgggagaaaatttttgcaatctactcatctgacaaagggctaatatccagaatctacaaagaactcaaacaaatttacaaggaaaagacaaccccatcaaaaagtgggtgaaggatatgaacagacacttctcaaaagacatttatgcggccaacaaacatataaaaaaagctcatcatcactggtcattagagaaatgcaaaacaaagccacaatgagataccatctcatgccaattagaatggcgattattaaaaagtcaggaaacatgctggagagggtgtggagaaataggaatgctttcacactgttggtgggaatataaattagttaaaccattgtggaagacagtgtggcaattcctcaaggatctagtgccagaaataccatttaacccagcaatcccattactgggtatatacccaaaggattataaatcattctactgtaaagacacatgcacacatatgtttattgcagcactgttcataatagcaaagacttggaaccaaccgaaatgttcatcaatgatagactagataaaaaaatgtggcacatacacaccatggaatactatgaagccataaaaaaaggatgagttcatgtcctttgcagagacatggatgaagctggaaaccatcattctcagcaaacgaacacacgaacagaaaaccaaacaccacatgttctcacttataagtggaagttgaacaatgagaacacatggacacagggaggggaacaccatacactggggcctgtcagggagtcgggggctaggggagggatagcattaggagaaatacctaatgtagatgatgggttgatgggtgcaacaaaccaccatggcacgtgtatacctatgtaacaaacctgcacgttctacacatgtatcccagaacataaagtataataaaaaaacataaatattaccattctggatagtagttactatgaattaagagcaatttattaatgcactactgcaaacagaaacttctattatccacaaaaaatgccatttttttaatggctccagaaagctgagaaagtcctttatgatacacacttatcatatggacaaggttttcatgacttcattcctgcccacttctccagcttcataattcaccacttctacttatacatgagtctctagtaatgttaaactgcttcctaatacccacaggcatcatgctgttttgtagctccatggcattacttagtattattctactgcttgaaaagcgcactcccattgcctgacaaatcacctttgattctttggatacaccttagacctcacgtctttcaagaagccttctttgaacaccagtgcagaccaattatatctctatgccgtcacatcactctgtgtagtcctacatcatggtgcaaatgttcaacaaatgtttaatggaagaaagtgaatcacttgccaagttcaaccaacatcactggaatattttggtttatcttcctatcactcttgagactaggagtgacattattgatgggattttgttgttgttgttgttgttaactgcaatatccccagtgtattacaatgtgcctggcctggagtagccacctgacctatatttacagaaattaactgaaagatcaaggtaaaccagtattaagatgtgtcagatttgctcaagagtagtttaccaaaacaatcacagcatccattttgttcatcctagataacctaatagtttatttaaaattgaattttctgactttctgaacagctatcagaatttattccttttaggctataaaaagggtgtgttccagctgcaggctgagctgacctaagaccattgaatcaatgctcagtataaatgatgccttgcaaaaatgaccacaaaagtaagatttgtccagagtctcttggattacattctagtgtccttttcactaattgaggtaataattattcatccaatccctctttgaaacatccctgcctaccaccaactttgaccactcctttctctgagccccactacacactgtacatgtctctatcatagcacttagcaaactaaactaaaaccaattgttgaaatgtagtctcctgtttgactgaaaattccctgaatgcaagattactttattaatttctacacttcaagaatctaatccagtggctagcccatggacatatcaattaatgtttttcgaatgaatgaaccaatgaacctatgtccaaaggaattagttgagttgtagtgttattaataaatgtcataaatatataaaacaaaaaattgcaatatttgaaaacaagatataattaaccttgactctggggaaggaactgacgtttgctgaacttctatgatgtgccacacactgtgctgggcacgagggactttgtcaatgttatcttgtcacaccttcacaacaataataaatttgtaaataaaatcgccttatttttcagatgaggacacttgaatttagagaaaaggattataaatttaagataattctgatatcaaagtttcttttcctgctgttcagagaatatgacttaaagtgaaaaatactcagaatgagtgtgaatatatgaagaaagaagataaagagacttctgattaagggttagtggagtgaaaaatactctttaccatgcaaaattttattggctcagattacaaggtctccttccatccacttgactgtcccctgcccacccctctggttagatagaaatcattctgccctagagactgtggatgtcctgtcttggctatagttttccaggactgagtggcagggatagatgccttaaattaagactcttgccaaagaagactttcaaagcaatgatttcttcagtgcattttccgtttgtttatgaatttccttagtacttttattatagcacaatctattgatcttgctaaatgaatttcatagacatgacccaataaatctatttatcaatatttaattataacagcaaatggaaaaattcattttctataggatagaactctaccttgtactataacgtgtagtttctctgagtattgatgcattattctcgtcactagattagaagctttttgaaaatggaaacaaattcagcttagcttagctgcttatccccagcatctaagataatatcttgagtataacagctgccaattaaaaagagtcagtcattgaataacttaaaatatatatcatcctctaatctgtttgggaaggttctggaaatcctgataaaaatatacaggttgagataagaaataatttttcaagtttatatatatacatgaaatatgagactcagtgaaatcaaatacttctcagactatgcattgtgagggatggaacccacgttccggactctgaattatctcttttcaatttaagcatgttggaggctaggagttgtcttaatatggcataccttgaaaacccagcgaattttctatgagattttctgttttcagaaattgcaagctattatttaagctatggtagttttagacacattaacaagtgaaaattaagaagctgaaaatagcagtctttgtggttacatattaagatttctgagagttgacccacaggtctagacattttctctgcttctttatgttatacaatagcagataaacttctcgagaacgtgtaaattttattcttgtaactgtttattgtcctaggggagtgcaaggacattaataaactttagagaaaggcagttggcattcatgaaaacaaaatgcagtagtgagagaaaaatagggaaaaagagggtctatgaccaatcccacccttaccttagaggtttcttgctgattctagatcactagtttcctgctgtctgcttgcttggcatttctaagaccatgaacagtatttaccaaagtatggcgtaagggatgctgggaatatacaagattattttaggtcactattgatgaatatttttatttcaatagtcatgcatttttataattaacttatatttataaaattgctgtttttcacttagaggtggaattcctgcaattcagtagcaaaaaattaaataacctaaacaacagaggagcaaataaacatttctccaaagaaagcacactaatggccaataggtatatgaaaggaccctccatatcacaaattacggagtgatgcaaatcaaaactacaataagatatcatctcacacctgttattattatgttttaaaaagataagtgttggcaaaaatgtggagaaattagaccccttgtacactgttgggaggaatgtaaaatggtacagtagctatgaaaaacagaaataccatataatacaacaatcctacttctggatatatatctaaaagcattgtaaggaagatctcaaagagacccaccctcccatgttttttgcaacattattcactatagccaattatttccaataaatgaatgactgaagttcaggaaacagttacaacataagttgatccaaatatcttctattttaaattttttcttgcaaaatagtaaattctcttggttacagttacttaacatgctgtaactttgtaactttttagattacagaatattttcatcattttctgtctgtcacagatgctagtgacaaaattctgtgtatcatttttcttcaaaatataacacttggtacagtaagtgctaaacaaagacaaccaattatggatttattaagtgtttgttattgacaatgaatatggaaaattggaaatggattccagagatggagtcaacaatatttggtaaccagatggctgtgctagctgaccaaggagagacatcatagatggattctgggtttgctaaattagtattttaattagatagtaacatattaaaataaataagttctctaatctactcataaactaatttcatcttattgagattgcacatttgatttttacaattcaaaataaacctatcttaagatcttaagctagtcctgcttttctaacacttgagttattcattcttaataaaatcatcttatataactcgaagaaatacattgtttagttttatttttttaaatgatgatattcaccacattctcactcctgtctcatgggcttttccttcatttgcccaaagatagctgttactttaacagtgatatgaaatctctcagcttctctggcactttgtggtcagtaaattttgtctaaaaatgtagctttgccaacattcattttgctgaaaaatgaaataaaacgagttttcaggataaacgttttctgtgcccattaccttgttgtttggtttcacactggtaaaactttgtttgtccctgttgctatcatctttgccaactttctctccacatagcaatctgcaataataacttccccaggagtgagcttagtcctcagtctctgagccaaggaaatcctggaagtaggttggggcttccttcccactgactggtaaacaggatctgaaatgggtctgctgccttcacgcctgatatcctgggcaggtaggcagccccagggtgtacctaggaacaatgccacacacttgcattgacatctgtctgtgtattctgtcttcccattaatttatatctggaaaataattcaacatcctttcattttaatctcaaatctgtgaagtcaccatgtcaaaatgtcagaccgttcgggagacattgactgcgttaatactgtccttcacactactgatacactacatgcacagccagccacaggctctttcccaagatcatgaagtggtgtactcgtgtaattgataaccaaattcaaaagatataattattaattatttctatgctggagcaaccatatggcctatgttttcctgtgacatttccttttatgattgttctcccagagttacaacacttctgagcactctcgaagttagacaatcatttgtggtcatttagacaatcatttagataatcatttgtggtcaacctatttatgtccttagaaaaacctgttcaccacttttagtctcagttaaaggtattgaacactatgatttctaatgacaatttcagttttaacatttacaaaatataaggtcagcctcaagtacacagaaatgcaacaaacctaaaaaaaactttcttgaaagtaacggatgcctaatgtttacatgaaattaactttatttttggatacagaaactgacttctgcgggatctttgtgttttaatgtgcaaattgattttatgattatccaacccttactcaggtaaagaagggtaagttctgaaggtcctggaggcttgttttctcccaaatttttgtatctctttgcaagtggctagatgtgtatatcttagtcaactcaaaaacagggcaggttgatgccagcaactgaattttggagcccacctttactaaaaaggctattttctcaaccaacaaatgtctcttattacatagtagagttaatgttccctgatttcctttccaactttgttacaaatatgtgagtgtgaggggcatggggtcctgctttgctggcatttttcatggtgcctccagctggtctactcaggcacatttccctgcaggatgggaattgaaggggattctggataattcactgattctctgccatgtaatcccttgcaggaaaatactgtaatacaccatgacaagattaaagtgccactttcatggtatcagtagccattatactagggacactgaactgtttatcaatatactaaaaatgaggcagctcagtttgacaagaaaagtgttggaaaaggtctgacccctatgctaagtttcccgtgctgtgcctcagcaggcttgtcgcacagcctccaagtctgtcccttcatctaggaaatacatgcagtggatagatcagattaagtgctaaaccagtaagttatctaaacaaattgattatagaatctaggattaggaagaaggaggtcactagaggaagaaggagaaattgaatcacacatactgtgttgagacctaggtgtacctgcaacttaaagctcacactatgaaaagatttcatgtcttcaatgaagatgatacattctcataagttactgcttcttatgctcagacacagatttcattgtggatgtctcctttaacagtataatgctatcagggcacacatctaggtctcaaccttttcacagacagaggtaagagttgaattgtccctgcatgtgtagcctctacagctatgttgaagtcaagaagagtgttttttctctgggaggcttggtgctttaatccagtaggtattcaatgaacacttaaatgttgattaaaagtaatgaaattcaggactgtataacatgtattaaacatcttttatgggctaagtttttacaggtaatttcttgcttcaaaaataagaaaattgaacctcagagagtccataatgcttatgaatggaacaataattactgatttttttgaagcccaagtatagtgatctgtcctctgtactgacatgccagtatggagacaacaacaaaatagttacatgagagtcttgtacagaacattttgtgatattttttcatcatatatttagaaaataaaaaggaagggaaggagcttgtcatgattttaagcaggctcatcttggccatagatttttatcacatctaatcttctttcacatctatctatactacaatatgcatgatccatttaaacagatttaaaagacaaactgaaatttagctttaaaataactttttaaatgtcatcaagttatatttggaaactttatgagagcagttatacaatcctataattatcatgttcatgaacctttccaacaagtatacaattcatgattacaatgtttttgaaagatagatgtgaaaatgaataaactagaataaagacagttgtgaaatttcatctagtgaaaatagatttttaaaattcatgtattcagagagtattttttgaagcaagacagtttgagtctggctaaatgattgaaatcacaagaattttttgaaatgtttctgtattttatgttattttattatttgtactttagcacaattataaaatctatttttattataatatgtggcagaatagagtgaaaaaagattatataaactggtaacttaagaaacacatttcaacatttgtgcaataaataaatatttaataaatgttgtgggaaaatcaatgatcagaaccacagaaaaatgttgtcttcagattacagaattgcacttgaaatgctgcatttcctaaattttgttataattaaatatgtatacacatccaagcctttatttaaaactgtcccatctattgtaggaaaagctgggtaaaaaatgtattaagaggtctctttaattccaccatctgcttctgcaaatgtgaagagctctgagttcatgattcttaatcagtccatttaaacatgaacaactatttcacagttaagaaagcaatgcaaatacctgtggaatacttcttctcttaatgttgaatgtttaaatcacataaagtggtcaatggatatgccctgatccttccttccacctcatctaacacagtcactcttatacatctctgtttaccaatcttgacattatcctgcccaaaaaacttccatggcttcttacggactactgaatgaaatcatgacattttgtcattgctttcaacactttccctaatgaaatctcaatactcatgcccagctagccttctacaaatacccaatgctccagtcctgaacctttcattgaaatcaactgctcttggctcttggtcacgcgtttcttacactctcttcttcgcctatctttacatgctccaattccagatgtcatccaatgtgtggctaaaatgctgccttggtcatgaagtatatttttcactttccattagaatacatttctatatttccaaaatttccataaaattaaaattacgtatttcatagcacatagcattgtttacattgtcattttatatcctttactagactataagcacttgggcttataaatcctatgtttgctttctgtaaccttcgtagagctagaactactattctctccttggcatatggtaaacaagacttacaaaaatctcactaatgcgtaattcttatgcattcttcactcgaattcaccaaatgttgacatattacataaattagtacagtttttcaacaccagggaacaccatttctaaactattaactaatccattgacctttttcaaagtttatcaattgccccactaaagtattctataggcaaaaatcttattcaggatcatatactccatatacttattgtatcatcttacatttattttaatttaggacagattttcagcctttctttgtttttgatgactttgtgaagaataatggctgatatggttaggctttgtgtccctaccaaaatctcgtcttgaattgtaattcccacgtggggagggtggaaagtgtttggattatgggggcgggttgtcccatgttgttctcgtgatcacgagtgaattctcacgagactggatggttttataagtgtttggcaagttcctccttcgctcacacttctcttttctgccaccttgtgaagaaggtacttgcttctacttacatcatgattgtcggtttcctgaggcctccccagccatgtggaactgtgggtcaattaaacctctttcctttataaattacccagtcttgggcaattgttcatagcagtgtgagaatgggctaatacactggctaattgttttacagaatatagcacaatttggtttgttccatattactcctgattatatttaatatgtagattaggcatttatagtaagaacacaacagaagttattttgagacttcttgggacattatataaagaagctcatgacactgatttgtctcattatgttagtgttcaatttgatcacttggctaacattacttttatcgagtttctccagtataagtttactatttttactttgtaatggctaagtacattgtagaatactttcagaatatgaaaatatcctatttctcattacttccacacactaattttagcagttattgattactgaaactattattttggtgtttaccacaggataatttttttccatctttttaactttttctatactcactaattcaaattctgccatggggaataatagctttctattgcctcccttatttctttatatttagttatttacctttcttattattgactcatggatgtttgttcaactaatattttaataagactattaaatatatcttggagcagtacatatatttttagagaatatatgtttaagattcagttgggtactgttctcagtattccacttgtttcaactattaattgtcatagtaaccataagaagttggtagtgttaccatactcatttcaaagataaggaagttgagacacaggagaattaggtaaccttcccacattactccaccagagtgacagagttgagattaggacctcagcaatctggctttagagtccatgctgttaacaaaaataataaatttaatctaataaggcttcgtgagactcaggagtagtttttctctctctcatcattagcacatcttcaaccaaagccagtatgtgcacaaggcatgctcagatctcagcatcatgggaccaggagatggtgaaggaagctaggattaagcagaatttgcttccaagagtaaaggatttggcaggttggaggaagattatctagccacagaggtaagtcctagtaaggatggtggagcaatctgagatataccagaatacggtcccatcatagcccaaatgggatctgttggtggtatcttcctgctatgttcactgctatagtagattaggattgtatactatgtgttcaggatagaagaacagctttacctgtagcaattaattagtcaaatatagaaggcagacaaagagttgggaaactaggcggcaaccacagcttaagaggagttcactggtaggtaattaaatgatatttatgatgaaaataacaaatatcagcgtggctagtcaggaccagctgacactactggtctggaataccatgaagataatcaggcaaactacagagtacagaaatgaagcaaaaattcacttttgcaactggaccagtacagtagggagaatgaaatattgcaacttggttgcaatagggcacctgcttcggtaggtgtagcaacacagtaatctcactcccaggtttaggcctacagtgattagacttcttgctaaacttcatttgatggggctgagacttctgacattcttattgcttctgccaggaaagtctttacagttccaactcaaaaactgtaaatatttgaacctatacatgggattcctttgacatttattcttacattcatgcattcactccttatcaaacacatacaatgtgccatgaaaatgtgcaggggttagaccatgaccaagacataatctatactatagtatattaatctataccatcaagtaatttattttctagtaaggtagttcttcaataatatatgcaagacataatctatactatactaatctatactatcaagtaatttattttctagtgaggtagttctctaataagtactgagcgcacatggaaagcagtagtggctcaaagttctggtggtgtgtgtgggtgggagggttaagagaggatttcctggaggaaatagatccacctgtgaggataatggaggcagagaaaggtagacaagcagcaacaggaacatacacctgtttaataaaagcaaacacatttaaaacaatatggaagtggcccagcaagatatctaccccagtaaaagaaattcatgaaaaccacccccactgccatctgattaccatgttcagctgcggtgaagtggaaggaaggttaggctgtgccacagatatttatagactcttaaatagctgtaaaagcgtggcattgaatgacatttgtgtaacccctttcctaataatagggattagagctgcagaagatctaggtggtcatgtagttcaatctctgatcatttctaattctagaaaggtgtaataataattatttacatttgcataatactttataaagcactttcatagccattatcttatttgctcctcaaaacaattttctgaaataagcaggaataatatcatcaaaattataaaaaacaattttctgaaataagcaggaataatattatcaaaattattattgcctggaaaaggaaacttaagacggtaggaaatttacattaatggctagagatgataacactagggagtggagtcaaatctgggatccaaatttctaacctcttatccaatgttctttccataataccacctgctttaatttgctaaccaagggagagctgatacttagcaactgggagtctcatatcctctcttggtgactctccaggtatttattgttcctttctgtgaagagcctatgaggagagggagaaatcatgttacacagagaaagtccttcaaagtacgacctctctggaacacctatcttagtttctctttggcagtttgtagaaaaggaatgtttttgtccttacctcaggctttctatttgagaatctgtgggtgtaaggaatgcatttttaacaagcccatttgggaatattgatgccatctgggaagtgtaaaagtaattacagaactgcttctacagagtgttggtaggctctaccatctaagaccccctaccccagtcagaatagatgaagcagaaacaagacgaggaggaagctccagtcagctcctcttcatgcagaaatggcatcaaggactagtattagagaggatatagcccccgacaaattctatcaacttctgaaaagatgcatttaaaaacagcgagattgctatgaaaatataccttcaaggagactctcctaggctctccttccaacagaattgccatttagccctgttttatagaaaccccatgtctgttcttgcatgggctattacagcaggacccacagttttaagggaaaagggtgatggaccatctcacttcttctgtaagaatccagtaggcaagtaaatgtgtaaagctctgaggaaaatatcaagagaaaatatctactcaagttgccactacttggcaccaaactgggtacacgatagacttcatgttatgttcaggttttactagtacaagattctagggggaaggggaaagtggtgagcagatgatattttcataacctgagtataatggaactttatctcaatctcagtttccaaacatctaggacatccacacttctcatgccaaataatttgcctcactgctggattaagttcagggtgactggaaatgacagagccaggcctttctcataacgaccctcaatggtgacctcctcatagaaggcattgtatcttttcttctgtggactctcacaggctgaatgggcttgcaggattcagagccagtgagagatatgattacaaagcctcaggataagccttaggccattttaccaggatccaaattatcagtgaaccaaacagcctggctggaggagatttgaggcaaatacaatcacattgcatcgtatcagaaacctaataacaattttccacaagtagtcactaaccaaaaatggcatattgtagccccataagcagcagatacttctaattagctctagatgattgaccacacatacagatttggctatacatgctagaagtaattgcagttaattgtcaatggtaatgaagcttgtattgactagttaggcaaacatcaaaagcaaaattcaaagctgtttcaagaaaatattgaaatgatacaaaggttgctgaacaaggcaactgtccacagatttgtgaagttaatgtaagaagcatactagtaaggttccatcctatatcacaattttaagggcagattaatcatatacctcccatttcctaaggtctaaatttaaaaatctaggaccatagttagataaataactttgcgtcttctttcagtggaaagccaaatgagagcaatttgatttacattaagtattttcaagtgaataatattaatgaaaggccagagggaaaaaatgacaggaaagaaaattataccgaggcctaatagcaatacattacaaacagacagggagacattaacagctagacattctgtgcagcaaaccattatttatgacaaggtcacctttgctttaagtagatattcagcagtcattgcataataggctagtggggacttcagaaatcttaaaacctcgcccctttattttatagcttttgcaactgaagcccaggagtggggaatggaagagaaggaaaggaacaagtatcgagcacctatggtatgaaaatgcacatttctatgcctttcacacaccccacctttcaatccctacatgaaccttgaaaggcaggtgtcactggtctcaagtcatgctttaggaaattaacgcttcacagcagaaatggtagggcgtgtcctactgcaccatgatgccttcctaaaaagaaaataaaggtggctcatttggtgaaccagcactgctctggtattagaatccaatcctgactcaggaatcaacccataacaactctatcagaagtactttcgagaatctaaaaaataatatccaagaaccatttaaaaagtgaaaacatttggcaaacactgagtttaaggttgaggtaagtcctacatactccagaatatgtatctatatgcttactcagaaataaggaagtctagtagagtacattgattaaaaatgatgactgacattgattgaagagagagtgtatgcctgtctgtatactagactattttaattgatactcaattataattgttatattttacacatagcaaataaatataccgtagaattgttaagtgacttcacaagttatatagtcaagaaatggaaaagccagattttaaacccagggttatggtcacccaaagcttttgctttttctctactactcacttctcctaatttttttttctttttatttttctttttttttttttctgagacagaatcttgttctgttctatcacccaggctggagtgcagtggtacaatcacagctcactgcaacctcaacccttcgggctcaatccacccacccacctcagcctcagcctcccaagtagatgggactacaggcacgtgccaccccacctagctaatattgtattttttgtagagacagggtttcaccattgttcccaggctggtcttaaactcctgagatcaagctatccacctgtctcagcctccccaagtgcagggattacaggcatgagccaccatgtccagcctgatactctttactcttcactataacattcttaggctgagcagttcgtttggaccttggccttgtagatcttgtaacttctatcttttattttcttcatattttgtaacttcaaacttttatgtttcttttctgtaccagtcttgtgtctccaaaaagatggaaaacttaagtgtctctctatttaattccaacacccagtgtgagacctcacagattgttggcagagaaaatgtcaatagtgatatctgtgagaggagctgcttttggtaggctgtagtgatagagcctctagcagccaatccacctcagcgtttttattcaatcactttttgctcatgctgagaaattcctgaggcattcaagaagtaggcatttctgaaaagccccatctactacttaagtgaccttgggaatattatttagtccgtctgtgtcttggttccctcatctttaaaacgaacctaagatcacatatctcagaagcttgagtaaaaattagaagaaataattctttgttgagtgactggcatgtaataagcatgcaataaatgttgatcattatagccccctttggttccaacctttgctaatcacccttgaataatccttagattgataacccttggaatccctctgctcctccttgacctctttaacacggcccaacaaacagcttaactcaggtgttgtctctctaggaatagcatcatcattattcttactcccacagctctggcttggttaataatacattttttttgtgtgtttcctctgaaatatatatagacttccacaataacttctacaacactgtaaagtagtttttcccctttaattttcctttttccttctactgggcaataatatgcttgacaacagggatggtgcctaaggtatctttgtttagcctgattctagcctagtaagtgtcacatttgtgctgaattaatcccagatatcatatacaaacaaacaaattattcctatactggagactatagtggacaatttattttcttgaggcagaaatgggattcaatttggcctcaatgattctggagacaaaaaaaaaaaaataagcttaagccaacatctttttccaatatacgagctgatttattttcacctgcattcatcatatactaactgcttattaaatgaaaataaattatctgagtttctgacttcttgctatagccaaagatagagactgttaatatgctagaatagctattttctatatattcacacatcaaagatggttgtaatcagaaaaaaagtagcatgtaagaagttgggaataaagaagtatggctgctgttgccaatatcaaaacttaaaaatttaatggagtcaagaaacctaaccataaaaatccaaaaatcaatgaagcatatcgtttagaccttgtgtttctttctgaaactttcaggtatacagaatatccaatttaaacagaatttttaaaaatgtcatatattattttttactttgaaatgaacaagattcacaaagtaagtatactgtgagtataatattgtcattgcataaagaagacaccccgttatccaattattttaatgagataatattccatttctaacaaacaaccttctgtttctcactaaaaccaaaggctctcaacctggtttcccattttctggtagtgacgagttaaggcttcaaaactgtttccaaaaacacagctcatttttccacaaactctaatgatttattcagatgcatgtggttttcaccatgtcaatgtgaatacagcataacaagctgggtaacacattccttagacttaagcattggagataaacagattatgactgaaactgacctaagacttggagtagatatagaacgaagataaatgcctgaatttagataaacatgaagcttcttacttatgttcctgttaaactaccagatcactagaccccactagaatatttctgaactctaggctgtacgtgtacctctaaattttaaaaagcctctctagatgatagatacacacagtaaagtgtaaggactacaaagtgatttcctaaaaatggaaaggtgtcaagtagttcttccttatctaacatgcaggtagataagaaaaattcactagaatatacatactttacttctcagattttgtggtaagaaaaagtgagtgcagtttgtctaaccggctatccaggaaaaaaaaaaaaagatcacgtaacgaggagtaacacagaataatggactaaaaacatatagaaataccattttaatagttgttcaaccaccttctgcttagaaactgatttgtgttattttttattaaaatcaattattcattgacccagagggccaattagaagcagctgtggtctgcagcactcatggagaggaatataaaagggtgagtgaattcagcaccttcgactgaaatatccaggttcttacattgggattgactaggcaaacaacctgacccacgaagaaggaagaaaagtcagaggtgaagtatgttccactctggagtagcagagagccaaaggaacccccatccccaggcaagggaagcagtaagtgattgtacaaccctgcccaggaaaccacacctctcccatggatctttgcaacccatggatcaaaatatcccctatgaggtgatccccaccggggctttgggtctgataaacagagttgtgtggagtctcagcagagcagccactcaggcacacacagagactgggagttttacatactccagccctgggattcctagcaaggcatgaaagccaaccatagctatacctaggaagggagcttaatccagggagccaagcagtattgttctgcaggccctacttccatgtcacctcacaagttaagaaccactggcttggaatcctaggcagccaacagcagtgggttgaggtcttcctgagatgggtctgagttcccagggggaggggtagccatcatctctgtggttcagttgagtcagctgctccagcctgcaggctgtggagaacataagtggtctggatgagaaagggttcaccgcaatgcagtgtacctgctctaccagaaagcatccagactgcttctctgggcaggtccctgatcccgttcctcctgactgaatgagaccttccaatggaggtctccagccacctcctacaggtgaatgcaggctggcaacaggtcagtacccccccaggaccaagcttccagaaaagacactggatgccatcttgctatttcacagccttcactggtgatacctccaggtatgggaaaaactgaggcaactgggttctggagtggacccccagcaaaccacagcagccctacagtagagtggcctgattgttaaaaacaaccaaaccgaaaacaacaacaataacatcaacagagaaaccccacagaaaccccattcaaaggtcaacaacctcaaaagtcaaaggtagatcagcccacaaagatgagaaagaatcaacacaaaaatgctgaaaactcaaaaagccaaagtacctcttctcctctaaatgactacaacacctctcgagcaaggacccagaactggactgaggctgagatggctgaattgacagaagtaggcttcaaaaggtgggtaataacgaacttcactgaactaaaggagcatgttgtaacctaatgctaagaaggaaaaagtgataaaacaataaaggagctgatagccagaatggccagtttagagagaaacataactgatgtaatggagataaaaaacacaagagaacttcacaacgcactcacaagtatcaatagcaaaatagaccaagtggaggaaagaatctcagaccttgaaaactatctttctgaaatttgacagacagacaagattagataaaaaagaattaaaataaattaacaaaacctctgagaaatatgggattatgtaaaaagactaaacttatgacagattggggtaccaaaaagaggtggggaaagtggaaccaagtaggaagacatacttcatggtatcattcatgagaacttccccaacctagcaaggcaggccaacattcaaattcaggaaatacagagaaacccagtaagatactccacaaaaatatcaagccatagacacataatcattagattctcacaggttgaaatggaagaaaaaatattaaggacagccggagagaaaggccaggtcacttacaaaggaaaacctattagactaacagtggacctctcagcagaaaccctacaagccagaagagattggggccaatattcaacattcttaaaggaaagaaattccaacccagagtttcatatctggacaaactaaactttataagtaaggagaatttttttttgagacaagcaaatgctgagggaattcttcaccatgaggcctgccttgcaagagctcctgaaggaagcactaaatatggaaaggaaaaaccgttgccagctactacaaaaacacactgaagtacacagaccagtgacactatgaaggaaccacacaaacaagtctgaaaaataaccagctagcataatgatgatagaatcaaattcacatatatcaatactaaccttaaatgtaaatgggctaaatgacccaattaaaagacacagaatgaaaagctggacgaagagccaagacccattgtaatgctgtctttaagagacccatctcacatgcaaagacacacacaggatcaaaacaaaaggatggaggaaaagggatagcaagaaaatagaaaacagaaaaaagaagtggttgcaatcctagattctgacaaaacagattttaaccaacaaagatcaaaaatgacaaataagggcattacataatggtaaagtcttcaattcaacaagaagagctaactatcctaaatatatatgcacccaatgcaagagcacctggattcataaagcaagttcttagagacctccaaagagacttagactcccacataataataatgggaaactttaacattccactgacaatattagatcattgggatagaaaattaacaaagatatgcaggatctaaacttagctctggatcaagtggccctgatagatatctacagaattctccacccaaattcaatagaatatacattcttaccaccacacatcactttaaaattgatctcataattgggagtaaaacactcctcagtgaatgcaaaagaacttaaatcataacaaacagtctctcagatcacagcacaaattagaactcaatattaagaaattcactgaaaaccacacacctacatgaaaattgaacaacctcttccagaatgactcttgggtaaataatgaaattaaggcagacatcaaaaagtttgttgaaactaatgagtataaagaggcatctctgggatgctgtaaggcatggttaagagggaaatttatagcactcaatgcccacatcaaaaactagaaagatcacaagttagaaacttcacatctcaactaaaagaactagagaaacaagaggaaagaaacagaactagagaaacaagaggaaacaaaccccaaagatagcagaagccaaaaaaaaaaaaaaaaaaaaaaacaaagaacaaaatcagagtggaaataaaggaaatagagacatgcaaaacccatcaagaaatgaacaaatccaggagctgttcttttgaaaaaattaataaaacagaccactagctagattaaaaagaaggaaaaagagaagaatcaaataaatacaatcagaaaggataaggtgcatattaccacttaccccataggaatttaaacaaccatcagagaatattataaacacctctatgcacataaactagaaaatctagaagaaaccgatacatttctggacacatacaccctctcaagactgaaccggggagaaactgaatccctgaatagactaataatgagttctgaaattgagggagtaataaatagcctaccaaccaacaaaagctcaggaccagacagattcacagctgaattctaccagaggtacaaagaagagctggtactatttctactgaaactattccaaacaattgaaagggagtgactccccgttaagtcattctatgaggccagcatcatcctgacaccaaaacctggcagagatacaacaaaggaaagttcaggccaatatccttgttgaacatgaatgcaaaaatcctcaataaaatactggcagactgaatccagcagcacatcaaaaagcttatccaccataatcgagttcgcttcattctcaggatgcaaggttgtttcaacatatgcaaatcaataaatgtaattcatcacataaacagaactaaagacaaaaaccacacgattatccaaatagatgcagaaaaggcctgtgataaaatccaacatcccttcatattaaaaactctcaataaactaggtattgaaggaacatacctcaaaataataaaagctatatatgacaaatctacagtcaatatcatactgaatgtgcaaaagctggaagcagttccctttaaaactggccacaagacaatgatgccctctctcacacctcctattaaacatagtattgaaagttctggccagggcaatcaggcaagagaaataaataaatggtattcaaataggaagagaaaaagtcaaattatctttgtttgcagatgatgtgatcctatatatagacaaccccatagtctcagcacaaaagtttattaaggtgagaagcaacatcagcaaagtctcaggatataaagtcaaagtgcaaaaattgctagcattcatatataccaacaacaggcgagccagaagccaatcatgaatgaactcccattcacaattgctacaaaaagaataaaatacataggaatacagttaacatgggaagtgaaggacctcttcaaggagaactacaaaacactgctcaaataaatgagagaggacacaaacaaatggagaaacattccatgctcatggataggaataatcaatattgtgaaaatggccatactgcccaaagtaatttatggattcaattatattctcattaaactacctttgccatttttcacagaattagagaaaatattttaaatttcatatgaaaccaaaaaagagcccaaatgggcaagacagtgctaagcaaaaaggacaaagctgaaggcatcatgctaccttacctgacttcaaactgtaatacaagagtacagtaaccaaagcagcatactactggtccaagaacagacacataaaccaatggaacagaagagagaactcagaaataagactgcacacttacaactatctaatctttgacaaacctgacaaaaaacagtaatggtgaaaagatttcttatttaataaatggtgctcaaagaacaggttagctatatccagaaaattgaaactggaccccttccttacaccatatgcaaaaattaattcaagatggattaaagaattaagtgtaaaactcaaaactataaaaaccctagaaaaacatctaggcaataccattcaggacagaggcatgagcaaatatttcatgatgaaatcaccaaaagcaattgcaacaaaagcaaaaattgacaaatagtatttaattaaactaaagagcttcttcagagcaaaataaactatcagactgaacagacaacctacagattgggggaaattttctgcaatctatccatctgacaaaaatcttatatccagattctacaaggaacttaaacaaatttatgagaaaaaacaaccccatcaaaaactgggcaaaggacatgaacagacatttctcaaaagaatacatacatgtggccaataaacatatgaaaaaagctcagtattactgatcattagataaatgtaaatcaaaaccacaatgagataccatctcacaccagtcagtatggtgattattaaaaagtcaaaaaataacagatgatggcgagatcgttggtagaaatgtacattagttcaaccattgtggaagacagtgtggcaattccataaagacctagaggcagaaatatcatttgacccagcaatcccattactaggtacatactcaaaggaatataaaccattatattataaagatacatgcatgcatatattcattgaagcactattcacagtagcaaagacatggaatcaacctaaatccccatcaatgataggctggataaagaaaatgtgttacatagacactgtattagtccattttcacactgatgatataggcattcccgagactgagcaatttacaaaagaaaaaggtttactggcctcacatttccacatggctgaggaggcctcacaattatggcagaagatgaaaggcacgtctcacattgcagcagacaagaaaaaagagcttgagcagggaaactcccgtttttaaaaacatcagatctcatgagacttatgcactatcacaaaaacagcacgggaaagacctgcccccatgattcaattatctcctgctgggtccctcccacaacacgtgggaattatgggaactacaagatgagatttgggtagagacagagaaccaaaccatatcatacaccatggaatactatgtaggcaccaaaaggaataagatcatgtccttttcagggacatggatggatttggaaaccattatcctcagcaaattaatgcaggaacagaaaaccaaacatcacctgttctgacttataaatgggagctgagtgatgagaacactggacacagggaggggagcaacacacactgggtcctgtcagggaatgctggggaggttggtggagggattgctaatggatgcaaggcttattacctaggtgatgggaagatctgtacagcaaaccaccatggcacttgtttacctatataacgaacctgcccatcctgctcctgtactcctgaacttaaaataaaagttgaagaagaaaattaattattcattataatgtaggtatattgactctatcaatcaggtgtggcaggaaaacaacattgaatattctaccagaatggaagggaaccaatactcaaaggtaggcacttgaatatacatctgagattctcaaaggtggtcattacactcccagatgtatccttatcaattcctacattttctataaaaaatttacagttattgggtattacattttttgagaattataagtgcatatgtgagggtctgtatgtatctgtgttcatacatattaactatcatcatcatcatatttttccacctttttatcccctcctaaattcaaagatggggaaactcaaactataacttgccaaagtctgacatcaaattctgcagttatactacagttggggttggtctgttctccaaatcaattgtctctgtgctctgcccaagtgctcctaaagacttcagcttatttttgggtcatcactcataggctgtgcagctctgaacaattttacaacacttctgtaggccttgctctcctcatatgcaaaacagagatatatagtccccactttctctacagaattactgagattcaaatgaaatattatattgaagaacactctgtaatcctgctaaacactagagaaatataatggattaacaatccttataagaaactgaagcaaatgtgtatttagatgtttcaataaggcatttggaaatagaagatatctcatcaaagacaagagcttggggattctcaagagctcaaattgtaactagcttctcccaatagtttcagaaaacagagtctcagagaaggtacaagatgccgtaaattaatatatctgaaatgggaaaaaacataaagtagaacgacttggtcaatattaacatgaacttgaccaaattaattttttcatataaagttatggtttaaagatgagagctaccatatctgtgtaggttaggaagagtttttaatcatatggtaggaaaaaattgaatttctttaagtgaacagtgtcctatcacaatggaaatgtaagtacctagaaaatcagtattttcattttatatttacattgcaataacagatgttagcatgattttgttgcaaactctctatatccacccctgctaagacaaacataattaaaataatttatggaattgtagtatgcctaagcagtttttgagttagagacacagcaaattttttctatgcccaaagatggcctctatgatctttaagtagttctgatatttaccaggacccatttgcctccaaacagagaattaaataattttgaatttagaagctgcccttgagaatattgaatctggcacttttattgtcaaggtgagaattttctaccttagggaatgtgaggatttacacagagtcacacaggaaatggatgccaaaagtaggatactgtgccaggttttctaactacaggtccagtgatgttttccctaaatttcttactaaaacaaaagccaaaaaaatatgactctacaaaaacaaacagaggttgggactgattgtcctcaccatgaacaaggcttatatttacctctttgtatctgctcctagcagccattttctgtctctacattctacccatctagggattggtgatccataaatttttgcctccaatagacatggaaacagccttactttagcattctaacagtctgactgtgtttcgtgttattccagtttcatcttcaataaaattgccatttagaataaagaaatactagtcatgagtggtcataaatggaagagatcatataaatcatgtatttcaatactcaaatttacagatgacagactagaacccagagaaatactccatccaaagatagaaaatcagtagaagagtctacattataattcaagattttagggtctcagatcttttcattttatacatctgtgctgtcatattcagtcagcaagagttcactaggcagttattcacatggcatttgtagttataaaataagagataagacatcagcatgacaagattttataaaaaatataaagtcgaattaatatgtctcatatagtactatatgattttttgagtttctataaaatgtaaatgatgaatacatacaaaaaattatatagcaactatgttatataaactctaaactataaattataaactataactttgttgtataaactataaactataaattatacattgtatattacacattaaaatcagcaaaattgaagataggacaatggaaattattgagtctgaggaacaaaaagtaaaaaggtaggagaagagtaaaaagataagggacctatctgtaggacaatatcaagtaggataacctatgtactgtggcagtcccagaagaataagagaaaggatgacagagaatatgtgaagaacaaatggctgaaaacttcacacatttgatgaaagacatgaatataaatatctaagaagctcaatgaactccaattaaatggaactcaaaaaactcacaccaagatacattaaaatcaaactttttaaagacaaacacaaagagaaaatcttgaaaacaatcagaaataagtggctcatcacatgcaaggggtcctcaaaaataatatgaacagatttttcctccagaaatattcgaggccaggagctggggaaaatatacattcaaagcagtcaaaggaaaaaaaaccgatctgtcaaatgagaattccatatctggcaaaaatgtcctttgaaagttcgggagatacactgcaagcttccctcgggactgcagccaccctccacatcattttgccagtgcacatgtatgcaggtagatttttgcattccctgtcctgctagcacatgtgtgcatgtgcactctgccatgcctctgctgctggtggaatgcactccaccccacttcccctaccctactgccattgcagttggagcctttgtgaacacagagcctgccagcctcacccccaccaatgctgtgctcctgcaacaacactgccattagagtgaaactagtatggatgacggtggaaccacccctgcctgctctgagcagccacagagagagcacacagacttgtgcccaccagtgtctcacccccatcaatgtcccacccccctgctaacaccaccaccagtggaaccacaaacacagtcaccaataagggatgtcctcctccagttacgctgtctcccccactgctacgaatgcaatacagaggcaggaaccttggcacccactagcaccctgctgcagtcaatgagtgtgaaccccaccatgctacctctgccactggcacatgtgaacaagaatggatcctgctgccatagccctacaaaatgctttggcacctcccattgatgtttagggaccagtggtccaagagcaccatggcttccccaaccgcccaccgattgtagttggtttctaaccttgaggagccagagaggaaagtcagactcgcaagtcccctagagtttgagggcacagtccaggagatggaagctgagccttgccccactaaaatctcccagaaataaagccaatcaactgaacccaccttataccacaatcaaatcctcaaataaaaataacaaaaaccaatccaaaggacagaaacttcaaagattgaaggaacaccagcctacaaagatgagaaagaacaagcacaagaactctaagtcagaaaggcagagtgccttctttcctgcaaatcactgcactacctctccagcaaagtgttctcaatcaggctgagatgtctgaaattacagtagtatttgaaattgggtaggaatgaagatcactgagaggcagtagtacactgaagcccaatccaaggaagctaagaatcacagtaaaatgatgcatgagttgacagacaaaatggccagtatagaaaagtatgtaaccaacccaatagacgtggaagacacactacaagaatttcataatgcaattgcaagtactatcaagtaataagcaaaatagaccatactgaagaaagaacctcagagctttaagactggctttctgaaataagacagtcagagaagaatagagaaaaaaaaataaaaaggaacaaacaaaacttcagaaaaatatgagattatgtaaagggaccaaatctaagattcattggtgttctcgaaagcgttggggagaatggaatcaacttggaaagcatatttcaggatatcattcataagaacttttacaacctagccagagaggcaaatgtttatattcaggaaatgcagaaaactccagtaagattcttcacaagaagatcatcccgaagacacataatctcagaatctccaaggttaaactggaagaataaatattagtggcagctggagagaaagctcaggtcacttacaaagggaaatccatcatgctaacagtagacctctcagcagaaaccctacaagccagaagagattgaagccaacattcttacagaaaagaaattcgaacccagaatttcatatctggccaaactaagcttcatacatgaaggagaaataaggttattttcacacaagcaaatactgagggaacctgttaccaccaaacctgccttacaactcccaaagaaagaactaaatatagaacggaaacatcattaccatccactacaaaaacacactgaagtacacagaccagtgacactataaagcaaccaaacaagtctacataataaccagctaacatcatgatgacaagatcaaatccacacatatcaatactcatcttggatgtaaatgggctaaatctcccaattaaagacacagggtagcaagctagattaagaagcaagacccaatgtacggtctcttcaggagacccatctcacaggcaatgacacacaaaggttcaaaattaagggacagagaaaaatctaccaagcaaacagaaaacagaaaaaaagcaggcattgcaatcctaatttcagacaaaacagaatttaaaccaacaaacatcaaaaagaacaaagaagggaattacataatggtaaagggttcaattcaacaagaagagctaactatcctaaatatatatgtactaaatacaagagcaccctgattcataaagcaagttcttagggacctacaaagggacttagattcccacacaataatagtgggagatttcagcacctcactgacagtattagacagctcactgaggcagaaaattaacaaagatatccaggatctaaaatcagcactgaattaaatagacctgacagacatctacagaactctccaccccaaaacaaaggaatatatattctttgattgccacatggtacatattttaaaactgaccacataatcagacataaaacacccctcagcaaatgcaaaagaactgaaattataacaactactctctcagaccacaacaaaatcaaattagaaatcaagactaagaaatgcactcaaaaccatacaattacatggaaattgaataatgtgctcctgaatgactttggggtaaataatgaaattaaggcagaaatcaagaagttctttgaaactaatgggaacaaagatgcaacataccagaatttctgagacaaactaaggcaatgttaaggaaatttatagcactaaatacccacatcaaaaagttagaaagatttcaatttaataacctaacatcaaaactaaaataactagagaatcaacagcaaaccaatcccaaagctagcagaagacaagaaataactaaaatcagagctgaactgaaggaaattaagaaacaaacaaacattcaaaagatcaatgaattggggagttggttttttcagaaatattataaaatagactgctagctagactaataaagagaagatctaaataaataaaattagaaatgacaaaggtgattttaccacggaccccatagaaatacaagtaaccaccagaaaatattgtgaatgcctctatgcacacaaactagaaaatctagaggaaatgggtaaattcttggatacatgtactctgctaagactgaaccgggaataaattgactccctgaacagaccaataacaagctctgaaattgaatcagttataaatagcctaccaaccaaaacaattctcagtgccatatggattcacagccaaattctactagatgtacaaaaaagagctggtatcatttctgctgaaactatttcaaaaaattgaggagggaatcctgcctaactcattctacaaagccaacatcatcttgataccaaaatctcacagagatacaacaaaaaaagaaaacttcaggccaatacccttcatgaacattgatgcaaaaatcctcaacaaaatactagcaaaccaaatccagcagctcatcaaaaagcttatccgtcatgatcaagtaggcgttatctctgggctgcaaggttggttcaagggatgcaaaccaataaacatgatgagccacataaacagaactaaagccaaaaaccacatgattatttcaatagatgcagaaaagtctcaaaaaatgcaatactgcttcatgttaaaaaacccttaataaactagttattgaaggaacataaaacaataagagtcatctatgacaaacccacagccaacaccatactgactgggtaaaagctggaagcatttgctttgaaaatcagcacaagatgaggatgccctctctcaccactcctattcaccatagtattcgaagtcctggccagagaaatcgggcaacagaaagaaataaagggcatccaagtaggaagagaggaagtcaaactatccctgtgtacagattatatgattctatacctagaaaaccccatagtcttggcccaacagctccttaagctgataaacaacttcatcaaaattttaggctacaaaaccaacattaaaatgttcactagtattcctaaacaccaacaaccatcaaaccaagagccaaatcagaaagacattcccattcacaacttctcccttaaaaataaaataactaggaatacagctaaccaggaatgtgaaagatctctacaaggagaattacaaaacactgctcaaagaaatcagagatgacacaaacaaatgaaaaatcattccatgttgatgaataagaagaatcaacatcattaaaatgaccagactgtccaaagtaatttatagattcaatgctattcctatcaaactatcaatgatactcttcacagaactagaaaaaactattttaaaattcatctggaaccaaaaaaaggttccgaatagccaagacaattccaagcaaaaggaacaaagccagagacatcacactacctgacttccagctatactacaggactacagtaaccaaaaaagcatggtactggtacacagacacatagatcaacagaacataatagaggacccagaaataatgccacacttacaaccatctgatctttgagaaagctgaaaaaaagtaatggagaaaggaccctctattcaatgaatggtactgggatagctggctagccatatgcagaagattcaaactgttcccctttctcaagccatatacaaaaatcaactcaagatggattaaatacttaaatgtaaaaccccaaaaaccttggaatacaacctaggtaataccattctggacataggaatgagcaaagattttatgacaaagacaccagaagcaattgcaacaaaatcaaaaactgagaaatgagatctaattaaacttaagagcttctgcacagcaaaagaaactatcaacagagtaaaccaataaccaacagaatgggagaaaatttttgcaaactgtgcatctgacaaaggtctaatatccagcatctataaggaacttaaatctacaagtaaaaagcaaacaaccccattaaaatgtggacaaagtacatgaacacttttcaaaataatacatatttgcagccaacaagcataagaaaaaacattcagtgtcactgatcattagagaagtgcaagtcaaaaccacaatgagataccatctcacaccactcagaatgtattattaaaaagtcaaaaaataaaagatgctggcaaggttccttagaaaaggggaaacttatacactgttgatgggtgtgtaaactagttcaactattgtggaaagcagtgtggtacctcctcaaagagctgaaagcagaagtgtcatttgaccaagcaatttcattacttggtatatattcaaatgaatataaattgttctatcataaagacacatgcacatataagttattcataatagtaaagacatggagtcaacctaaatggccatcagtagtaggtagactggtaaagaaaacatagtacatgtgcaccatggagtactatgcagtcataaaaaagaatgaggtcatgtcttttgcacgaacatgtaatggactggaggtcattatccttagccaactaacacaggaacagaaaaccaaatactgcatgttctcaattacaagtgggagctaactgatgagaacatgtggacacatagaggagaataacagacgtgggagactaccaggggttggagcgggaaaggagggagaggatcaggaaaaataactgatgagtactaggtttaacacctgggtgacaaaataatttgtacaacaaacccccatgacacgagtttacctatatagcaaacctgcacatgtacccctgaacctaaaataaaagtttaaaaagtgagggagatattaagacattctaagacaagtagaagctggaagaattaattagcactaaatcttttatacatgaaataggccttgagggagtctgtagggttaaattaagggacactagataataactcaaagccataagaagacataacaatgtcactgaaggtaaatatgtccacagtcataaaaattactaccattgtaacaatggtttacaatgccacttcttgttttctacatgactaaattacataatcaaacactaaaattattagtttaaagctaggattaactttggttagtaaatccacattttattttcctcataatttataagacaaatgtgtttaaagtattattagcatatgtgtttgggctcacaatgtgtaaaattgtaatggtaaaatcaacagctcaaaggcgtgaggacagagttgttaaaagaacagaatctctatatgttattaaagttattaaagttaaacaggtataaattcaaattacagtgttaaaagtataaggtgttagatgtaatccccatggtaaccacaaataagatagctatagagtatctacaaaaataaaatttgtcacgataaaaaatcagataaacccaaaggaagttattaatgcagaaaatgagggcatatagaaaagaaaaagcaaaatgacagaaatgtcactccttatcatttattgccttaaatgtaaataatttatccaattaaaggacagagattggcagaatgaacaaaacaattgatccaaatctgtgttgtctaccagagacccactgagattcaaaggtacaaatagactgaaagtgaaagaatgaaaaaagatacgccatgcaaatacaaaccaaaagacagaaaatattattatattactgttagaaaaaagagactttaaatttgaaagtgtcacatgagacaagaagggcatcacatattgagaaaatatgttcaatacaacaagaagatataaacatctacatacacaagaacagacaatcaaaatatatgaagcaaaaatgaacagatttaaagagagaatagtcctatcataacggttgcagacttcaacacctcattctcaataatgattacaacaacaagacaaaagataaggaaggaaataaagacaacacaataaaccaactagatgtaacagacatatacagaagaacactctaccaaacaacacaacatagacattgtttttatgtgcatatgggacattttccagaataaaatacacatattttaccacaaattaagtctcaatagatttttttatagatgtcatacaaagttattttctctgactacaaaagagtgaaattagaaatcagtaacaggtgtaaaaatggaaaacttacaaaattgtgggaaataaataaccattcttagacaatacatgaatcaaaaaaacaaatcacaggggaaattggaaaatacttaaagatgaatgaaagtgaaaacacaatataccaaaaattatgggatgcagcaaaagcagtgccaaggaggaaatttatagctataaacacttatattaaaaaattagaaaaattcaaatcagcaacctaactttaagatactagaataaaaacaaactaaacccaaagatagaagaaggaaggaaataatgaagattagagcacatataacttaaatagaaaagtaatagagactagaaagattatagagaaaatcaataaaaccaaacttggttttttcaaaagatcaacaaaattgataacttttaggtagatggacaaacaaaaggggagaagactcaattactaaagttagaaataaaagtggagacatgatgaaaaattctagggaaataaaaaggattataaagagtattatgaataattgtacagtaacaatttgataacctagatgaaatgaacaaattcttacaaacacacaaaacctccaagactaaatcataaagaaatagaatatctgaatagacctgtaagtagtaaggatattgagtctgtaagcaaaatgtctcccaaaaaagaaaaaccctgggaatcaaaaaaatctccctacaaagaaaagccctgggtctgatagcttcatgagtgaattctaccaactgtttaaggaaaaactaacaccaatacttctcaaattttcctaaaattaatatggaatttcaagtgagctcaaatagccaagacaatttgaaaaaaaaaaaaaaaaaaaacaaagtggaaggactcacactttccaatttaaaacttactacaaagccatagtaatcgtaacagtgtggttttagcatctagattaatggaatagaacagagagcctagaaacaatccttcacatatacagtcaaatggtttttgagaagggtgtcaagaccattcttgagaagggaaaatggcagtcttcaacaaatgatgcttggataactggatatccacacacaaaataataaggttgaacccttacctaacaccatatgcaaaaattgactcaagtggatgaaagacctaaatataattcttaaattatacaactcaaagaaaaaaaaacttaatgaaaatgcttcatggcattgtatttgggaatgatttgttggatataacatcaaaggcacaggcacaacaacaaaaaatagacaaatttgacttcaggaatatgttttaaaattgtgtatacaaagacactatcaacagaataaaaaggaaacacacagaatgggagaaaatgtttgcaacttatatatataagggacttatatccagaaaatatagagaagtcctaaaactcaacaacaaaatcactctgattcaaaaaaaggcaaagaacttgaatagagatttacccaaagaaggtatctgaatggtccatacacacatgaaaagatgctcatggataggaagaatcaatattattaaaatggccatattgcccaaagcaattagtagattaaaatgtcattcctatcaaactaccaatgatattcttgacatgactagataaaactattttataatttctatgaagccacaaaggagctcaaatagctaaggcaatcctcagcaagaagtacaaagctggaggcatcacattacctgacttcaaactatactacggggctcccataaccaaaatggcacggtactggtacacaaacagacaaatagacaaatggaatggaatagagagcccagaaataatgtcacacacctacaactatcagatcattgacaaacctagcaaaaagaagcaatggggaatgaactctattcacttaatggtactgggatagctggctagccatatgcagaagattgaaactagaaccctactttacaccacacacaaaaatcaaatcaaaatggatcaaagacttcaatgtaaaatccaaaactataaaaatcctggaagataacctaggcaatcgcattctggacataggaccaggcaaagatttcatgaccaaagataccaaaagcaattgcaacagaaacaaaaattgacaattctagttaaactaaatagcatctacagagcaaaaggaactatcaacagagtaaacagacaacctacagaatggaagaaaatatttgcaaactatgtatctgacaaaggtctaatatccggtatctacaaggaagttaaacaaattcacaagcaaaaaccaaacaaccccattaaaaaatgggcaaaggatgtgaacagatatttttcaaaagacatacatgtgaccaactagtatatgagaatatcctcaacatcactaatcgttagaaaaatgcaaataaaaaactcagtgagatgccatctcaccccagtcagaatggctatttaatttttttctcttgtttgatacagctggagtgcagtgtcataatcacagttcacttcaaccccatcttcagcctcccagtatgctgggattagagacctgagccattgttcctggccgagaatggctattatgtaaaattcaaaaaataaaagatgctggtgaagttgcagagaaaagggaacacatatacactactagtgggagtgtaattcagccattgtgaaaagcggtgtgtcaattcctcaaataactaaaacagaattgctatttgatccagaaatcgcattattaggcatatcctcaaaagaatgtaaattttctaccataaaaacacatgtatgtgtatattcattgcagcactattcacaatagcaaagacgtgaaatcaacctcaatgcccaccaatggtcgactggataaagaaaatgtggtacatgtacaccatggaatactatgcagccatacaaaagaataagataatgtcctttgcatcaacatgtgtgaagctggaggtcattatcctaagcaaagtaatacaggagcagaaaaccaaatactgcatgttctcacttgcaagtgtgagctaaacaacaagaacacatggatactaggaggcgaacaacggacattgggacctacttgagggtggatggtaggaggagggagaggatcagaataaatacctattggatcctatgcttattacctgagtggcaaaataatctgtgcaccaaatccctgtaagacccagtttacctatattaacaaacctgcacatgtaccccagaacctaaaaaaaaattaaagatgcttagcataattaatcattagggacattcaaatcaaaactatgagataccaccttacacccaataggatagcaacactataaaaagaaaaaagtaataacaagtgttggtaagaatgtagggaaattggaaccctcgtatgctgtttatagaagtataaaacagtatagctgctgtggcaaacagtatgatgggtccttaaaaaattagaaatataatttccatatgatccagaaatttcacttctgggtacatacccaaaacgttgaaaacaaggtatcaaagagataatgtttacacccatgttcaaagtgtattatttgccacagttaaaatgtgaaagcaaccccagtgcccactgatggatggacggatggataagaaaacataatatatgcatacaatgaaatattattcaaccttaaaaagaaggaatttctttcatagctataacatggatgactttgaggagataatgttaaatgaagtaatccaatcacagaaaagacaaatgatgtataattccatttatattaggtactttgagtagtcaaaattataaagacagaaagtagaatggtggttaccagacgctggtgggaggagagaatggatagttactgtttaataggtatagaggttcacttttacaagataaaaagagttatggggatagatggtggtaaggtttgcacaacattatgaatttaataccagtgaaccatacacttaacaatgttgaatatgatccatttttgttatatgtatgaaccacctataaaaattgaaaaaaaaaagagataatttaaaaatagccacacctgaaaggtcatcacactggtccttatatgaaagagacaagagagtgaatggggagagagatgggatgacagaagttggcatgatgtgaagaaaaggccacgtgaaggggtgatgaggagttattgaagatggaccaaaggatacagacagcctctggaagctgaaaaaggcaagaaaaaagatttccctctgaaggctccagaaggtgtgtagcccagatgacaccttcactttatacactggacctccagaaatgtaacagaataaaattttgttgttttatgcttcccttcaaacctccatgaataaaatagcctcaccaaggagttgctggcctaagttaactttagaaatgaatggaatctgtaagactaggctaaagaaactgcatgttaagtactgcgctctagtcaataaatttgtttcccatagggatatggggtaacaattctgattctgatatataaatattccttaagcaaggaagcaaatgaatagctcatggtggcagccaggttttccacttctggagtgggaatttgtggattggcatggtgaggagatgagattgatccatatggtaattgtttagacttggagacaacaataagaactcatgttcaacttaatatagatatagatcgttacatgtagagatatttatggacttgtgtatatacacaggtcattatacacacatttatttctttgttttgccaactgttaagtgtctaaaagaaatggcactagagcagtaatgagtatatgcaacacccagatccagatcttgatttctattattattttccaaagaaagtaaccagtgttgcttggagaaatggctggttcaggtgcaggaaatataaaagatgagcctggagcatgttgtggttccattgggtaaggaagccctcacaaagcaacaataacagcaacagcaagaacaaaatacattgatggcagtatgtcaaaaaggcacaagaatcaactgaaagaactcctagtggacaaagattgacaatttgagcagcaaaatagtgctggattttaattctaagattaacatctgcaagtccagactgatgtgaataaaaaatcgaataaattaataagtggaggacaataatcaacgatgcaaaagaattccaaataaattatgtaaatgcttcatcctaaaggagggagagcaaaactctccactgttaagtatgagctgtgcaaagggacttccttctaaagagtaaagtatggaagtggggaggagatagtaaatttacagcagagtaacctggcacacactacttcagtcaggtgatcaaggtcaataccaacagttataaatcatgttgatagtatacaccctggatatgatgtgattaaaatagtactttacctctgtgatctacctctctaaaacccataaccctaatttacccatgagacaaatctcaatttggagacattctaaaaaatgcctgacctatactcatcaaaactttcaaagtaattgaaagcaaataaggtatgaaaaactgttacagccaagaggagcctaaggagtccagataactacatgtaatatggtatactggatgcgaccccagaacagaaaaagggcattagataaaaacaaagggaatcttaataaactatggacttcttaataaatattctcttactaaataattatgtattgatattgtttcattaattttaacaaatatactacactaatgtaatgtgttaataataaactctgtgtatgtcagaggaaagagaggtaatgtaggaattctttgtactatatgctcaattttttagtgaatctaaaacttctcttaaaaatgaagttgattcatagaaaatcaattgaacaaatgttgcttttggttaattgatgatataactaaatagttcctgttttaaccttgtggaaagcagaaattgttggcttggttatatatttgatttattactatgtgatggatggtatgtgtcaccaaaactgaacagaattttatcacatgaaaggagtaacaggaatatgcttccagaaaagaatgtattcttgacagaaattgataggggttacattttgggggcatctaatgatttaaatcttttatgacacatgtattactagaatttgtcagaacgttaatctaagtacaatcatgtgataatgtattcggtttgaaacagaataacaaaggggcatttgtcacttagcgtcagaatggattcctggacagatatgaccatattgccactcagcagtagccaagaaatttaaatgacttttcctcattttttagtcacttaaatcagacatgtatcccttactacatggcaaaccatgtgcttaagaaaaataatacttgataaaatcagaaaacaaacatcttaatatgtagctaatagcatagacagacaaggaaatatttttagagatcacctagccctggcctgtcgagtatggtagcttctagccccttgaatgtggctagcaggaattaagacatgcttgtattagggttctccagaaggatagaactaataggatatatgtatatatgaaaggaagtttattaaggagaatgggcccagacgatcacaaggtaaagtcccacaataggccatatgcaagctgaggaaaaaagaaggcaggaggggctcagtctaagtccaacagcctaaaagtacggaaactgacaatggagccttcattccacggctgaaggcccaagagtccctagcaacccactggtgtaagtgcaggagtccaaaggctgaaaaacctggagtctgatgttcaagggcaagaggaacagatgggagcatgtagcatgggagaaagatgaaagccagaagacagcaagcaagcttctcccaccttcttctgcctgctttgttctaatgggcgctggatggtgcccatccacattgagggtcttcctctccagtccactgactcaaacgttaatctcctctggcaacaccctcacagacatacccagaaacaatacttacagctatctaggcatccttcaatccaatcaaggtaacagctaacattaataatcacaattatgtgagtgtgaaatacactcatggttttgaagacttagtaccaaaagagaaagcaaaatagctcaataatttttatataatcggcatacagaaaagtttcatctccctgaacatctccctccattcccatggcaatcactggtttgttctccctcactatggttttgtctttttgagaatgtcataaacatgaaatcatgtagtttgtaacctttggagactgacttcttttactcagcatactgcccttgagttgcttcatgtatcaacgcttatcaatcttttttttttttaactgagcagtattatgtgtggatattccactgtttattcacccattgaaggacattttgttttgttttacttactgtatcttgaaactcttaacattttattttaaacataaagatatctattgaaacattattattgctcttagtttaaattcaggactaatatgtgattggtaaaaacaaaaatgaaagcaaaaaaatgtaaaagagaagaaacaaaatgtgggttcactcctctgaccctcaaatacacatgaaggcagtaagaagctcttaaccgttttctttgcctcattgcagacttgctttatttcttacattcctttttgaaaactcttttaaatatcaatcatgtactttttttattttttttttactatctggccctttatttatttttattcattttttattttattgtactttaagttctagagtacatgtgcacaatgtgcaggtttgacacataggtatacatgtgccatgttgctttgctgcacccatcaactcatcatttacattaggtagttctcctaatgctatttctcccccagccccccatacccctacaggcctcagtgtgtgatgttccccgcgctgtgtccaagtgatctcactgttcaattcccacctatgagtgagaacatgcggtgtttggttttctgtccgagcgatagtttgctgagaatgatggtttccagcttcatccatgtccctacaaaggacatgaactcatccttttttatggctgcatagtattccatggtgtatatgtgacacattttcttaatccagtctatcattgatggacatttgggttggttccaagtctttgctattgtgaatggtgccgcaataaacatatgtgtgcatgtgtctttatagcagcatgatttataatcctttgggtatatacccagtaatgggattgctgggtcaaatgataactctagttctagatccttgaggaatcaccacactgtcttccacaatggtggaactaatttacactcccaccaacagtgtaaaagcattcctatttctccacatcctctccagcacctgttgtttcctgactttttaatgattgccattctaactggcatgagatggtatctcattgtggttttgatttgcatttctctgatggccagtgatgatgagcattttttcatgtgtctgttggctgcatagatgtcttcttttgagaagtgtctgtctgttcatatcctttgtccactttttgatgtggctgttttttttcttgtaaatttgtttgagttctttgtagattctggatattagcccttcgtcaggtgggtagattgcaaaaattttctcctattctgtaggttgcctgttcactctgatgatagtttcttttgtcatgcagaagctctttagtttaattagatgccatttgtctattttggcttttgttgccattgcttttggtgttttagtcatgaaacccttgcccatgcctatgtcctgaatggtaatgcctaggttttcttctagggtttttatggttttaggtctaacatttatgtctttaatccatcttgaattaatttttgtataaggtgtaaggaagggatccagtttcagctttctacatatggctagccagctttcccagcaccatttattaaatagggaatcctttccccatttcttgtttttatcaggtttgtcaaaaatcagatggttgtagatgtatggtattatttctgaggcctctattctgttccattggtctatacatctgttttggtaccagtaccatgctgttttggttactgtagccttgtaatatactttgaagtcaggtagcatgatgcctctagctttgttctttttgcttagtattatcttggcaatgaaggctcttttttggttccatatgaactttaaagtagtttcttccaattctgtgaagaaagtcattggaagcttgatggggatggcattgaatctataaattactttgggcagtatggcaattttcacaatattgatttttcctatccatgagcatggaaagtttctccatttgttcatgtcctcttttatttcattgagcagtggtttgtagttttccttgaggaggtccttcacatcccttgtaagttggattcctaggcattttattccctttgtagcaactgtgaatgggagttcacacatgatttggctctctgtttgtcttcatggtgtaggggaatgctgtgatttttgcacattgattttgtatcctgagactttgctgaagttgcttatcagcttaaggagattttgggctgagacaatagggttttctaaacatacaatcatgtcatctgcaaacaggaacaatttgacttcctcatttcctaattgaataccctttatttctttctcttgcctgattgccctggccagaacttccaacaccatgctgaataggagtggtgagagagggcatccctgtcttatgtcggttttcaaagggaatgcttacagtttttgctcattcagtatgacattggctgtgggtttgtcataaatagctcttattattttgagatacgttccatcaatacctagtttactgagagtttttagcctgaagggctgttgaattttgatgaaggtcttttctgcatctattgagataatcatgtggtttttgtccttggttctgttcatgtgatggattaggtttattgcgtatgttgaagcagccttgcatctcagggatgaagccaacttgatcgtggtggataagctttttgatgtgctgctggattcagtttgccagtattttattgaggatttttgcattgatgttcatcagggatattggtctaaaattctcttttgttgttgtgtctctgccaggctttggtatcaggatgatgctggcctcataaaatgagttagttagggaggattccctctttttctattgattggaatagtttcagaaggaatggtaccagctcctcattgtagaattcggctgtgaatccttctggtcctggactttttttggttggtaggctattcattattgcctcaatttctgagcctgttattggtctattcagagattcaacttcttcctggtttagtcttgggagcgtgtatgcgtccaggaatttatccatttcttctagattttctagtttatttgcatagaggggtttatagtattctctgatggtagtttgtatttctgtgggatcagtggtgatatcccctttatcattttttattgcatctatttgattcttctcttttctcctttacttgtcttcctagcagtctatcaattttgttgatcttttcaaaaaaccggctcctgcattcattgattttttgaagggtttttttgcgtgtctatctccttcagttctgctctgatcttagttatttcttgccttctgctagcttttgaatgtgtttgctcttgcttctctagttcttttaattgtgatgttagggtgtcaattttagatctttcctgctttctcttgtgggcatttagtgctataaatttccctctacatactgcattaaatgtgtcccagagattctggtatgttgtgtctttgttctcattggtttcaaagaacatctttatttttgccttcatttcgttatttacccagtagtcattcaggagcaagttgttcagtttccatgtagttgagcagttttgagtgagtttattaatcctgagtactaatttgattgcactgtggtctgagagacagtttgttgtgatttctgcttttttacatttgctgaggagtgatttacttccaattatgtggtcaatcttagaataagtgcaatgtgttgctgagaagactgtgtattcagttgatttcgggtagagagttctgtagatgtctattaggtctgcttgtttcagagctgagttcaggtcctggatatccttgttaaccttctgtcttgttgatctgtctaatattgacagtggggtgttaaagtctcccattatcattgtgtgggagtctaagtctctttctaggtctctaaggacttgctttatgaatctgggtgctcctgtattgggtgcatatatatttaggatagttagctcttcttgttgaattgatccctttaccattatgtaatggccttctttgtctcctttgatctttgtgggtttaaagtctgttttatcatagaataggattgcaacccctgttttttttgctttccatttgtttggtagatcttcctccatccctttattttgagcctgtgtgtgtctttgcatgtgagatgggtctcctgcctacagcacactgatgggtcttgactctatccaatttgacagtctgtatcttttaattggggcatttagaccatttacatttaaggttaatattgttatatgtgaatttggtctggtcattatgatgctagctggtttattttgcccattaattgatgcagtttcttcatagcatcgatggtctttacaatttggcacatttttgcagtggcttgtactggttgtttctttccatgtttagtgcttcctgcgggagctcttgtaacgcaggcctggtggtgacaatatctctcagcatttgcttctctgtagaggattttatttctccttcacttatgaagcttagtttggctggatattaaattccgggttgaaaattcttttctttaagaatgttgaatattggcccccactctcttctggcttgtagggtttctgctgagagatctgctgttagtctgatgggcttccctttgtgggtaacttgacctttctctctgtctgcccttaacactttttccttcatttcaaccttggcaaatctgacaattatgtgtcttggggttgctcttcttgaggagaatatttgtggtgttctctgtatttcttgaatttgaatgttgtcctgccttgctaggttggggaagttctcctggataatatcctgaagagtgttttccaacttggttccattctccccctcactttcaggtacaccaatcaaacgtagatttggtcttttcacatagtcccatagttcttggaggctttgttcatttctttttactccttctctaaccttgtcttctcgctttatttcattaatttgatcttcaatcattgataccgtttcttccacctgattgaatcagctattgaagcttatgcatgcatcacgtagttctcatgccatggtttccagctccatcaggtcatttaaggtcttctctatgctgtttattctagctagccattcatcttatcttttttcaaggtttttagcttccttgcagtgggttcagcatccttctttagcttggagaaatttgttattaccaaccttctgcagcctacttctgtcaaatcgtcaaagtcattctatgtccagctttgttccattgctggcaaggagctgcaatcctttggagaaggggcactctgatttttagaattttcagcttttctgctccagtttctccccatctttgtggttttatctacctttggtctttgatgttggtgacctacagatggggtttggtgtagattacctttttgttgatgttgatgctatttctttgtgtttgttagttttccttctaacagtcaggtccctcagctgcaggtcagttggagtttgctggagtttcactccataccccatttgcctgggtatcaccagtggaggctgcagaacagagaatattgcagaacagcaaatattgctgcctgatccttcctctggaagcttcgtttcagaggagcagccacctatatgaggtacctgtcggcccctacttggagatatctcccagttaggctacacaggggtcagggacccacttaaggaggcagtctgtccattctcagagctcaaatgccatgctaggagaacaccgctctcttcagagctgtcagacagggacgtttaagtctgcagaaattgtctgctgccttttgttcagctatgccctgcccaccgagatggagtctagaggcagtaggccttgttgacctgtgatgggctccgcccatttggagcttccttggccactctgtttacctactcaagcctcatcaatggcgacacccctcccccagccaggctacagcctggcagagtgatctcagactgatgtgctagcagggagcaaggctccatgggcgtgcgacctgcttagccaggcatgggagagaatcaccttgtctgccggttgttaagaccttgggaaaagcacagtattttggcaggagtgtcccgtttttccacatagtctgtcacggcttccctttgctaggaaagggaaatcccccaaccccttgcgcttcccaggtgaggtgatgccccaccctgctttggctcaccctctgtgggctgcacccactgtccaaccagtcccagtgagatcaaccaggcacttcagttggaaatgcagaaatcacccgtcttctgcatcgatcacattaggagatgcagactggagctgttcctatttggccatcttggaatgcccactgctcttcatttttatgttgttattaaaatacttaaaactatgaattggcttatatttgagtcctctcacactatagttttattagacaacattggtctagtctaagttgctttttatgtaaagaaagaacctatggcccagagaacttatgatcagtgccaggtcctgtctttaagtgatctggatatttttaaacaaaaatgtttctctatttaactggggagaagagttttttcaagttatctatcactaagaaaattttcacttaggcttcatgaagttcaaatacattttacataacattttcactgttttctactcaaggaagatcttggcctactgcccttctgggttaaataaaatgagctaccatttattgagtgcttatgccatgtagaccagtgctgcaatttgtataataaatagcttacataatttattattgagtttaattctcacaaaaatcttttatagatgaagaacctgatgctcagagagcaatttgcttaagcaaccacattaatcagaatgtggtaaacatagtatttaaatggggttcttgttctaaagcttgtgttctctccactgttctcaactgcttctgaacacatgaagttatttgtgtaagctgctacagctgtcaataggaaccctgtaaggattatttagcctttcacagctgtttgggattagtaagaagttgatattccttcaattcttcatctggcagaacctagcatggtaatatttgctctaaagaaaataagaatctctcatatttttttcctctggtgcctggaatacatcagactccgctgggtttagaggatcatactgcaacagaagttaaggaggaaggagcaccgtcgagtctagataagtgctcagttttcctgctgtttagcaaacccccaattatctgaaaatttcaataacagaatttttttctgtgctctttcagaaacaagaggaaatgacatcaaagttttctaatttcagaattaaagaaattaatatactcacacacacaccctcatacccacccacgcacagagctatacaggagattcatcacccttggagctgctgctcctcctcctaagttctatattgcagctaaaatttttccttatttggattcttagtcaccgaaaagcaaacaccagaaatcatctgattcaaatgatccattttcacctcgtacatcaacactgttgctaaggtcggtgaattccaactccatgatgtttcttgcatccttcccttgttctttgtcatggcaactgccctagtcactggtcccattcctttttcctggattagtgccccatctccctcttgttcactatgttccagtcattttgtttttctttaatctcctcagaatccagagctatgccctgtgcctggaatgttctccccatgccctctttggctaagtctgactaatttttcagatctcaactcttctgcagaatcccttcctgacctgcacagatgagggaggtcttcttttaataggctctcatggtatcctgttttccttgtggcacttacaatgataacaattaattgtacaatcatatccttaatagctgtcttccctgctggaatgcccttaaatattatgctgggctgctttatactacactgtgctgcttttttctaataaacaatttcctgtattacttccattggggcatctttgaaaatttctaaaatatttataaatgcaacaagtgcttattcatttatttctaactcccattatagatggttgagaacatgagtttatagtcatgacttaacactcctcttcttagcctccctatataaggctgatcaagctgccgttacgttttatgatgttgggagagtaccttagcttgtgggtgagtcaatcttctcaactgaaaaatggggataataatagtactgaacacttcagagctttacagataaaagtaaatcaggtaatattcagatgaaagttaattcagataatatatttgagggtacaaacaaaatgtccatgaaagttggcaagtattaatttacatttcaggggtatctgtatatttatttattcattatttttattaaaaaatgttgtaaagatgggggtctcactatgttgcccaggctggtctcaaacttctggccccctacatcagcctcccaaagtgctggaattacagtcacgagccaccatgccagaccctgtatatttttcctattgaaaaagtgttcagtataacttctcagaagcaaattccaattaccaaggggaacagctctcaagtgtgagacaaatttgcatcctcctttgatctattcatacatttcatttctgtagtcattaaacatggctttttttttccactaagaaatctttaaacttattgaaaataacctcaggctgatcctagtctttcttagtaactgtacatatggcatatagagctggaaaaacacataaattagacaatagagaagcaaccaagctgtgttttatatatatacatatatatgtatatatatatatatatatatgtatatatttggtgtatccttttgtgcagaggcttattttgaagagcatgtgggagaggaagtgtttaagaaaataagaatgaagggaaagagaaaattcaacatctgtaagacgcatgtatgtgattatcataactgggcatgtctgactctaaagagtattaaaatatgctctgagaatcagcagcaaagaactggaaacactacataaatggagatggacctcacaagatacattcaagcatcctaattatacaggtacacatctttcatttgttcaaagatatattcaggacccaaactactgtattcagacctctatgcccatatttatgtctggatgtacacttaaaggaggcaaaggcacggtgcagtactttgctcagaatttccaggcaggctgattgtcctggctatgattccagtcatcataaatacatttgattctcacaaatggttccctggttgcatccagcaggtccatttgtaaggcaagtagttagcttgttctgctgctctgtgactttttgaagagttcctgcattcctgctaagcatgaacaaagcaggaagacattaatgtgctgaccacaatctcctctggccacctcagggaaactagcatcatggattaaatcatttctttgctaaatgacacctgttgaaactgacaagccaacaaagctgagatcccatgctgagcagaagaattacaagcaatggggctgcccacagcattgctgcatgacagtgggtgactgagaatcacattaacacagtagtgaattcacacacttgatttccaagcattcctcacatgctatccttcttgggtgtaaattttgcatttattcattgaaaagtattgtgattcataaaattataatttttattataatttggattctctacagactttgttactgtattgcatggtatttattaatatgtatattattaaatctaatttttttacaaaagcttttaaaacatgaatttctaataagaaaatgacaattcttctagaagtagcagtgataataataacaataataataataattgctgtattagtctgttttcacactgctgataaagatgtacttgagactgggcaatttacaaaagaaataggtgtaatggacttacagttccacgtgtctagggaagcctcacaataatggcagaaagcaaggaggagcaagtcacatcttacatgggtgacagcaggcgaaaagagagcttgtgcagggaaactcccatttttaaaaccatcagatcccataagacttattcactgtcacaagaaaagcatagcaaagacctgcccttgtgattcaatcacctcccacggggtcccttccacaacacatgggaattcatgatgagatttgggtggggacacagtcaaaccatatcaatgggtaacttttactaattgcatatttttttgacataaacttccatatcaccttatatatattggcttatttaagattgtccctgttataaatgaagctttaagtctctgttctttgaaaattggaaagctttaggtttcaccatgttatggaagaaaaattgtctctgtgaatataattcccaaataattaaaatatcaattcacatggtccaaagctgacgggttgttgttctggcaggtttcagaggaaacatcaatagtgataatggctgaactcattcatggaccactcactatatatgccaagccgagtgctaagcccttcacagatattatttacttttatcccggcaacaaatgtattagttaaaaattaatattgtttccttctgacagatgacaattgaagtttggagattaagctatttgctaaggatcaccatgctagattgtggcaaaactagatccagaactaaagtccgcctgacttaaaggctggactctacattactgtgctaactggtggtatttaaatcaattatttcctaaacattttgtttgtgtctacacttttaaaagggagagaaaacattttcccataatcttaggggtttaactatcccctcttacagtaattttgggacatcttcaaatcaaactcaacataaaggacttgtgttcaaatgatttatgaattatagtcagacctgaatctttagaatcctgtaaacaatcaaacactaaattttgggtatcttcctcactgtccatatacattatcattgaacttctgtgaaataatattttatcactctagatgttatttatcacatacaagatggctatttaaaattttacaggcactagcacactaaaaagaaacaaataataatgcaggtaggtaggtgtgtcagagctgtaattggaataaatgcaacgacaagggaaacaatagaagcaaatgtcatagtttgagcagcaaccatattgtatagttaggtctattaaacaataaccatgattttccaagagtttcacttttaattcaaatgttttgttttctccctctctctctctggaaaatgaaggcaactctacccatactcatcttggatgctagaacatccatgtgactgaggcacagatgatatatgaatgactcaaaagggcacttctgtgtcttacttttttgtatgcacttagaaaacatcttagcattagttctcttatgaaaatgaatgaaaatacctacttttcagggttttaggaggattatataggttagtacctgcaaagcatctatacactggcacataggaaacattccatcttttgatcccataaatctgctagcagtgagtccttctgtacaaagaagaaaaaataattccccattatcagtggagtactgatgacagcctcataccagcttataggagccgattacattaatttcttcccagcttctaatgatgctaaaaattaagctcaatttttatacatttaccactataccaccatggccataatttatcttccatattctgtcctctaggaaatcttttagtagcaggtaggttagaaaataactactggaaataaaacaagcatgtatcttgtttgtgttaggcagcagcctcatattctgctgagatgtcaaagacaatgcaatgtgacctaattatatactgatccattagatgagattttcaatatcttagagtgaaaatctgctagttcagaaataccagtaggaagcacacttttcctattctccacttatgtgcccaccataggaataactgatcaatacactcttctcactgagtttacacatacttctgtgccacatattacactaagtgctttgaatacaaatcatatttaatcatgcaagtaattttctttgataagtatcacccaccacttaatataaaggaataaaataaggctcacaaggctaagtaaaggacctgatgttgaagagctgtgttagagattgactggctagaacacagactgcaaagcctgtgttcttcatcggtgtattctatcccttcccattctattgaataaatactgtgttgtaatgggtagaaattattcattttataaatgaaggtaactgagggattaggaaatgaaggcttttaaaacatgattccataaatgcaggatttcatttctccctatagaattacaaaataaaagcaagtccataaacccgattagcagatacagggctgcccgtctttgggaatgttaatctctggtcacatgttgcaaatgtttaactgttctatccatcacataatctcttcttgtaaatttatcatgaaatatatttacagctctctatatgacatataaatcatagactaagagctgaatttagccaacattttgaaatcattcccaagagatgttgcggtataaaattttatattcagtttagcacactatgttaacgaacacactaaaaccgcaggacatttcaattactagaattaaacagacctcttaaagtattccaaatgtattctgcagaggcttgtcagtggaggtggagtgtatgggattatctttctatctcaactgaaatgatcccacagtaagcgtttggttacttagtaacattaaaattgcagttaagttcccttacaattagtggccttcaaataaatagttttgagaactaattacatactttggcagaatttcattctttctgttttggtagttattctggtaaatttctaaatgtagtgggcatgatcttcctctccaaatgcttttttacgttttaaagaagaaaggctagtttgtactgaaacttgatttggagatgaatagatcaagaagaaatggacgtaagttgttcaaagaataaattgaaaaagatgaaataaagatttttgtcccattacttatgacctcaaaacatctatagttaaaataattaggcagatgaacaatcatatctaagaatatttgtgtacttacgatgttaaaaacatgatagaagatgatgtattatcctcggagacacaacatcatgcagtcaaagcattcagttctttggcctagttagtcatttctactacaggtatttgcaaattttaggaaaactctgttgtgactgatgaagtgaagcctcaaatttttattgaacattctataattaaagaagttaagaaagagtatccatatgttaccatttttgacatggttagcaacaatagtagtgactatgcaccatttatcttcaggcagggtggaaagtaaactactggaaagaaaacaagctgatacttgatgtgtaagagcactttcctgctttgctcaggttccaaagacaataaatgttacctattcatatattgacacattagataggatgcccattcacttagtgtaaaaatctgctagttcagaactaccaaggggaagcatacattttctgttctctgcttttatactcatgtgtccaagagatatcaaatatttgtcatacactgtgccaggtacatgaatatgacatggtccctagtacaaagagaattgtgatctgagaaatagatgataaacatacaacatagtgaaatggaactatccataagacgtagcagcaggtgatggaggtaacactgggcatgtgttctgaatgtgaataggaatttgataggtaagagtcatttcatctcagctataattttctccaataagtcattgttgacattgctcccttgcaccacccagaatgaatttgaggtggtacctctgagctcaaagaattcttaatgcattgctttgccatgacttgatataattagctaacatcacaaatcctctgaaagcttccaaaagccaaagtgcttatagttcttacattaaccaatctactctctttagctttttgaactcatctctttcaactcatctcagccaactagactctttgctacttgcgcaatgtgtggaacatgttctacttctgagcttttgttcttgctgtgccctcaacctggagagctctttccataggtaccaacatggctccccctgccccatctttaagtcttctcacatatcatcttctcattaaggacattcctgactaccttattttaaaacatcattcccacagacacttttttgatgcccctttcctgctttatttatttttttacgttacatacctttctgtgtctattatctatcccctttcctcgctccacttaaatatgagcttcatgaagacaggggcttctgttcgttttgctaattgctggactctgggacaagaagagcttctggcacataagaggcaatctataaatgtttgtagaatgatttaaaactgaaataatgtatgtattattcagaatacacagtaagtttttataatgtttcagatgccctttgaagatggctgttaggtggaaaagactgacagtatacaagtaaataagtaaataaaatgtactaattacagattgtagttaatagaatgaacaaaacaagcagatatctttatttaaaaatatgatatatgatatgatgtgtgtgtgtgtgtgtgtgtgtgtgtgtgtgtgtgtgtgtgtcttttaaaccaggacaatcagaaaatgcccctctgaagagataagctgagatccgacatccaagcatcactcatttatagagttggtgagcagaggtcagtactattcaaagcagaggatggagtaactgttaaaaaatatccagggcaggaaagaaatgaaatttttttatatcacaaaaattaaaaaggagaggatgtggaagacagtggaatgagcaagggttattggtggaggccacaccatacaaggttgtaggagacatgataaggcatttggatttatttgaagagtttttggaaagtatcaaatgattttaattggggaaatggcatgatttcctatagattttaaagagtcttctcttttaaagatcctgtgtagtgcgtgaataggactgtgacaagaatggaactggaataataggaggctcttatagccatccaggtgagatcccatgatttgggttaagaatattaatgatggtgatgcatggatatgtttaagattgactttaaggatagatcattaggtgttggattgcatttaggaggtaaagaaaagagagagaggaaaaacaagtcttcattttctggctttggtaataaaataatatcatttattgagatagggaatgtagggaaatgaatggggaaaaagggataaaaaagggatagaaatttggtttctttctggatatgttaagtttgaaaggcttatgtgatatccaagtggagatgtcacgtaggcaggtcaatacataggctagatctatgcctgtcttcatcattatacaatgaatttcccaagggaagatattttactgtattcgtccctaggtcagcagttggcaaaatggttgttttataaatgttgccctgaaagactactctctttatatcctgctgggcttaccagctagacacactgggcactctagctttgggaggaacatctccttattcttctttgctccttagatcagaacaggccattgcatataaattgttagctccagaataacttttcaaaaatattttacttcattttgaaaatagacctgacaaaccctttggatataacacaataagctaggtggtgtatttttagaagaaacaaagcagatcaatcataatagtaatattgtaagaggaaatatgaaaaattttagactcagggatcctgagagggattggaaaacagcgggaataaagtcaaaggaagccatgggccatgtgaggtgttaaagcacatggaaaaaaatgggatggtaggaagaatttttatgaacaagcagatcatattgttatccaataattccatttaccaaaagtattgaaattatcattttatattttattccacagggtatatatttcacatgacatctcttctaattgagaacagaaacatagtccaacttggctctaaaagttgtaaggatatattactaaaaatatgttaaaatatttgagatatttagaaatgtgactatctgatggaagtagattaaaacataaatgcttcttaatttccaattctgtttaaagaaactatgctgttttcaaaattctgtcagttgctagggaaactagaaagggggctattaaattgtatatggaaagctattttccaaaatacattaagtggaagatgtgagtagttagataaaacttttcataggcaagaaaacgtgtgaaatcctaggtgaaggatgaacgcctcctcaattgacagtttgatagagattctgtgcctcctttaccatgaaccattgttattttagagggcagcaatgttctcattgtcctcttggggaatgtattcttaaggaaggtgagtaatcctggaagaaaagctaagatctttttggaccaataatgttaatatagttacaggaaagatcactaggctaaaaattaggagaatcgtgttctaaaccagacccagatatgaacttaggaaagctagttcttccctggtctccaattccagcatctggatatgagtgaaataattgttagagttccttttgcctataatcatttaatctgtgagtgacaggtgaatggcaatccacaaagtagaggataatacctttaacaagaaggaaattgtgggtgatgagatcaattgtcaaggtctggaggccaagttccatttaaataacataaaagcaaagaaaaaaaagaaaaaagaaaaaaagaaagagaagaaaactttaagtgaaaatttaagaatgaattatttcggtaaggcttatctgtaagttaatgtacctgctaatatataatgattttcatttttgttataaattgaacattttttgttcaagtacactgtatttagccatttttgatatttttaatactcagagaatttataaacattcctaaaatccttttatgaaccttatcttttagaatgatagaagtctcttgattattcccttgtggtaccatattaaaaatgcaaaggaaattttctaactcctcaaaccacacaccagtggcattccaaagcctacagaatagctagtgaatatgaagttaaccagtccaaatgacctttccttccacttattcttacggtaaattatatgctgtaccaatattaatgtacttgcagcttcctaaaattcaacaaatatttattgaacatctacaatgtacaaggcaaattttttttttctttttttgatatggagtcccactctgttgcccaggctggagggcagtggcgcaatcttagctcactgcaacctctgcctcccgggttcaagcagttttcctgcctcagtctcccaagtagctggcagctgggagattacaggcatgcaacaccacgcctggcaaatttttgtatttttaatagagatgggattttgccatgttggccaggctggccttcaattcctgacttcagatgatccaccctcctcagcctcccaaagtgctgggattacaagcatgaaccactgcacctggctcgtacaagcaacttctaagaattctcccatatcctgtatgctatttttgctctaaatccatattttcttctatctacccattaattcattcataatgtatgagtcatattatttacaaacacagaacatcacacactgcacagtgtttatcaatctctgtgtttgtttttcccatcaaactttgacttgagtaacataattctgtcttgcttgtatttgctgaataagcaaattaatttttaaaaactatgcatgaattaattttaaagatactccataacagcaactttggctggaaatatttgttctatgaaaaattttaccatgtgagtgttacaacttcagatgaagcaggaaactcttcttttttaatatatagaatagtactaggagagaaggtatgataactaatttaaaaaataaatatatgaggctcgatgtatgtgacagatagatcaactctcaggatagtaggagaggacaggatgcctagaatggaagagaaaaagcatgaagtacaaatcaggaataaggacaaggggtagggtatcttaggcaacagaggtaatggtttgaaagtaggaaatatcacgatatactgtagtttggaaaggtaaatctggagcatttaggagtaaaaatgaacacagtagaagataagtttagaaaggaaggcaacggctagcatatgatgggctgcaaatgcaatgacaaataatttgaactttatcttgcaggcaatggggagcctctggaaatttataacagttagaattaaattttagaaagatcactggcagcaatgtggaagatgaattgcaagcacaggagaggaaatggaaacagaaaatactagacaattggaatggtaagaaattacaaaagtctgcaaacagtgacagtgtgaacgcagaggaatgaacacataggaaagaagttaaaccagtagcatgaacaggatttattccttaattaaaatttagggataaagttgtaagagaagattatatctactctcattgttttcaagacttaaaccaggaggacaggaggaagtggcaatggtaagataatgcactggctgggtttgagatgcttacgaaaaatgcactggaaatgtcatataagcagctgaatatgcaggtgaatacgttaggagagaattgtgagttgaaaacatacatttaggaaaacataagatgcttgagaagagcaactttgtcttgtttactctttattctcaactccacacataaagactgaaccttcagcaaatgctgagctgctactgctaatgttgaactgatactatcacccacttccaacctcccttgattagaaaactaatagatgcaagtctcctgacacataataaggatgcaataaatggaaatttcattgataacttgataacttggacaaggacagccctttttgtttctattatatattctagaatataaaatatgaatacatgacaaatgaccaacattacaatatatactgaagtatatggggcaagtgctattaaataaaggacatttaaattattttaagatactctatcaatattttaaaagcatacaagtttgtggcataatcagtattgaaatgaaatcaattctaaatcatgtttgacttctagttagaggtttatattctttcatttaatcagtgtttaccttgtattctgtaaattcatttggttttcactgggcttttatgtcattaatttcttatttaataatttgtaacatcccattttagcttagctgaaaaaagagtaaaatggattttatggcattgatcagtgtactacctaggtcaatgtaaaagctaggtagtagaacatgttttgaaaccaaagcaagttgggagagcatgttagtcagaatatggaatcccaggaataagactcactctttaggttatttcatctcagcacccaattttattaccaacaacctagttttttaaaaaaatattgtagtggcattagaaagttgggctttacactaaaatcaatagccctgttttcttagtaggggcctgaaaatatctcatagatattattgctctagaaagagtccatttcatgcacagatgagtctgcatgtatgaatcttacctgggcaatatcagttatgaggaacttaggacatttattctattgttctaatttgggctatttataggccagaattagcatctttggtgcccaatctctaaatagaaaaaacaaaaagctaaacatatgtggtaatgtggtgaccaagaaaactactctttttatgggtttccattaacatactgtgttcaaaaagcaaaacatgtttatgacaggactcctattatttctagtatcaaagaaatgacagtaacattacaactaggggatatttctagagattggtctgataaagctccagcttacttctccattgtaaaaaaagttatcttaaagatgggaatttttctatacaactcaatcaatatttagtctgcacatattgtgtgtcccacccaacatactgaggtatttgggaaggggtatgaaaactataagacatggttctgaggtgaaatactgctttttaaattgtcttttcttaaaccaattattagtgtttttttaatgaaattataccataaccatttgtatttacatacgcttagaatatgtgcaagtattattgaaaaatatttaaaaattacaaagttttaaacatgtaagatgggccttgtggcccatgtaagatgggcatgatctatttttgatactatttagagactatttctgatactatttagagtaagacgggccttgtaatatgcatcatcatgatctatttctgatactatttagagtatagcactagccttatgtttatgatcactatgcattcttatagttacagattatacccttctgttcagactcttatctccaaattgatgatatgtattacagagcagttgccacctaactgaataactcatatcaatcctaactgaaagcacaacagcacttaaatatataatctagcccaaacttaaacctaaggtagggatttctataggaacaagaaagcatatatatgaactgtattttttcattgtttcaattaattttaacctgtggtataagctatgtgctttccagatttacacatatataaaaatttgacatataattcgagagaattaatggattttatagtgaacatctaaggactgctaggtatttctggacctcaggtttaaaaacatgggaataactcattgatggtagaaccgtagtatcaatctggcatttaagatatggtatatttttgcatattctgaggaaggttcttctttttataagacacagaaatagaaataatagtattgggaagaattttaattagatctaagaataacattcctaatgtggatataaaaattaagatgtgtttctgggattctcagtaaagcttatattttatgatatagtcattacataattttccagaactataatagtttcagaacaaacctactgggagggccaatacgggagtcaggaagcactcaagaagttaagtaagaaagaaggatctgaaagaagcagggataggttgggaaaggaaacaacagagaagactgttttttttgtttgttcgtttgtttgtttttgtagagacaggtcttgctctgtcaccgtggctaaagtgtagtggtgtgatcacagctcagtgacacttcaacctgctgggctcctgtggtcctcctgtctcagcctcctgagtagctgggactgactacaggcacacaccactatgcctggctaattttatatacagacaaggatctctttatgtttctcaggctggtcttgaattcctggcctaaagcaatctgcctgcctcagcctttagcctcgaaaattgctgggattgaaggtgagagataattaatataatggtttggaatccttaatatacctggaacatgcatgttcttaagcattcccgtccccactattctgcttcaggggaccagcatctctcacctggactagtgcaataacctcctgaatggtctacctgcctctaatgttaccccatgttcaagccactatttgcactaaattaaaatgtttctagtaatatgagttatttcactttcctctgtaacaccattctgtggacactttttgttcttatcaatctgaattatttaccatggcttaaaattccctggcagatctgtgagagtgtagtcagcctgaaaaattgggttacagtcagaccacatactttgaataaattatgtgtttttattttttaaaaaaatattctgttagacatttagaggatgaatcaaggtggaaatactagaggcaaaatgatcagttagaaatctattccagttgacatgttaggaacataaagtaaggtgagtccatgggcatggatgtgaggagcatcatggaggtaagtttaatggaacttgaaaataaagtatatgtatttgatattaaatagcttcaaacctgagcaataaagaagatgatgatgaacgagtgttaaggtgaagcatcatatcctgttactggagggttattatggttactttgtctgcttggataaagaattaggccaaatagtacatttcataataaatcttcctcctagatgggctacacatagcatccaatgttcttcatgagaccagttagtgcaaaaaaatagctaagatagctatggctgtaaagcccagagatctctgatatggtgtgattaccatccttcacgatctattacataagaaagaatttccactgtgtgcctccaatgaaagaccaaaatgcaataagtagaacttacagaaatttcagataagaacaaacaagaatattttaacaatcagagctagaacatgtagaaaaatggtagaattcccattatatgaacatgagactatattgagagggattgagatctccacatgtagaagttctacaaatattagggcatatggaactgaaagggcctttaattcacaagcgagaaagcagtatcccagagaggggcaggcaacttggccaaagttgtacagctggttacagattctgatccagtttcagattcacagcccagtgacctccatgctacataatagtggctacccaaggccaaggagccagtgttgtgactacctcaaagacatcataaaggaaaggcttgaagtggactatgcagttggaagagaagggaaaataagttgaccatgaacaaagatactctactaggatggatcatatactagggaagggcaaatataatagtgaaaggattgctttccatttgaaggtatctgtgaagccattagaaataactaattactgttaataataacaataatacctacaatattgaacagattttttaatgcaagcttctgtgatgagtgttcaagatatcatgacaaccctatcaatgagatattattagcactctccattttacatatgcataaatgaaggcttaaagaggctgtataatttgccaaaaatcatttctgtagtaagcagctgaactgagtcccagaattcagcctatgttcataaccattttgccatattgctaatgtgggtatcatagtggatcccttagcctgagaaaacaacgagtttaatagttgcatatgtccctattgtgtaggagagccctggagagacattttagaagctttcttgataaaaaaagaaaaacaattagctaatcatctggattgttacttatttaatgaaacgtattagtaatttgaaatagactacaatgaattactcagagaaaatgggttcaactaattggttcagaaaagtcttctgaaggatataattaaattgcctagtgtactattactgctagcataaacactattactgatcttcaggaccacttgcatttccaacgtaatttaaaataagtagtgggagagacaagatccatggacacaatgtgtttcaaggaatcagccatgtggttagctaatgaaagcaaagcaaggtcagtatttgaactgtttccagcaattagcattctgttatatttttgttcctatgaatcatcaatttcaaataactcttaaacacctttttaatagaaaatactatcttatttaataccatacttctgggtcctagtatgctgtttggaataaaagatccttaataatgtatgctgaataagtgaattaaatttttataaaaagtgtcttttcttttaaattttacaaaagacataatttaaaatatacatatgacactcaccacatgacttattgaagattagatcagaacataatatttgacttcaattctgtatggttacttctgtgaagatttatgataaaaaagccaggaacaaatggtaaggaatgcaattattttttaagtgccatgatattttcatgactgattttcattaagcatgggaagtcatatctgccatggatcctgcattatatatgtcttataaataggctaaaatgatttgaacttcataaactgataaaaatgctcttgagatcttaggatcttaggatctttacataattctttgtcacaagttgacttctgtgaagatcatgaagcaatattgttctctagggaagatgtggaaagaaacaggtgcctgtatttctttttgtgattacctagatgaaaggaaagtacacacacacacacgtgtgtgtgtgtgtgtgtgtgtgtgtgtgtgtgtgtgtgtgtacagaaacaagcatagttttattacactcttagaacctggataatttcttagtacagagtggacaaacaggaaatgtttgctgttgaattaatgtatacaaaattagtttcagagactgtacaaacattgatatcatctctgcaaaatctaggtgttcaacatgagaagactggattcttttacttgttgttgttgtttgttttgttttttgtttttgtttttttagagacagagtcttgctctgtcacccaggctggagtgcagtggtgcaatctcggctcactgcaacctccgcctcctgggttcaagagattctcctgactcagcctcccaagtagctgggtttacaggcatgcaccaccacgctccgctaatttttagtagagacggagtttcaccatgttgatcaggctggtcttgaactcctgacctcctgatccatccgcctcggcctcccaaagtgctgggattataggcgtaagccactgtgcccagcccaagattgggtttttaattataaacccacttaaaaaaatcctgagaaaatgccagatataataagcatatcttaaatgacctaagcaatagcacaaataatcttactattaaattattctaatttgcttgagatgatactaagacactgtaagcagcagaaactagaatttagtaagtccagcatcactaattttacaatgctaataatctcttctttcttttgctttttaaaataggttctaaatttgttggattctcttacctgtcacaatataggatcctattttggtataagataattaagatgggtttttgattatttctatctagattttgaatatattatttactgcatccctttaaacattttcatgaattgctgttgttaaaaaaaaaaagcattatggatcttgatctcttcctctctctctcttgcctcacctccctttatatttagttggggagctaagaataaacatagaaaataataactcttaatatgtcatgagtatcatgacacatggtaaaataccatgctgatttttccttccatgcatattataatgtttccttcatcccatgcttctctctcactgactggaatctcatgctctcctgtctgctctttctcctttctcttagcaaatagcaaactcctcttttttccttaagtcccaggtcaagtatcaatttctaatggaaattatctttctgagactacatgttctcttttacctaatcagtgttgagtgatatttagctttgatttcaatcaatgttatcattggatatgacaatatcgttcaattttttttctcccatcctcttcatttgtctgaaaaatgccttgagggcaggcactatgtccaattaatctttcatctatcagtcccaaaacttttattaaatatttgctatgtgtaaagcactgtatttgttgctggaaattcttgaccctaagttcagtatattacacagaaaacacttttgtagaatgaataaatgggactttataatacatcaaggaaattctacaaggcttattttaagaaaaggtcttaaatgaaaagctggtgaatgtggggcagcgatcaaggcaggacaaagagcaaccatcttcatctcacatcattaagtttaaaagttatgtattttccccaggtttaacgatattggtctggaaaataaagagaaaataaatatgtatgtttttggaaagcctgtggtgttgtaaaagttatttatcacggtcataattgttgttttgtggataggagcatttgagagaaagctgggattgaaatccctgacactgagtcaaagtcatgagtgtttctctactctttgctacctaatgaaaacaccaaaaaaaaaaaaaaaaaaaaaacaacaacaacaacaaaaaaaaactgcaacagtggagcttattttatatgacaatccagggaagactcaaaaggagtaaagcatgaaaccttggcacctgttctaagctagatctagatgtatgttaaattaaaaaggtataaagaaaaaataaaagcttttgttttcataaataaatctctgtttagtatccaaagttagtaaagatgtgaaaaacagaaactcttgtgcccttttgaagggaaattttataatacgcataaagagttctaaaaagtacatggccttcaacttaaaaagtatttggcacttttagaaatttctcttaaaagctactaagaaaatgttcacatatttttatatgagaattttcattgaattgctgcttataattatgaaaattagatttgcattaattttctaaataacttacagcagaaccttaaaaaagattaaacacattaaaaatgaagatttaaagctaaccgtttaacatagcaatttatcaacaatagttaagttagggactataaaacagtatatacagtattaatatcattttttgtaactatctatatatgtatacttcaagagaattaggcacattattatacatgtgatgcattttgatataggtatgtgagtgcatggaaatttttgaagcatatgaacaaattatgttttattatgagtgcagtggagttatatataatatggataagtagacaatgaaataaataatacaaagaagtagaaactcatacagcaaagatatcccaaacttaaaataacacactcatcatctttaatggaaactagatatgctttcagcctaagtttaaatatggatatatatggcccccagtctcgagtttccctagagcaacattagctattttgtgtatccatggtcacagcagttctacgataataaaagtcagaagatttctcctttttcttatccttcacctacagaaatgaaaatggcattcatagtttagaaagttcttagctcaaactaaatactggataatgcagtaaagcacatatcaataatcccaattgaaacagtctgggctttgatcccagacttcctggcaaacaacagactctgtgggccaataggcaatggaaatgagaatcaacctcccagtgaaaagagaaaccaacatcatgaatgaggtcctaacttgaaagaaaaatctaagaagcaatttctgaaacagccccacagggagtttatgcacatttgtgagaaaagtaaaaaataaataaataaataaacaaacaaaacctcggggctggcagggaatttacctatcatttagcttgattctttcatttcacagatgaagaaattgaggcttaaaaggagggcaaattgccaaagttgctctaaaaattagttctataaagtcaaatctcctgattcctaacctactgcagttcttatgtaggactctccagccaaaacagtactgtttttgtgtgctatgcaattttcttgacaaagagagattgtcatagcaattccttttctgacaatcacaggcagagttatgtagttctttcatggttctacagtacttaaaaaaaaaaccttctagattacttgcaaaacaatatcaaaatttttgcttatctatttccagtagtaaattttgtgttcctgaaggacaagaatcatattgtgtttaccttaaatccttagtgccaattgcattgcacaaaatatagcaggtactcagcaaatatttcataaatgaatgattgttttattctgttcattagattcactagtgaggagaggcactcctaatggactagccaagggacattatgatatgatggaaacagcaagttctcataggtgacacctggatttaagtccctcctctatcagttcctaatggcaatgacaccttcaattgccctgagcaacacattccttatgcataagttgggagaaatcatacctgctaggctactttccagtgtggccatgaggatcaattgtgataaatgtgaaaataacagcaattttattaatagcaaattattacgtgaatggaaggaatatgtgtggggggcttttaaacagggtctagctttttcagggcataccattcaaacacaatgcccattatagtaaaataaaatatataggattgtttctactgataaatgctatatgcttcaggtatgttttatagaaatccaaagtcattggctatattgtactggggtaatgacagcccagaggcataccattaagcctttgacttttgagtgatgcatccacagatttagggattccataaacttgtagagattttaagttccaaaattttctcctaaaatgtataaataattgctggtagggaataagaaaagtacattgccatgtagatactgagaagctggccaaaggatttgttcctatatgtctccagatgtgagatttttatttgtgtctcactgaagctataaattactgttaagttggtgcaaaagtaattgcagttttgccattaaaagtaatgtaattactttttgagaggcaccctcaaaggtaatttgcaccagcctaacatggttcatgcttctgggtttcttctagtataggagacattgtaaatgttaaattccatattgccagcagtctgctagaactgcacagaacaatttagttatttgagacaaatatatctacttgtaaataatcatccatgcaagggttattagcatcaaattaaggaacaactgaatcttaacaaaacccacaaacataaattgtatgagttaaaagagtgtattaagaggacaatgtgggaggcataggtgagagtgaggcataggtgagaaacccacatgctagaataacttgacttctttcacagagatagtaagtatagtcaaatgaaaggcacatttgcttcaaaggcacacatttctccaattaagtttgaatttcaattctagtcctgctatttactagttatacattaacaaattttataacctctatgaggagaaaagctcctcatggtgtcaggagccagagaatttagtatgctgagcagaggttaacccttttctggttacacccatgtggatgatgcaataagggtcaggaatattcctaagctgcaggaaaccccttctctgcaccaagcagaaacaagcgtgggggagggaaatgtggagaaatgctttagaatatctcttttaagtttcaggaagcgaggttctatttttcctgggtttctttgattttatgcttgctttcaaatcttgcagtgacagtgatgagagctcatggatcaacattaaagagtagggtcataaagacaaagaactaagaaaaacacttcttctggtgtaggctttaagactctgagatccagctcagctcacaaaaatcagaagttctacatagcaaagacatagaatcaacctaagtatccatcaacagataattgaataaagaaaatgtatatatactatttatagtgtatacatagtattctgccattgaaagaataaaatcatgtcttttgcagaaacatgaatgaaactagaggtcattataataaatgaaacaactcagaaacagaaagtcaatagatgcagaaaaggcgtttgacaaaattcaacaaccttcatgctaaaaactctcaataaattaggtattgatgggacatatcccaaaataataagagctatctatgacaaactcacagccaatatcatactgaatgggcaaaaattggaagcattccctttgaaaactggcacaagacaaggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccatcatctcagcccaaaatctccttaagctgataagcaacttcagcaaattctcaggatacaaaatcaatatacaaaaatcacaagcattcttatacaccaataacagacaaacagagagccaaatcatgagtgaactctcattcacaattgcttcaaagagaataaactacctaggaatccaacttacaagggacatgaaggaactcttcaagaagaactacaaagcactgctcaatgaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcacgctacctgacttcaaagtatactacaaggctacagtaaccaaaacagcatggtactggtaccaaaacagagatatagatcaatggaacagaacagagccctcagaaataacaccgcatatctacaactatctgatctttgacaaacttgagaaaaacaagcaatggggaaaggattccctatttaataaatggtgctgggaaaactggctagccatatgtagaaagctgaaactggatcccttccttacaccttatacaaaaattaattcaagatggattaaagacttaaacgttggacctaaaaccataacaacctagaagaaaacctaggtattaccattcaggacataggcatgggcaaggacttcatgtctaaaacaccaaaaacaatggcaacagaagccaaaattgacaaatgggatctaattaaactaaagagcttctacacagcaaaagaaactaccatcagagtgaacaggcaacctacaaaatgggagaaaattttcgcaacctactcatctgacaaagggctaatatccagaagctacaatgaactcaaacaaatttacaagaaaaaaacaaacaaccccatcgaaaagtgggcgaaggacatgaacagatacttctcaaaagaagacatttatgcagccaaaaaccacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttagtgggactataaactagttcaacccttgtggaagtcagtgtggcgattcctcggggatctagaactagaaataccatttgacccagccatcccattactgggtatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaactggaaatcatcattctcagtaaactatcgcaagaacaaaaaaccaaacaccgcatattctcactcataggttggaattgaacaatgagaacacatggacacaggaaggggaacatcacactctggggactgttgtggggtggcgggagcggggagggatagctttagtagttatacctaatgctaaatgacgagttaatgggtgcagcacaccagcatggcacatgtatacatatgtaactagcctgcacattgtgcacatgtaccctaaaacttaaagtataataataataaaataaaataaaaaaacaaaaacaaacaaacaaaacaaatactgcaggttctcacttgtaagtgggagctaaatggcatgtacacatggacatacagtggggaataatagatattggagattcagaaacataggagggtggcagaggatgagggatgagaaattacttaatgggtacaatgtaccttattaggtgatagttacactaaaagcccagacttcactacacaatatatccatgtaaaaatgcacttatatcctttaaattgaacaaattaaaaaactaaagaaagagaagtcttatgccaaaagcttgattgtaataaattcagtgatttttgtacagactatttcctgtaaatgcatgtgttggagggattgttgcaaccctagcaggcagtttgttaaagacctggagccagagtttctgttgtatcaactttcacatgcatcaactcatgagtgctgatatttctccatatacttattttaatttattttatttatttatttattttgagacagagtctcactctgttgccaggctggagtgcagtggcgtaatctcggctcactgcaacctccgcctcccggattcaagtgattctcctgcctcagcctcctgtgtagctgagattacaggcatgcgccaccacgcccggctaatttttgtatttttagtagagatggagtttcaccatgttggccaggatggtctcaatctcttgaccttgtgatccacccgccttggcctcccaaactgctgggattacaggtgtgagccaccacgcacggcccgtatacttattaaaaacagaaaatattgatttttaatatgttaaatgttggtttccaaaaaatagagcagtttaaccatcttcatagctttactaatacaaagcaaaaagaaatttcaatgcaaatggaacggtattgatttgactatgaatcttcactcttctaatcaagcattcttttaaaaattctaaagacttagagagtatgtcttatggttaatgttttgtcttctccttccttttgttctcagtgattagcacataatatatactcaataatgttttctcagtaagggaacccatcaatctcatgaataaatatatctctctgacgtttttcccctaattgacaattacctgaacttttgggtgtaggaatcttccctttatttttttccttgacactgacatattaaatttctgatcaaggcttctatttctataactagctttgatactctgccccagatctctagggtcagactcttccagaggcagctgtcaagtgctgccaatagcactggaaaggaagataataattcaaatcccaattctgcatctactagtggcatggcattgaacaatttgcttcatccctttggacctcagttttctcatctgcacaatgtaaagaaaaaactttgtggttcttaactagaagtgctcaccaaaatcatctatggacctctattaaacatacacaagccaagattcatacaaagagattctgattcagtaggtccacagggaggaggagagcaagaaaatgtctgtttttctaaaatgatccataaatttcacagtctgtagtttcagaaattccaggaattctcaatcatttatttgcaagaatttattaaagatatggtgtgttctttttattttaaatcctctggaagaaatacactagatgtttcaacattgacttaattcattttaattattccattaatcatcaattttaatggtcaatttaattattaacaaatgagttcgaattcctttggtttctgcctatagttaatcaagttctagaggcaagaaagtaatatagaatattttaggcagttgatctcaactgtgaaaataactagctttcaagaattgactaatgctagagaggatagctctgtggctgacaatactgaggttactttacatggggctagatttatacctaattatggagtagatcaagctcatctctggtgctttttattcccttcaacaccctcatcctgggaatcatgtgggcatacagtattttaggattttttttggtatcctgtgaaactttccccatctttttatacttgtattctttcaatgtgttaaggttctaatacactaattgatccccagatagtattgttacctctccacatcttcatttctttacccctaaactgtaagatattgcttaaattttaaaagagaacttcaagacaatgattatcttcttttaagacttgattcaaatattgcttcttctgtgaagtcttccctaacttgcccaggcaaaacaaggttttactttccctaggctgtatttgcattttattttatgttgtacaaattatctgttgacatggatttctcactggactctacatctcttaatggtaaaggcattgcctttttacctctatatctgcattttctgccataaaccttgacatagacagttttaaaaaatgcttattgaacacatgaatgggtggaaaatgtcagaatttcaaaaaatgtttaaaagctgtcttaaaccttcaggcaaccttagaaaggggatctttggaatcctctcaaatgaagcatattactgaatttgtaccctacctacaaacctatactagactcaactctgtccctagcctgtaatgtccattcaataaaatcttgtcactttattttattttagaaagcttatcctatctacaataggagtgttattttaaaatctgaagagaaaagaaaaagagaaactggttaggagacttttgctcaaatgggaagcaattaagattgaaactagattggtgtcagtgggagaataagaaaaggacccacttggtaagcacttactgctgggccctgtgagtcgagcaattgatggtatgccatctttttgagaaaccttctaactacaagttatcattggtaatcagtctgttaagcaagtctgtcaccaaaagagagatctgatattcaaattgcatttagtgtttcaaaaaacagagtgcaggcagattttcttcatataaactacttttttttaggcatctgaaattaatgaattgcaaaattcaaataacatgttttatacaatttgaataaaaatgtgctaagagaaactgagttatacgtattagtcaattaacaagctgcttctcatttgccatgtagtttttataacactttagaacatttctttctcagtatttgttatcatttatagaataattttaatccccaaaataggcatattagacattttatagcatatgttttcatagaatattcatttataaatttctagatactggttaatctataatagggtgtttactgattactatataatatctactattcaataattgtgtatgtgatggtatatatattacatactggcaattatttatagaagagacattttacatagtatatatatggaatgcacagacatgtgtatttaagccttgttacttgctatctcatatttgaattttccactagaatataagttttgaaatgactttattttctaatctctaatagcaagatataagaaaatctggctgtccttagatactgtatatatgtactttacagccatagaattttagttgcagcatgcagggtatgtatttaccatgtaaactgtatagttaaaataatttacagatggtcagataaataaatagaaagaatattaaacaatgtgtttgcatttagattatcatttttaatgtttccactatacaggaacagataagcagagaatggcatggatctttatagttaaatagcatggatttgtgaaaaaccactttagtgaagtgaaaaagtatatttccacagacattattaagaggtgagaatttctcaaagccacattgtaacatagtgaccataacatatgacacttctcagtgtcatcatgttatattggaatgtaaaatattattgcaagaaagataataaaaatggcatcaaaattagctaccttaacagcttctctttttcaatctcttagtcttcctagatgaactcctggcttggcagaaatctctgaattctgctcgttccatgttcatgaatactaataatgtacctcgaaatatgatcccttaacatgaattaattctgcttcccaggatatatttttatttttcacatttcacaaagatttatgagaaataattgtttggcatttatcggcatccatgttccactaattaacatccttgtatatccatggggaagaatagacagaatctaacaatccacttcctttatcttttaacaacgtgtttgtttctgtttggagactgttaattagtttaaccttagactctttaaaagcattttatttcttttttaattcacaagttactgagaaaaagcatagagcaactgattcaaattaagaacaaagcattatctcatatatttcttataagggaggaattaattgaaaaataatctcatcgtggagagagggaaatatccagctggaggagaggaggtgataagtcactgtattttcttatgtttcatcagacttctttcccctctaaggggcaagttagaggcttattctaataagctcttaactgtagccagtttattcaagtttaagctctcagcttcatcatatattggcttttcaatcttaagcaagccaattaggatggtggcagaggagtgtagaggttatatagattcatttggtcatttgtttcctttggtcagccaggcactttgctttatgtagttcatctcatttaatctttgtaaagattattatttttactgttcatcaaagtaggcatgattaactttgctatattctagaaaatggaaacccagtgatattaaacaaccaagttaatgactggtaaagataataaacatacacttgggcaatttggggaaagaaataaaataatatatgtactttgaaaacaaggcagcattaaagacatgtaagatatgacatcatatagggacattcaatcaagatgaactgagaccaggtataatgcagttaatatgtcaaaaaaaaaaagttgaggagattcttcaggaatatggttgccagatttagcaaataaaaatatcaaatatctgttaaatttgaattttagaaaactagttaatttagcataaatatatcccatgcaatcttagggatagctgatactaaacaaatgtgtttcttaaacctgatatttgaatttaattgtgtgtcttgtattttatctaactgccctactcagggactttcctttataagaaataaaggctagagaggcctctactactgaggacaggaactgggaaagctgttacagtaggacctctgtgctttgattatgcatctaatatgatgactttcattattggagattaggccccaagtatgagaaagactgaagagtaaaatggtttggaaaaactgcagcctagattagcaagtttgagataatggaagggtgctatgtatggcagtaacactgagatccataaaagccagtaataattaggtttggatagctgagtaaagctttggttaaaaaaacttgggctggctcttgaaaaatgagtatatgaagaggaataaaagaggattagtctctggtggcattagtaaaaataaaacatgggaatgagtccttttcaaatatcaattctgtacaaacatctgtagctacacaaatattacatgaagaaacagctgagaaaaaagtaaatgctcatatataagattagcaaggtatggtggggcccagcaagacagggattaaattaggaagagagtagatactgaagatcggtcagggagctgttagagtaagcatcctgaagaaggcataaacaggcagaatgaatcctgttcgttgctcctacaaacatgcagcataggaggaagggaaacagcttttactgagaagctgtatttgtgtcagtcattgatattttatcatattaaatattcaaagttaaattaattgtgaagtataaatatgtatgtcagtatgaagatgaccaatgccaaccaggatcattgaataaaaaagagttttgtttaatctatttattgccatctatgtccaaagaggaagtcaatattggcagatagtctccttgtgctcaaagagttcaaaaaactatgtcacaacttaagagaaacagaactggaattaggaaatctggttgtgctattaacaagttaacagagtttattcatctgtaaaacgggaacaagactatctcagagaaaaagtataaagattctattagataagttttgggcaaagattatctcagctctaatattctaagttccctcctatggaaaagccattattctagaaacacctttttttgttttttttccattctcaagatgctatgccttaacaacactggggggtggatcacttagaaggacaacaattcaagtattcaaatacgtgtttccagcaggacagagactaagctggtgcctttgaggacaaataacagaagattttttttggaaaacattctgaacacattttgatagactttgtgacagtttggagaaaaaagatacagagcattaaaagcgggatatgaaatctaaaatataaggaaacaaggactttgggaatctgaaccaggaaacagaaactcagtttgaatattttataacaaagacctgttgtagaatccacagtattctctactattctgtgctgtagaaaaattatgaccctgggttcttttagatacagaaagaagaaaatattccagcaggtctctcttagaagtagagaagaacatttgctttttggtctgatatcagccttagagcatttttgcagattgggctcactctgtagaatgaaagtagaatgaattctcaaaattagggagaacggtctctataatttaatacctataggacaaactatatgtatgacaagatgagaagtaatgatacaaaattatgtactgttttatgtattaagtgagatatcttacataaagcataccacaggcacacaatatatggtgatttccttccctctccaatcacaccctgccccttccagatccaatgcatatcctcttccaggggtaccatgcgccaacttacccagagctcagtggtacaaatttacagcacctatcagtgataacagccagaaatgacatactcttcccaaaaaaggcttttctctgcagcgtagagggtagaattaggtcagttatgtaagactcatattaaacgagtacactttgggccactttggtgatattgttaatgtttctgccttcaagtggttacaaaaggaaggtgaagttaatttcccttgcttcggaagttctgttttataagtctgaagggtacaatattgaaatgataacctacattcaatattaaccatttgctgccaaagtaaatactatatttcgataatttcataaatatccaagagaaattgtcccaatattcacatatattgaagttagctcatcaggaaaagtcattttagtgatgaggctctgaagaggcccccaaaaattgagataattatagtgatacgtcaactgcaaaaaccatatttgtgagagatgctcagttatgtctgaataagaatcttagaattatagaatgttccaactggagaggatcttgtctaacacatttatcatagagataaagcaattaagacctggaaatgttaaattatttgcttaggattgcccaagaaatggaagagatggttctgaaccaggtcttttgacttaatttttttctaatgcatttgttatagagataaagcaactaagacaaggagatgttatttgttctgcattgttcagtaagtggaagagacaaaaatatttttcaatcaacaaactcttactgttgatgttaatatggctgacactgcctctctgccttaaagtgtattacaataaaatgcaaagacacctatgaaaacctttcatcataaaagacgaaatttcatttttttcccaaaacccaggttttaacacagaaaactttgagctccaagaattaaaatactctttttgaagctagaatactaaacatccaattttgcatgtagggaaatagaaacaaatattttaaatgttttgaacatagttttcacagctagaaaattacttaaaaaaaggcctctcaatctctgtctatgcttgtttcattcatattttatagcttttctcacctgaattctggtaaatccttatctttctgtcttacctccctatcactcatcctgaatttcatatatttatatttgatttttgttttaactccggggaagattagtatttatctcattttaatattttctctttgtgcatttcagtacattgctttagtattctaatgtcctccaaaatttagatttcttgcaaaagaaactgctgattcttaccaggtttgtatcacaaataaatcttttaaataccgtcttttagtcttccaacaagttgctgacattttattcatgtttgtatccctgtgacttgcaggtagggggtactaaatgctgtctgctaagtgcatgaatgattaatggaacagcacaaaggggagcaccccaggctggggattttttagttctctcactaggtttgccaagatgtttcaatcagtattccttgagtaccacttcagagtcagcctgagtgtgacttattctaccaccatctactttacttcaattttctataactcatttaaaaaaagaatgccaatgaaaattctgtcatatgcttgaaacattttggggctcatgttagtggaatgacttctagttttcccagcttcttccagtgcaagttttctaaacatatctcaaaaagccccagttttatatcacaacagtttcatgagaaagtgaaacagtttcatgagaaagtgaaacagactatgaaccttttgtactgatccatagtatctctagaaattaagcaaagtagatacacagatgagtatgcatatatttttacatataacatataaagattcatataaaatgttgaatcatctggagaatttcaggcttgggtaggaatatacaatactgaataaagtggctcataacgttttataaaagaaatattatctttttatttcatctcatttgactccacctatatatcctaaaaatttttacaataatactttccctgattaaccattaattcaaaagataaaaaaaaacaagacttagccttctaaattccagttgcttattggatgtaatagtacttttaattactaaatgattccaaaattaatactattggactctgacttctgaccataatgttttaacagaaatcagatataccatcctatgtgaaacaattaaaaaactggacaagatatacaaaacaatagttttcaagaaatacaatattgaacaatgtaggagagtaatccctgagaaatgagaaacaaacaagatgaaccctacaattgccctagcccatagccacaagggaatttccaggccattgcaacaggagtctgaggacacaaaggcttctaacatctacaagatagaggactagagaagaggactctgacaatccacagagggccttttttgggtatttagcaaataatttatcagtacctgaatgtgagttagccattacagcctgcaaaacatacagtctgaaagtattgaatcgaacagtactcaggatacacagaagacctggaatagtgcctgtacccataaatctaagtaggaagtcttataattcacagacacagtagaatactcagaagactattgcctctgcagtggagaatatttctatatatatactaaacacagctgtagtcctacctaacaaattataaaatagtagcagtaaagaacaagctgcttccaactaactgaactgcatcccagaacaaaattgaagagatttataaagataaaaagaatacaacaatcacaaaagtaaaatttacaatatctgaattgcaatttaaacaagctatcaggcatacagaatagtgggaaaaaaacaaccaataatgaaaaaaaataacaagtaattgaaactttcccagaattgaaataaacattaccatggatcaaagtgtcaattcattaagtagtagaataatcctaatcatgtaagcacctaataataggtctgtaaaatacataaagcaaaaatgaatgaaactgtaaaaataaaaagaattcacaagcacagtcataatttaaatgtccctctctcaataacttgacaaaacaagtcaactgaaaaataagaatatagtagacttgaacaacccatcactcaacaagggctaactgaaatttatagaatattccaccaaacaatggcagcatatacattattttcaaggacacacaaaacacttaccaatatggaccatattctaagccataaatcaagctttaataaatttaaaacaattcaagtcatacaaagtatacttttgaccacaatagaattaaattatatatcagtaccagaaggatatctgaaaaatcttcaatatttgggaactaaataaaacatttataataactcatgtgtcaaggacaaaaatcaaaatgaaaatcagaagatattttgaagtatatacaaataaaacacaacatattaaaatttgtgagttatcaatttagggcattatatgctatattagaaaagaaagaaggttcttaattgagtttgtgttgctataacagaataccagagactgggtagtttataaagcaaaaagcttaatttggcccataattttgatgtatagaaggttcaagattggtcatctgcatctggtcagagtctcaggctgatttcacttattgtggaaaataacagaagggaagcttgtatgtgcagagatcacaaggtgatagaggaaacaaagaaagaggcgaggtgttagcctctttttaacaaccactgcttgtgggaactaacagagtgagaactcactcatctctgacagtgggcattaatctattcatgaggaatcggttcccatacccacatacctgtcattaggccccacctccaacattgaaatcaaatttcaacattaaatgtttgggggacaagcatgcaaaccagagaaaaacgtcacaaatcagaggcttcagcccctgccttaagaaattggaaacagaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcgatggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaagaaattggaaacaggctgggtgcagtggctcatgcctgtaatcccagcactctgggaggcctaggcaggtggatcatgagattaggaatttgagaccagcctggccaacatagtgaagccccatctctactaaaaatacaaaaattagccagacatggtggcacgtgcctgtagtcccagctactcaggaggctaaggcaggagaattacttgaacctgggaggcagaggttgtggtgagccgagatcatgccactgcactccagcgtgggcaacagagcaagactccatctcaaaaaaaaaaaaaaaagaaaagaaaagaaaaagaaattggaaacagaacaaatgaagataaaaataagcagaaaatagcaaataaaaatcaaagcaaaaaatcaatgaaagagaacacagaaaaacaatttaaaaaatcagtgaatcaaaaaagctagttatttgagaaaaatcaataaaactgataaatctctatccagattggtccaaaaaaaaaaaaaaaggaaagaaaaggcacgaataaccaatatgagtttttagagaagttatattgctacaaattatataatattaaatggatcataaaaaaacagtgtaaacaattttatgcccacaattttgacaatttaaataaaatagaaaagttccttcataattaattctggaagaaacagataactctaacagatctatctatctgtctgtcggtctgtctatctatctacataaatttgaaaaatcaatgtgtacctttttaccaaacaaatgaacaagcaaaaaacttcaaattttattgttgagtttattttaataatttgagattggtttattaaatacataattaaactaaagaaccaaaatatcactccatgaagagaacaaaatttggctcatatagttgattagtggtaaaatatcttcaaattggtttggaattttttagtagaaacacatatggatattttacacaaataattttggatacgtttgcttattttgccactgtttacacgtaaacagtacataaaatgctcttttgatttaggaaattctaatattagataccacagaatttaaatttctctttttttttctattgattatttttccaccagacttctttgtttgaacttgtggacctatccaattttcagctgtacttgatacaattcccaaaccctgaaaaattattttccagtttcatgtcatcatgtgatatcaactcaaaaagtgttaatatttaaccatacttaaatttttgcattgatttctaatttctttgactaatgtttataaaaataccatcaactagtgtaaggtatttttattacctaccaaccaatcaacatacaaaaattcaaaatcactctgaatgtgttagaaaacaaactgaatgctccttgagggaaatataataacactgagttatttattaaattattggatgctaacattgtggtagccaggtactaagtcctttaaatatcttttctgtttcctacaaaaatgtgagattaatttataataatcattatgcataagaaaaatgaggtttaaataaattaagtaacttggctgagatctcatgctgataatccacagtgttaagaactgaacgagctctgttaaactttgaagtctatatttttagccaacatgttacactgcttccctaagtctgtttctttcatttctatagtcattgtaacttagaagcagtaagtactcacagaatgcttattacatgctgagaaagttgattgctaacattttcattacttaaactaatctaaacctcagttcctttttggtatgaaaagatagtttataaaatataaacataaaaaactataaatctacctctattataaaaaaagaaaaaataaaaatgaatgaactggctaaaggatctatgaaagcttgatttttataatgccttggaggacagatgaaattttatatgtcttagttgggacaccacatttggtttacttgccaccattattgctggctttattcagcaatatgttgtatcatgattatgacagaaaaataatcagcctgtgacattcctcaaatgcctccattctgtacaaaagtattacccaacctgtatcttaaaactatatacatgatgatatgctgacttttggctccataaaaataagaaaaattattttattcagtaaacttggagaagcagaatgatgaatacatcttcaagatgtgaataagtcatgttctttctagtagcaagattagatttataaatgtaggactgctttgatacttgtataattttcttattatttttaaacacttattacatagaaattattgctttgcaagtgatagtagaccaatatatttattatatttgcagaaggcattattcatgcctgtcattcaaattattattctgaaagtagctctaataaagtagttcatttgcacaacaaagctgactaataaacatatgtctctaaatcacagtttatataaatattcaatgaaatcagcagaagacactaaaagtaaatgcagatttcaattttatgcaaagggaaattaaaaaaagacagcattattgtatagactcaaaaagttgttatggttggacagaacccccaaagtcattgaatccattaattgaatctattatgagagtttacatttgtccttgataaatttcaactttctagaatatgtccagtttttccatcagaaaggatttttttccttccaattcttattctataattagtcacattggtttaaacttccagctctaggtgaaggacaaatttcaaaagcaacattttcaagacttcatacaaatcactaacaagaatgcttccaaagagagagaggcagtcctaatagagtggaaagagcataggtcttggaatcaaaataaataggtttgaggcttgatgccataatttctgagcttatgaccttggccacatcacataacactgtgaactccagctttctcctctgaagcagagaaaatgtatcaaaatatgaagatactttatcaactgaaaatgactatatacatttacatatttgtctagattgtgcagtagatatgctactgaagaatatttttcagttgctattaataaacattatttaaataatgaatcagtctaaattaacatgtagctattaattcatctaaactcacatatttatataaccttagacaataactgcacagatttttcccagatatcttgctaagtttgttatctcaatagtcattttttgaaacaaaaatgaaagaattcatgttgttaatggcaatagcatgatttgtcattaattcttgttaaaaatgaaaataagtttactttttcttaaatcatctttagcaaatatttgtgggttactgtggctcacttaattcctttttaaggacttcgtcttagttaattttgtgttgctataacagaatacctgaaaatgggtggtttaataagaacacagatttgtttcttacagttctggaggctgggcagtccaaggttcaaggacccatatctggcaagcactttcttgctgctttatcccatgttggcagacaaaaaggcgagcaaatatgtgtgcgagagagaaaggaaaggggctgaactcatcttttttactagaagcccactcctgccataagtaacccatttccattataatataattaatctattcatgagctcaaagcccttatgacctaatcacctcttaaagtcctccctctcaacactgttgtactggggattaagtttcccacacatgaactttgggggacatattcaaatcatagcagattaatttttaaaaataagccagtgtacatgcctgtaatcccagcactttgggaggccaaggcaggcagatcatgaggacaggagatcgagaccattctgggtaacacagtgaaaccccatctctactaaaaaatacaaaaaaaaaaaaattagctgggcttggtggcgcacacctgtaatccaagctactcaggagaatggtgtgaacccgggaggcagaacttgcagtgagctgagatggcatcacagcactccagcctgggcaacagagcaaaactccatctcaaaaaaaaaaaaaaaaaaagccaatataatcagtaatatcagtaatattatttttccattattgctattctttctcgagccctgtaccttttgaaataaggtgttcactggtttgctggtctttgcagagaagtattagataaaagcactttataatttgaaaaactatgatgaacctggcttttacagttattaaccctgcaatcttgggcaaatagctttgcctctcagagcactgaattgctaactgatagaaatgcagaaaacattttttaatttgttaatttgtgatgaaaattaaaggaaataatgtatacaaaatatttcgtaaatgtctaactccaaatgttacctctctatgtcttgttttgttatcatctcactttcctctgtgaaacagaatgaagtatttctaagtgtgtcctttggaggcatggattcctaaacatataatacaagtagaaaatacagtgagcactaaaaaatagtttttctaaaatttgcataagcgaacaaaagcacaaaaattattcctgatgaaagtgattttctttaggggcactggaaaatatagcctcatacaaggaaagaaaaattatttttattctgatgtataagacatcatttcagaaatatatacaaatggagggtgttgcctacagatacacatcactgaagccaggaagtttttaagccaaggtaacaatcaatgacctcagttgaattcccgaaagggctctacatcagtgttaaaatggccatagataagaagataattaactatctgtcctgagaatctatttgaaagagctgttctaagtttctgagagcaaaccattaaaaacagaaaagtgaaagcagagaatttgggcttattccattcactggcctcctgttttctattaaaagggttgatcgtaactcccttattttttgttctctgcatctttgaacacttgcttgaggggccaaaaaaaaaaaaaaaaaagaaaaaagaaaaaaaaaaaagcagggggcataaagtaggaggaggaagggtcatagttccaaaatatttccagaccatccccagacaaagagcagctcaggtttcgatgtcaccttcctccatgatttgtaagccatatccttagtttctctgttccttctccaatactactttgctttcaatcctgagcagttcttctctggactattgcaatgataggtcatttgatattcccaagctctagtctgattttcattttgattcacttccatattactcctggagtgatcctttcgatacaaaatttgctcctgaattccccctgcttgaaatcttctataattctactgctttcaggataaagtttagtctggaaaataaatcacttcaaattttgaacctatgtttccagagtcttctctagccacaaaaaattaaaacttgaaaaacacccttaactcatgaacaccatgaactcatttgtccctgttagatgagagacaagagctaggccctcaatacattcttggtgaagaatgaattattgaatactggagttcccaatttcctacttacattttatcatgaagcggcttatgcttaattctttttgatgactctttcatggaaaatcatttcagtggaagtttttatacattattttttgaattgagaagagatgattactttcccagattattgtttagatcaaatcgtttaagtgacttcatataccacatattttgtgagcaactgccaagtgccagacactgagaatacaatggtaaagaaatagatataatatatgtcctctggaatttatatcttagttggaaagagaattaattaaatgaataatttctgtacaggatgacgcatactttgatattgacctattgtgttatagccactgtgctatacatagttgagcttatgatcttgccaataagagatatatagataaaaatgccgaataatatttaatcacaaattacataaaggcaatgattttaagatgcaggataataagcaatcatgcaaaagaggtgaagttattttaggtagcaagggaagacttcactgaggaagtgacatctacactgatatttgatggatgagtaggaattagctgagctaaaactgtaagaagatcattccaattaaaagaatagcatgtgcaaatacggaggcagagaagagcttggcatattttaagaactcaaacaaattcagttcagctgataaaagatgtgaaagtgtggcagcacacagggctggaatacaattatcttcttaagaatattgactcttccggttcctgaatgtggtacatctttccctttaagtctttatttcttctcggtgacattgcttgccaaacttttcaacctttcaatccatattctttctctctctctttctctctctccttccctcccttcctccttctctccctccccttttgtcgcccaatttctctctggaaatttgaggtatcttttctttctctccagttttttgaagtgtgactaaaacgcagctcaatagttttcaaccatccaggaattaaaagggtaatttcaatcttgaaattcatgttcttcagttctgaggatttttcttaaaacatgattttaataatttattcaattcattttctctattcttttgcaagtttttcttattctaatgctgggaaatcccagagcagttctccagttttcttgtgttttctctcctctattctattcctttgcctttttgttttacatttttagatatttcctcgatttgtttcttcatacccttctattagatgttttatttgttacatatgctttcattttaagaccttattatattcctttgtggaatataataatgtaaatattatttataattacattatttataataatgtaaataatgtaaaatgcttcctttgtggaagcatttcctgccacttttaaggatgctgtatattttgttttgtgtttaaggatattattattagttctttaactttccacctccctgaagagtttctatatccttcagtattttaagtttactggttttgtgctctgtcttcagtgttagaagttttcctcagatgtactagtgatgtgaaatggtctcttcataattaatgttaggggatttcaaaaaaaaaaagactagagactgtgtctgtgagtgggacctgtctattgtagattttacatcaggaagtactactgactaggatgctctctggctgatcacccatgttgagctggtttcatgggtctcagggaaggagatactcccactttcctgcatagagagaaacttctggctacctgcattctaggatcccaactggagaagagaacttgggctatcaacatttagtttgtaaaagttttcttatttccacatttcagtatagtgccttgcctctcacctgatgttgggaccttcaatccagagatcctctttttcaccctgtactctggatacgtttcaactctttggctaactagataggattctggggatgcttattgcttaaacaaactttttattattcttgcttcttttggtcctacgatcattccatcttccagaagtaactgctatcacagatttccgagcttttggaaggttctatactgcatattggtttactccttggctgagaatttggctttctttgtaatttagttactacttgtccattttaaaatttgtgttgctatcatctcttcttgcattccttcggtctttgtaagatttaagggcaatgtttctttattctatttggaagcattaagaaaaaaaaaccctgaaattaaatgtcagtgttcaatctgctgtcagtattggaagttgttctgattggcttttgtggacttcacagaattttctggtggcgggggagaaggactgaggatattagcagtcttcgatgaacatacaaggaactaccagagctagattacatggaaagattcttttattccttggaatcgctatatgaattgctctcctccccaccatcctgtacacaagcactgtggcttatttagaaagctgtaaatcagtagcctccaactttactggcaccagggaccagtttcatggaagacaatttttccacaggacagtggggcggggcaggggggtggtttcagggcaaaactgttccacctcagattattaggcattacattctcataagtagtatgcaacctagatttcttgcatctagagttaataataggggttttacgctcctatgagaatctaatgctaccactgatctgacaggagtcacagttcaagtagaatgctcacttgcccactgctcacttcctgctgtgttgcctggttcctaacaggccacagacctgtactggcccttggcctggcggttggggacccctgctctaaataatttaccagtacctacatatggatatgtgtgtgtgtgtagacgggtatgcatatgtatatggcaaactgaggtttcttaactaccatcatcttttatgagtcatatttcatattgcatgttcattttcagagtaacatatactacatgcatagtcatatttataaatctaaacatgttttaattttagatatataacacagatgagttaatatttatgagctcatgtgaaaacttcactaagcacgaagtttgcaactaagtaccctgcacatttcttagtgccttggtctgccgtgttttcttttttttagtttttcatgtgcaagtctttatttttattacctatctgatggctatttaacttatgctaaggatcatctcagttatttcagttaacaggataaaatcaactacactggatcctgaacttttttttttttgagttaaggtttgttattttcttaagtactgctgaattttttctttgttgatgtatattgtttttgtgaacacccctcaaataagattgaaacagttttgctatttcatccatattatcagttgccttcagtttttcctctaggggtactatatttacattagcccaatctgctcagaaataccagagacagtctttactttccttacttgccactctaccatcttcattatattgagaaatgagttatgtcttaaatcagcaaatcaacattttctatgacttttatcaagatgagggaatagatatttgacatacagtgtgggtgtctcttgtaaaagaaattgacaacacaaatcacaagtgggatgcaactaatgctagagagctgctttatgttttaaatatgaataaatctctcaaaatatgaaagtggaaagacaagctggactcaaatgattacagcttttagaattaaaataaattagggcaaatactggctctaaccacaagagagattatcactgtttgcctatttctgaaggaaccctcaaggaaattaaggtggcttgggttttagtgcaaataacactacatgttttctttaatatttccatttctccttaattcatttcacctgttaacacaaggcatgcccaaacattactctaaacattaaccaaactccatgttctaagtaagaaataaaatgcattatatttttttggacagtcactgggttatgtaggaagaagtaattatttttatataaaagaaaatgatgaatctcactctaggtgttaagctggtgttaagaggtgttttcttctagaataatatccttaaaggtatatgaacaaatgcgggaggtcttgaatggtagttcgcagagaccattatgatgtcaaaataatgtaaggccaacagagtattgacagttcaattttcagttttagcaatttttaagcaaaacaaattaccataaattactgtcatctaatacaagaaagagtattttacttaccaaaataaaaaagatggtttcttcattgtacttaccaaaattaagtattaaatatttagtacatatttgctgtttttcttagaccctaagttctgtaggaattagtgatgaaaaataatttttaaaataaaggccattatcaactacaaatacacagacacacatgtatgtacaaataattatatatataattattttatttatttatttttcttttattttggacctttgaaaatttcattaaagccttccaagggccaatggaccagcatctggtagccactagtccaatgggtattaggtaactgatgtccgttttccaccatctggacatattgtcactggtgactgtcatatatgtactggacaagaaggattaaatggcataatgcccataaaaagcattttgtaatctttaaagcactaaataaatataaggaattagtactgttatggttatgatattgcctcagaatgcatggtaacaaattctaacctgaaaaaaaatccctttatctacttaaaaatcacaagactatgtagacttttaggaataaaattttcccataggagtggtaatcaccaactttttcaattgttttgctacataatccagcctgctatagaaacttcaaaaatggaaaagtggaagtgtcaggctataacaatctcttgagatgtcatattaaatgtaaatacatcttgaaagtttcttggcatatcattagagcaagattctactgtaggaagcaagaggtttatttgtaatggagtattttttttaaacagcaccgtcttctctggctaaataagcaatttgtacaaatgacaaatgtgtttattttgcttgagaaatgaggacatctgaacgccagttatttacaaacctctatgtaaataacttcaaatgcaagacctatgtaagtaatttaatcaatgtgctaagggcagtgccattcacctctcctgtaattgcatcaccctcacctactgacctcatctggcactactccacatcagcaatgttacattttcctcccttaatcttccagcacacttcatctttctggatgtctagtcacacatccttacatgcatactcatatttcacagagatttctagacctcatatttcatggagatttctagatcttttagtttttagttttctacaaatatgttatgctcttcttgctatgtaaactttgctttaggacaaatgaagagtcagctagttcccctgcttacgccattttcatttcaccctaacactctttgaacagctgactgtgcttattttgtaccagaacataaaactactcacttggttggttgtttgaatcctgctgcttcttccagacctgctattttgatctcagatgattccaggattctaaatgagaaactttaaaaaatcctatctgctaaaatatggattaaggtttcttcagcttatttatttcattaggtgcttattttgtaccaggtattctttatagtgacataggatagagcagtaaacaaaatccctttcctcatggagcttaccttctagcatagactagagagacaataaaccaaataaataagaaattttgtagcaaatgtgctacatgttataaggcaatacatattattgacaaaaataaagtgggtggggggtaaagactatcaatggtagggtatgtttcatgtttaaatgtgatggtcagagatgtttcagtgagaaggtaacatctgagtgaagattttacgtgacaaatctattgatgttgatatctgggggaaggttgtttcaggcaaagagaacagtaagtgcaaaagccctgaggtggaagtgagactaggaacagcaagaagaccactgtggctaaagtgaattgggacaggggaggagcaacaggacatggatgagaaaggcagaagaggtatgtgttaatctggtaacatagtgtaagactgtgggttttactgtaaataaatggcaagtaaattagatggattgttagaggagaaaaaagataaactcgtatactttagttaccatctaaaccagaatccagatataattgttttgtgttccttgagatataggtaattgtacattcacaacttaggatcctaattctcatccaatcttatttgttctaatttgggcatatatatatttttctttaaagtgtttacttggaactggagatatgaggacccaggatcatgacaggacaatataagaagaagaaaataagtaaattgataaagacaaaaatataaaatgttatttctaaatagtaaaataacaaaccaatcccataaaaagtaaagaaaaggatacttgttatcacaattattatacaccagtgattaaaaaattttagtgaatgtaataaatcaagaaaatagtatcattagtataaggattggagataaattgactcagatactttgtgttaataaaattattgtgcatgtttaaaatccaaaacttctggagaaaactacaaatattaaataagaattttgaattatacaaacattaagtggcttttctcattattagcaacaattagttggaaatcaaaaatatactaacgaaattacaaagggtggtaataattcaagaaaacacaaaatatttataaagcaatctgtctttatggcagaatgtaaaaataggaattaaatgtcttctcttttttattagaatatttaatatcattaaaatttcagccctctaaatattaatatttaaaaacttaattttataattagaaaaaaatcttaaaaaattcttaaagaccaacaatatttaagagaaaaacaaaattagtatacgaaaactaaaaataattagagtggcatgacttacaagtattaagtataatagaaaaacaatgtaatcaaaacactatgttggcatgcttggtggctcatgcctataattccaacgctttgggaggacaaggcaggcagatcatttgaggccaggagtctgagaccagcctggccaatgtggcaaaaccctgtctctactaaaaatacaaaatttggtgggtcgcggaagcacatgcctataatcccagctgctagggaggctgaggcgagagaattgcttgaatctgggaggtggaggtttcagtgagctgagattgtgctactgcactccaacctgggcaacagagtgagacttggtctcaaaaacaaacaaacaaacatccacctactatgctgctacaaaagaaagataaataaaacaatagtaccaaagagagtatctaaaatgatataatagtatacagaaaatatataatttaaaatatgtataattctaatgaaatatgaagaagtgttgttatttcaatgggaaagaattctttatttactaaatcatgcaggcacatctgatcatctatctcaaggacctcgcaatgcaccaattttaatttaaaaaattgtagttggattaaatgaataaagatacaaaacaagaaaacaaaactttgccagttttcagagaaattttttggatcaaaaagaggagtgaagaagctataaaataacttttaaatatgtatttgattatgtacaagcaaaaaacggcaaatttagcataatcaatatcctagaaccaaagtatatattgaggggaaatctgtatgtcaatgattataaagccaaagagaaatgtgaggaagagaatgtccatattcacattggttacctggggagaaagtaagaagagacaggaagaagggagaggagaaggtagacaaaaggaaaaacaaacaaacaaacaaaaccacaaaaaccaaaagagataatggaaagaagaaaacaaaacaaataatggaaaaataaaaaatatatatgcactagcataatgtctacttatattaatgctacatgttaaaaaggatgaatggacatattgcaaagcatcaaagaggaaaaggcaaatgaaaacaaagatttgatttggggattggattttggaaagtattcttctgacattctgttatagcaatatagtaaaaatatatttaaataaaatatatttaaaatatatttaaaataaaagtgagagagagaggcttcaaaatggctgactgaaggtatctggtacttgcctcctccgcaaaacaaaaacaaaagtaaaaaatctccaagcaaatggataatcacactttgaatgtattgccttagaaagaatgctgaaattcaacagagaagtaacagaaaacacctaaggcagaaaggaaagggaagtgaggcatccttctctgccaggagccaggagagacttcccaatgtggggaaagagtaagtgagtgacccctaatggtccatatccccaccacggattcctgcaatacttgccagagccgttctacccacactggctgtgagactaacagagagagctacgtgaagacagctctgacagcatggctcaagaaagggaggtcacgctgtgtattcgtctgtttttatgctgctgataaagacatacccaagactgggcaatttacaaaaggaagaggtttaattggattttgcagttccacgtgcctggggagacctcacaatcacgaaggtaggcaaggaagagcaagtcaggtctcacatggatggcagcaggcaaagaaagagcttgtgcaggaaagctccccattatagtaaccagatctcatgagacttagcatcatgagaacagcatgggaaagacctgacccccatgattcaattaccccccaccgaggccctcccacaacacatgggaattcaagatgagttctgagtggggacacagccaaaccatatcacgctggatcctgcacacatctcaagccctaaacaactacagtgaggtaccattttgagagcccagtcaccaccagtctgtatcctgaatctccttattcctggagtaaaactgacatcccctgatcacagatggatgctgctgtcagatgctatggccaatgccaagtacaagccattggcagcaaccccaactgccacaagtagcagggccatcatgcatttaaaagtgccatgaagaaaggctatctcacttgtagccaccacttggggctaaagattgaactcccagcctcctgcctatggcttttgccactgaaagcaactccaccattcccagaagcagggccacagtgcagccgctgcctccctaaccaagcattctgccaggaatctgggcatcattcagcccatgcctaccacagccagcatcagcatgtacctatttgggacctcatgacagtcacaccccattcaagtatccctcacccagtgcctgaacatgtcacttggcatctgggagtttggcaatcgctctgccccatccaccacctctcatggtgctgaggatgagcccacccaaattgccactaccaccacagctggcatctatccacacacaccaactgtgggccagcgattgcagccactgataacaccagcttggactgcttgggatccaaaggattgttctgccactgctactcccatcaccaacacaacacccactgctcagggacctgagtatctacctacctgcccaatgcaaagctgccactaccagcacctgagcaagctgtctggaggccaaagaatcagctagcctgagcccgttaacattggtgccagtgaatgctgtgcttggtgagacccaggcacatttagcctgccattgccaccactggggcctgaggactatctcagtggatgttcctgtctccagcaaaacatcactacagacttcactaccaattgtaccataagctactaaggaaatcacagacaatactgacactgcctatacccaaagaaatcatacaaaaactacactactgcacacactcagagccaaagtgccctatccaatcaataccacagatactaatttgtagatgacatgatcttacatatctagaagaatttaaagactataccaaaaaccttttagatctaataaatttagtaaagttgcaggatgcaaaattaaaactaaaataccagtagtatttctatacaccaataatgaactggctgaggagaaaataaagaaggcaatcccaattacaatggctattaaaaaaatctataagtatacttagccaaggaagcaaaagacctttacaaagaaaactacaaaattctgatgaaagaaatttaagagaacttaattgaatatgaagacatcccgtattcatagattgaaagaattaacattgttacaatgaccatactgctcaaagcaatctacagattccatgtaattcctttaaaaataccaataatattcttcacagaaaaagaaaaaaaaatcttaaaatttatatggaatcaaaaaagagcttgaaaaaccaaagcaatcctaagtaataacaacaaagctggagacatcacactacctgactttaaaatatattacaagaatatagtgaccaaaacaatatggtatgataggaaaaatggtacatagaccaacagaacagaatagagaacccagaaataaatccatgcgttttttatccaaatgatttttggaaaagttgtcaagaatattcaatgaggaaagaacatccttttcaataaatagtgctgggagtatttgatatccatatgcagaagacagaaacaggacccctaactctcatgatatataaaaacatcttaaatggattaaagactcaaagtaagaccccaaactataaaactactaaaagaaaacatagaggaaacacttgaggacattgggctaggcaaagattttatagctaagacctaaaaaacacagacaacaaaaacaaaaataaacaaatgggattgttttaaaccaaaaagcttctgtacagtgaagaacataatcaacagagtgaagagataacctgttgaatggaagaaaatatttgcacaatgtttcatctgacaagagagtaatatttagtatatacaaggaacttaacagcttaaaaaaaaaactaactcccgctgcccccccaaaatacaaataattgcatgaaaaattgggcaaaagacatgaacagacatttctcaaagacgtataaatggccgacaggtacatgaaggaatgctccacatcaataagcaccagggaaatgtaagtcaaaaccacagtgaggtatcatcaccccagttagaatggctattattaaaaagacaaaaaataaaagatgctggccagaatgcaaagaaaagggaaagacaatattggtaaaattatacagacactatggaaaacagtataaaggtttctcaaaaaagaaaaaataaaactatcgtatgatcagcaattctaatactaggtatgtatctgaagaaaaggaaatcagtaggtcaaagagacatttgcacctccatgtttattacagcactattcacaaaagcaagatatgaaataaatctaagtatccatcaatggattaattgttaagaaatgtggtatatgtaaacacaatgaaatactattagcgcataacaaataatgaaatcatgtcatttttagcaacatggatgaaactggtgttcattatgttaagttaaataagccaggcacagaaagacaaatattacatgttctcactcacatatgtgggaccaaaaaaaaggttttcgcatggaagtggataccagaggctgagaagggtgtgtacatgggtagggcgtaaataagagaggttggttaatgggtaaaaacaattgtacaattagatagaagaaaaacattctaatgtttgttagctgagtagactatcattaacaaaaatatattgtttgttctaaaatatctataagagagaacttgatatgttcccaacacatagaaatgataaatacgtgaggtgatggatactgtaaataccctaaccctaacatgatcattactcattctgactgtaaaaaaaaatcatgtgtaccccatacatatgtacaaatatgtatccatgacaaaagcaatttaaaaaattactttttgtaaaaaaattgccaaatatttttttaaagtaaaattaagtaagaaaacagattttggcatgtacaaaaaggtaaattgagagaatctctataaatcatcttgaagcataaagacttgtattcatgacttgctaagctattagaaaacaataaagctttaaaatattctgaactaatgactgaatgatatctaatcaatattcactttatcacctggcaagtctaataatatgaagtcagagtactgaagaaactacatctattttccctgcctttgaaaggaaataaaacctacgaaggcttcctttaaaacagcacgtgtccaagaatgtatctggtcttccttgtctcaccactttactaataatttgacttttcctaatccaagtgattgattagttgaatgcatgtttaagcctcatagaaagtgctcatttcttcagacgtgatttgcaaaggccagaaattcaccattcagtaagaaaagctatgaaatagacctgtcataaactcatggggagggtgtcctagggagtcacctctgttctccaccaggagacttttagctggcttacttgcagagaaacatatatttagtctactttttcgattttagggtgtgagaatcctgccttttacttaggctgactgagttgaagagaaccgtttttctgcctctctattactgccatttttccccccctgcagtttcagccactctaaaatatctacaatgtgttaggtatgaaaggtatgaagatttataaacctttacccacactttcaaggagcttatattctagtgtaagagggaaaagaagaaaacagaaaaataaaaatgaaaagttccagggatatttaaggggtctgtggaagtcttactggagttcaggatatcttccaaactgcctggaaatgtcttacgtgataaacctgatacataaacctgagtatataggtaaaagacagggaagtaattccagggacaaaacagtgtaggttacactgtaagctagatatgttcagagaattgtaatcattttgagatagaataggtgaagatacagcagtgggaaggtgcagaagtgtgtcaattctgatattcggctggtatgcatcagcataaattaacccattggttatgacttgcatctgttttgattggatccacatcttactagttgttacatattttaaatctcacctctgagtatcataggaagtgactggcagattttaggccatgtagtgtatgccaaattacggagtggaatatgatggcaaaggggagtcaactaagatcattttgcaaaaggatgacacaattacacttgttttacagaaaaaacaactctgaggaaactggggatgatgggatgaggaaaaaagaaaagaagcatttttaatccatgttattgatacaatttagcaaatgagaggtgtaaaaataactgtattaaaaagactaatatctatatccaaagagtacatttcttattaaacttagcacattcttttattttaggtaaaattaaatcactttgggttgaatgaggaggtagttcaaatgcattgcctgttgcaattgctttgaacattatgttccaggatgttgaagtcaaaaaaagctcctttgttctggttctcctctccactgagaatcacggcattcaagcctgtaccctcaactccaaccaacactcctaagactctccgatctcataacccatcagaagcccttaaacctcaagaaggattgaaaaaaaaagtggagtttatgtgcaaaccatgactacttttgagtaatattgaaaacttaatactgctatgtaagtaggcatattcatcttcacagatgaaaaaactctggatcaggaagcaaacctctcctgtaaagggtcagatagtaaatatttaaggatctatgggacatatgacttctattaaaactgttcaattctgctattatagccccaaagcagccatagacattatgtcaatgaatgcgactatgttccagtgaaactatcgtacaaaaatagaattcagctgatgggcctcagttaatcagtcactgtttttagtatgatttatcacaatgcctgtcaacaaatagaaatatacatatgtatatatgtgtgtatataaatctgtgtgtgtgtgtatatatatgtatgatagttcacatcttctgttaattccaccaaatcatgtcaatcttctagaaaacaggccaggcgcggtggcttatgcctgtaatctcagcactttgggaagatgaggtcactggaaatcaggagtttgagaccaacgtggccaagatggcaaaagcttgtctctaataaaaaatatacaaaaattagctgggcatggtggtgcatgtctgtaatcacagctacttgggaggctaaggatggagaatcgcttgaactcaggagacagagactgcagtgacttgacataccgccactgcactccagcttgggtgatagagtgagtgagattctgtctcaaaacaaaaaacaaaaaacaaaaacaaacaaaaacaaacaaacaaaaaaacaaatctagaaaacaataaagagcaaatgtttttgactggaattcagcacagaataatattcagtttgcctttgtttctctgtagatgtttacacacatttataaagcaacttcaaacttttctgtttactaaaaactaaagtttcatcaaaaagtttagtttcctgagaaaatggaagtgcagtttgaatagtccatctaattattaaattttcttgattacagaaagtgtaattgctcctggtttgttaatcttattttttttaaaaaagaaacattttcagaatcacctttaactctacattttcctttgtttaaattatctatcttgaaaatagagaaaaacatattatcttatactgtaaggacaaaatttattactgaaattgaggattatcaaagatccagagatggttttccagaatggtttaggatacaggttatcttctaatatcctcactgccatttactgcctgtgggaccttgagcaaattagttgtctctctgtgtctcagtttcttcagctataaaatgaagttaataataatagcttacaaatagaattgctataaaaagtcaataaattaatacatgaagatcaaccacttagaacagtgcttgttaaataaagatcactctataaaaagtgattattatcaaaatgttttaaatatttatctaaacaaatgttcgcagtgtaatcaatctcaaagccaccagcgcactttgagatgcagattactttaaagcacaagctctagtattagaagagggcttcaaagtcctgggttggtttcatcctggacataggaatacttcttcatccaataacatcaaaagcccctgttcattttcagttgtcagacctacagcacctcccacgtcaactggtattatttacatttcagcttatatctagcaagcagagttgcctttaaagacataagttacgtcggccgggcgcggtggctcacgcctgtaatcccagcactttgggaggcagaggcgggtggatcacgaggtcaggagatggagaccatcctggctaacacggtgaaaccccgtttctactaaaaatacaaaaaaattagccaggcgtggtggcgggtgcctgtagtcccagctacttgggaggctgaggcaggagaatgtcgtgaacccgggaggcggagcttgcagtgagaccagatcgcgccactgcactccagcctgggtgacagagcgagactccatctcaaaaaaaaaaaaaaaaaaaaaaaaagatataagtaacgtctctgagtttcagattcttcatctataaagttaggttaatattactcacttcagaagggacttgtgagaaataaaagaaatatctcattctttacattttaataggggtgtttgaggggaacttttatgctccaggagagaaaagcatggaaagaaaacacacagcttcattccactatcttcctactatcccttctggggatagtgactcatctgtctggtgaaactggagaaggggttaagtgtgtacgactccatctcttctttttatggagcagtctgttctctgaacctgagtttttctgttgtccttctgaaagctacctattaaagcaagcaagtcctgtgattgttcagtcctgtctgtgactgtggggatggagaagaatatttggtcacagatcaaagatttggttttcatttagctaatatatactaattccatgacttcttgctggtatttaatttgaggaaagggctattatttaatgaacctttaaatccctaacagtgagaaattaatataatactttatgtgactctacagttacaaatgttaaatttggccttactttaaaaatatcttgcattatagtttaacaaaatctttctctcctcattgtttataacagatggagtaatacctttcaaaaataataaatgaaaccacttattaacagtataggtttcctggtttccaatctccactgactgtttctcaacccactgccacaccccttatgctacacacacacacacacacacacacacacacacacacatacacacacaaacttccttctccacttgcctccaaatttaggaagaaaggccatcaagtgatttttctatttctaaacttttaagctatatctgccccaacacatttttaaatttctgttctagttctgtagtacatcttctcagttggtttcctccacctggactttaaatgccaccccttcccacatttttatgcattttatactattcgtaaccctcttttcattaattaaatcacctatcctacctggataccaaaattaaccaattaaataaacaactgacctttgcatgcaagatacagatactatatatcataaaattttaaaaatctaaaaattatgaagcttggcattgtctgaagatcataaagcccaaattaaatgacaagagtaaaaatattttcaacatattccaatgagctaccttccttaatttataaagtttttagaaatcaataaggaaaaataaacaaaaaatggttttagtacatggataggtagcttttaggaaatattgacataagataatatttactatcttactcataattttaaaactacaaattaaaacattgtgatgccattttcattcataatattatcaaagtgcaaatgatttaataatgccatgagttgacacagaaatacaagtgcttttcactatacattttgttcaccacttaaactatttttcatgattataaattacatctttggagagaaataaaatgttaatgttaaaaaatctctctttacctcattttcccttaaaatatacagttgacccttgaacaatgcaggagttagatgcaacatcatgttacacagtcaaatatctatatataacttttgactctcctaaatcttaactactaatggcctactgttgacccaaatccttacaaataacataatcagttgattaacacatatttttgtatgtggtatgcattatatactgtattcttataataaagtaagcaagaggaagaaatgttatcaagaaaatcatagggaagaaaaatatatatttactattcattaagtagatgtggatcatcataaaggttttcatcctaattgtcttcatactgtaggctgatggggaagaggaagggaaggggttggtcttgctgtttcaggggtggcagtggtggaagaggcagatgaggtggaaggggaagcaggagaggcaggcacacttagtttaacttaacacatttaaggaaatgcatttttgcctttttttttcatttctctaaaaatgtttctatacagtaccaatccttcttccactgttagctttaatttcagtccctgtatcatagaaaggatcatgtcataaaagaagtcaaaagcagtcttgaataactgaaaccctcctgccagattatctaatgtcaatttgctttctgttactacttcttcaacatcatcttcctcctcatctggcactggtccaaaagcactcatctccatcaaagtcatcttctgttaattcttgtagtgtgatgtctgttagctcttgaatttctccaagatccatattctgaaaccctttacccccacctttttttttcccatacccatgatctcatgatttccttgattggctctatcataaatattgtgaagtgatacacaagatctggaaacagttttcttcagcaggaatttattgtatcaggcttgagggctttcagggctttttccataacaacaattgtatcttcagtggtataatttttccagactttcatgatgttgtctctatttggatcctcttcaaccagttgatgatcctttccatagagtactgtgtgtaatgagcctttatggtccttatgacccctaatctagaggctgaattagagactttgtgtctggaggcaagtagatactttccatgttgaactcatgaggttctgggcggtaagaggcattgctcaatagcaaaggaactttataaggtagtccttcctagccaggtacttcatgaattcagggacaaagtgccgatggaaacaatcaaggaaaatagctctaaatgtccaggtcttcttcttgtacaaccaaaagactggtagctgatgtttatcttttcccttcaatgctagaagattagcaactgtgtagataagaaaagtcatgatcataataaacctgactgtattgtcaaaaaacaggagggttagcttactccttcctgccttaaatcctagagctcacttctattctttactaataaatgttctttgtggtatttttctgtacagaatagaggactttgacacacattaaaaacctgttacagcaaatattccttctcctcagtggttttcttaatggtgtcttggaacttgtctgctgcttcttgggcaacagaagctgtttttctcattatcttgacaatttttaagccaaatatctttgtaaaattatcaaaccatcctttgctaacactaaattctccagctttagatccttcaccttccttttgagtaagtcatcctttaatgactttgctttttcttgaataatattagactctaaatgtatgcctttcttatacccaatcatacacctacataaaagctgcattttcaaaattacagaaaaaggtatttccccagaagagcaaggttttcacatctgctggtgtagccacagggatggcttcatacgtttccttttctttcgttatgttggtctttccttatgctggatttgtttatcttgaaatgaagggcatctgcagctgcagaccggaatccacagtacatattaagcaactcaactttttcttgtgatatcatgacttttctcttcttcttgggagcagtttcagcatcactactgacacttttgttcccatggtgttatttaaggttcacagtattgcaaaagacatgataaaaaaatgtgcaataatcaggaacaatcacttttcactgtaatgcatgatttagtggtgaaatgcacagttcacagggagatgattagcctcatactgtgatttaagcagatactcataatacttgagatcattgcaatatcaataggaggtggctttgaaattacttcagtagtacaacatgtactgcagttaattttatgcagttatgatttaatagtaaatctttgttttctcttaatcaggaatggctcacaagtgtgcacaaaagttttgataaattttaacttcttataatagattggtgtagattttatggtagtaaatgataaaatagtatatgtaaatattacattcatttatcacacatattttcttatttttaaaaaaatattcctagtcaacatggtttgtgtgtgagtttgtccaaattattgcaaatctcaaaaataaatttcaacctatcaactgaaaaaaatatgtaaatggagacctgcacagttcaaactcatgttgttcaagggtgaactgtagatttcattcttcattccttattagttcaacttcccaaaatactggcttatatgtcatgggttcatttactcaccatctactcacttcttagctacttcattgttaatctgcttttattactctattcagccatgtcttgttaaattgccaattctctccacctcaataaatccaaatggccatttcagtgttattttcacttgatctcctaaattcagttgacactggtggtcttgcctgtaaatactctcttccattggcttggatgacacaacactcttggtttcccatcaacatctctggatttgcctgttcctgtctccaatttagagttcatctttttttttcaacctaaatgctgaggtccctcaaagataatttcttagaattcctctcttaattttaacaaacacgtccttgatttgctattatcctgatgagtctctcaattctatttacagcctatatatctcttctgagctctcaacttacatattctcctacctagtagactactttatctttgaaatgtacctgaactccacttatccaaaactgaactcatgatctgctctttacttcatatctgacatttcccaaagacctcagtaaaggtactatcattcctattgttaacttttatcccacattacaaattaatgacactgaatagcccagtagaagaaaattatggacatgcctttttattgcacttgattttattgtaactccacagatattgcattttttacaaattgaaggtttgtggcaactctgtcctacacatctgttggcactatttttccaatggcatggtctcattttgtgtaattttgttaattctcacaatatttcaaactttttcattattattatatctgttatggtgatctgtaatcagcgatctttttcgcttatattattatttcaatttacatgataattgtacacatttatggcatacagtgtgatatttccataaatgtatacaatatataaggatcaaatcagggtaataaacgtatccgtcacctcagacatttattatttctttgtgttaggaacatgctactgttgtaattggtttggggcatcacaaactgtgcctatataagaccgtaatgagggtggtatgttctgattgtcctacccactggctgtacttccgtctctctccctctcctcaggcctccctaaccctagagacacaacagtattgaaattaggctaattaatagccctacaatggctaaatgctcaagtgaaaggaagaattgtaagtctctaactttaaatcaaaagctagaaatgattatacttaatgaggaaggtaaggtggaagcaaatataggccaaaaattaggcctgttgcaaaaaacagccaagttgtgaatatagagaaatgataagaaagagaaacagccttattgctgatgtggagaaagttttcatggtcttgatagaagatcaagtcagccacaacattcttgtaaaccaaaattctaatcaagagcaagatcttaactctctttaatcctataaaggctgagagaggggaggaagttacagaagatgtgtaaagctagcagaggttatttcacgaggttgaagacaggaaactgtctctgtaacatcaaagtgctgggtgaagcagcaggtgcagactgatagagaagtttcaacaacatattttcaatgcagacaaaacagcctttttttggaagaagatgccatctaacactttctcagctagagaggagaagtcaaggccttgcttcagattgtcaaaggacagactaactcttctatgaggagataataaaactggtgacttgaagtggaagccaacaatcatttccattctgagaagactaggaaacttatgaattatgttacatgtattactgtgttccaaaaatgaaaaaaacaaagcctgggtgacaacacatctctttaaagcatggtttactgaatattttaagtctacttttcagaattactacacacacacacacacacacacacacacacacatatatatatatacaaaaatcctttcaaaatactactgctaataattgacaatgtgcccggccagccaggaggtctgatggagacatacatggagtttagtgttgtttacatgcctgctaacacaatatccattcttcagcctatgaatcaacaagtaattttgactttcatgtcttattatttctaaaatacatttcataaagccataactgtcatagatggtaatccctcagatggatatgggcaaagtaagttggaaaccttctggaaaggattcaccattctaggtgtcattaagaacattcatgagtcatgagagaaggtaaaaatatcagcaacaggagtttggaagaagtgattccaaccctcatggatgactttgagatgttccaatacttccagtcaaggaaataactgaagatgtagtgaaaagagcaggagaactagaattagaaagtgagttcaaagatgggactgaactcctacaatctcatgataaatcttaaatggatgaggaattgcttcttatagatcagcaaagaaagtggtttcttgaggcggaatatactctggtgaagttgctataagcattgttgaaatgacaacaaagaatttagaatattacctaaacttagtagataaagcagtgatagaatttgaaaggactgactccaattttaagagcagttctaacgcgggtaaaatgccatcaaacaacatttcatgctacagataaataccacttccttttgtgaaaggaagactcatttgatgtggcaaacttcattgttgtcttattttaagaaattgccacagccactgccaccttcagcaattgccaccctaatcagtcagcagccatcaacattgaggcaagaccctcaactagcaaaaagaatctaacccactgaaggctcagatgatcacttgctttttttttttagcaataaagtatatttgaattaagatttatatatttttagacataattctattgtgcacttattaggctacagtacagtataaacataacttttttttttttttttttttttttttttgagacagagtctcgctctgtcgcccaggctgcaggacagtggcgcaatctgagttcactgcaacctctgcctcccgggtttgcgccattctcctgcctcagcctccagagtagctgggactacaggcgcacgccgcgacacccggctacttttttgtatttttagtagagacggggtttcaccgtgttagccaggatggtcttgatctcctgacttcatgatccacccgcctctgcctcccaaagtgctgggattacaggcatgaaccaccgcgcccccccccactttttatatgaattgggaaaacaaaacatttgtgtgatttttattgtgatactgttttattgtggtggtctgaaatcaaacgcacattttctccaaggaatgcctgtatacttgtttgaaaatgactgaatttggaatagacattcttgctacatgtaaagataaagaataatatctacctctggggaatagccactatcatagtttgactagaaaaactgtaatttcattggcaaggatatttcttacagtaagttcttatcatttccattttgaaaaatattgatgtagattgacctctaagaaatgcttcttataatcctcaagtacttttgaaatttaagtacatttcctttttgtggctttgtaataatcatcgtagtaaagaatattctcaaattattcaaataaagttaattatagatcaaatgaaactatcttttcagttgttaatttgctaaaaactagttgtttccaagtcttatttaaatttctaacttttaaataatgtatttcaagtaattctttcccagatctagaacaagacagtgtattcattctagaaaataagccccttaagaaatgccattactgttcagattattgatctcagcctgctgtcagagccaaagtgtttagcaagactatttcagggacctgaacaggatatttttattggcaatgagacagcagattacccacagctcaaatggaaagacctagtggtgaggtgtgtatcattctaacattctattgatgtgcagcacagatggtgagatgtgctgatggatgaggttgtctcagcagcagagttgtcttagtcctgccaagcacttaagttgaacgacctattaaacatggttgacctaaggcagttggagatatttataagtaactacagctattaaatgtggaccttctagtaggctctaaatatagcctttttttttttccacatagctttgacttctagttcctaaagccattcattcaagttgaattggggaagagaaggagcaaaaagagagattttcagaatatctgtaaacaaaataacactagaatactgaaagaagttatagcgtgaactaaataaaaattttcaggaggtagcactgatataaaatactaattaaaattaaaaatttgaattatctaaaattttaaaaaaataaactcaggttctatgtagaacctagggtttgctatcaaataataacttcccctctgtttctactctacagaagacaagttagtagaaaagtacactggattataagttatggtagttgggtaattgtgtcatccaaattttggaggtatcagtttcctcatttgtaaaattagagttagtagatgtaaactttttcttacaaactattaacttttgcttttctgttccatttcacacatcaatatttattgagtcttacttagaactcctgtgtataaaatagaatagtacttaatatttaggttgttcttagatatgggttttttcataacacttatatgaccttctatctaacttatctgtaagtatcataagggcaataattattgtttttttgctcattgatttatttcaagcacttttacatatagtaaacactcaacatttgtcaaataatgattaaatgaaacaatacatgtaaagtgcttagcacagtaattggcacaaagtatttgataaatggtcctataaatggttctgataagtggttttattaacacccacagtgccatctcactaagatagttggaagaagttaggatatttcaaagagaagttggagagtactgaggaccacactgttgttcccaaatatttgaaagagcatcacgttacttttaaagaaaaaaaaacatgggccaagaggcagaaactgcagggagacagttttaaaatttggagtaaggaagacctaacaaaactgctcaaaaatgaaatgaactgatgttcaagtaaatgtcaaattactaaatagccagttaatgtggggataaaaaaaatctaactagaggctataaatttagtattccatgaattaaatgatatggaaagaactctatgtttatcatatacaaaatagattttaaaatacccaaaatataaaattttgcaatgcttctggaaataaaatcatacatggaaaatggcaaatattataaaagccaatctatttacttagtgtacatgggatcaaagaacatttgctttttggcaaatacaccatatgactgaaaacaaatgctgctgatttttcttattaatgctggcaaatggagcagataggaatcgtggaattctttattccctatcagaaaaacagaactacttaaagctagattttttttcttttctgttatttttactgcagtggtaacactgcacttcagaatacagtataagaatattggcagttggcatgtttgtgggttgtatgaaactaactggtacatcattcctgccaactagcgacgattttgacaaaatatatgacattgataaaaaaggaatctcactcaatatcatttttattgaaggatgtgtggcctcataccaaaatagccccatcaatctattgccatcagatcggacagaaaagaattgggtacataaaatggctgtcataaaatgtatcccagctggagctaagtctgatcacagacggtcagttaagcatttggaaaatgaaggaagtacatttcccttaataagccatcaaaagttaataacaagtgacttggctctctatttggggcagaaatcctgagaaagatgcagtggattctaaggtttttgctgttctttacactggctacgtgttaataaaaagatatatggtacataatgttttaaaggtatgcaatgaagaagcagcttccctaccacttataagttccagtgttaccatctcagaagtgcacctcattcacacattcaaaactacgatgttgtcttactaattatgatagttaattttatgtgtctagtgcctgggctatgagtgcccagacattttaacagacattaatctgcctgtgtctgtgagagtgttctggatgaaattaacatttgaagcagtagactgagtaaagcagattgccctctctaatatggatggacttcaaacaatcaactgaagacctgaatagtattaaaaggctaagaggtaatgttttttgcctgatagcatgagatggacatcggtctttttcagtcttcagacttggactgaaacattggctcatcttgaattgcaagcctaccaactttcagactgcaaattaatattatcaactttcatagttctaagacctttggacttggattgaaactacatattggctctcttgggtctttaatcacatgaaccaattccttgtagtaaatatcatatgtgtatatatatatatacacacacacatatgtatatacacacacacacaaatttatacatacacatatatatgtgtgcaggacacatatatgcatattttttattatatatgtatatacttttggttttatttctctggagaatttgactaatacactgattcagccacaacaacagggaatgtgctgagttgtgtcaatcaagtgaattatccagataattaaagtcaatctctgtagaagctggtattttggtatcttgtctagaaacaatgtaggtcaccaggcacctacatttttgtgatataaaataacaagccaattttctaatgctttaaaaatgtgctctgaaagcaatccctcattttcaaacccaaaattctatgattcaacattataaaccaagctcatgtagtcattctcaaaatcagctttaaaagcaactatgagtttgagtcatgtttactttccaagtgaattactcaagcatataaaaatccatttcattaccttacagtcatggtttttaggacttaaagatgcatcatcttcatttgttgattcctgttactattaatcagcacatggcggatctacttattttccatgattttctccaggcacaggtgcgttatgaaatttaagctctatttccactgcacagattaagctttgaaagaattttttatcatacactaaaagctacccttcagtgctgccaaattcctggtattaactccatgtaaattttcttattatcactcacctgcccagaagcagaaattctcccgctagacccaggcgcctcatggccatcagcagacctctcaccgtcatgccctcacagaagcaggccaccacccgggccttgggcaagtgacttgtgagcttcttcagcagcttatcaaagctctgctcccctgcattactgtagattttgtaagagtgggcgatgcaaatcccttccttcgctgacatatctttgaaggcttccatcccactttctccatagttgcctgtgtgaaaacatagataagcagagggatagtgaaatgagagtgttgcattaattgggtataatcagaatgcaggtgttaggagcatgaaagtcattggtatgggacttgcaacctgaagacctgaattttggtttttgctcttttgccgaattgcttattttgggcaaattacaattgaaccacattatatatgcattgatcatttatattttcactgtgatggagagaataatataaaaagtgtaagcaattcatcatccttttatgactcaaaatagctcttattctaaatatgagctgatggaaatatttatctgctatttttttgcattctatctcacttccctttacttctcattaatgacaatttcatcccactgagatttttgtatttaaagatatagtacatataagtaatacatgtagtttatatagtatagatgttgccatataaatattttataaagtattatattatatataatattcagtatattatatacttataatcatgagaatttatggtttggtcttaattgaaaaactgagatccttgcttaagatttagtcttgtcgcaggtgaatgtgtaaacttatgaaaaacatttacagttttatcctatacaaccatggggaagttattgataaggaaaaaaagttcaaagtcttttgcaaaatttggggactaaggacaaatgttagtctttaaaaattaatgaaaaggggattaatattgacagtcagctatatgccaggacacaaggacctttatatatgtgatctaatttagcactcacaataaaatattgatgtagctattatgggctccattcaatacatagatcagaaaacagagcagttaggtccatatttaccttgagttacactagcagtaagtggagggctgaactcattcacagatctaatagcataggttctgctccctctacttgtctaaggctgactcttgggagtctcagaattctaattacatccgcatttctctttcccatttcagagtgacaattctccaattttagatatttttggaacattttaaggctctatattttatacagggctcatattctgaattttcaaaatattagatatataagggggattgctttgaagaatacaagaggctattacaagataaccaagctgtagaacatataaggatgtgactgacttaaaaatcaacttgacctaggaactggaatctcatcaggaggagtagatatcaaattaataaggagcactgtgggcattcagttgcatagggttcactacatgtctataactgcaataaatacaactccacaacaatttgattttgggaaagtcagtttatatatgttagctcactgctccttacaacaactctgtgataaaggttaatgttctcttcccttggctgataaaactgaagttcaaatacagatagtaggtgtcaggatcttagtttgaacacaaatctctgattcctgtcctgatgtgggtgctaccataccacaggtaccttgctgcaaatgaaatctgttaactttgagggtggattttggtgaagttttatctccatgaacaaactgcaaagggcagagcagagcaggtcagcttgaatctcagccaaaaatactggtgggccagctgcatcttttccctccttctccagaattaaaagcaacaagaagcctctgtcatgatggcaggtgggcaatctagttattttgcaattaacaaagtttaaagggcactttctgaaaaatgtgccaaagggcctaaattaccagttttacactaatgtgagtaatctattattctttcatttatttttagctaactctgtttttcaacagactgtcttgcatttcatgttttgatttaaggcagaggcatttgcataaataatttgaaattaggtaagtgattgtgatgtgaatttatcgagaatttcacatcatttatttacttttattctcaatacattcactgttaaacaagaaaagacatctaaaaaattcagattatttagcattttgttcctaacagctttaacactgtttatgtttatataatatgttgtagagaagcagcttgaaatagtggagagaactttgttattagagaaacctgagttcaacttcaatttatatagtctttttaatctcagctttctgaagtaacactgcttaatatccagatattttaatattatatttaatgtatgtaaactatctggtaggtcacctgaacccaattaattgaacctactgaaattataaagaatattctagacagagtttagctactctttactggagcatccaaaacaaaacagtggagaaaatggcactattactgtacactagactaaaaaattaagcttacactagcagaataaagtattattttcccagagcaaatcccaagctgtactctttaaaattaaaaaaggcagggggtatatgaaaaattttcactcaattttgcagtgaatcaaaaactgctctaagaaagaaagtttacttgaaacatttaaataagaaacagttttaacacatgtgtgacataaaaattttacagaatataattttgatttaacaaaagaaatcctttgtaagctgggagacaaagagaatatgtcttccaataaaatggaaaagactgaagtgttgagactttctggtagttgatagaaacactgtattctataattatacattttaaaataatgaaaaaatgcagcaaaaaaaagtctacaggcttctcaaataaaaatagaacacatttcaagtaatatgtagaatgaggaaaaagctaaggaagtaactattactttttccaatagagggaaacaagtaactgagaaagaaagctgtggtataaaatatgaaactaacatgtgacttcattttaaataaatagaagtaagacagaatccatagaacgttcttctttaggtagcagagggtttacaacttggaattatgtggagaaaatgtaatcatagcccaatgtcttcactcgtagctcacgctacttacaggtataacgatgcaaatgtcaatcattgattttcaaccttaagaatccacctatagacaaatggaaaaactcattatgcaataaaatatatttgttatcaacttttacaatgacaattaaagagaaagatgatgaagtctgagaggtagatgcagggaaagttgttgggaagaggaaggccattaaagtcactcactcccaatttggaagtcaagatatacagaaaataaaatgtatgtgattaagggaattatttgatgctaaaataatcaggaggcagctaatgtagtgagataattatattaaaagaaggaataagaagatgtacaaggtaagagataatgtctatagtcatttaaaagtagttactttttaaaaagacatattcatattagagatatggaggtgaaaataaaaggatgaaaaactaaaacactttttttcactttaagctctgctgtactatttgacttttgaaaatatgaaaatatacatttaataaaaaaataaactagcatacttaaaagtcattgaaaggagagagttgatgcagataatttttaaagtaattgtcttctctctgctttatcattttatcctgttttagggataaaattcacagaagttctttatatgctactcttggtggaaatgtaaattagtacacccattaatagaaaacttcacggaagttcctcaacaaaactaaaaacagaattatcatatgataatcacccctacccctggctacctttccagctaattttaactgcactctcatgttcatggcagcattatttacaaaagccaagttatatccatcaacagataaatgaattaaaaaatgtggtgtatatatatatatatatatacacaatgaaatactagtcagcctaaaaaccctaaaaaatgggtttaaaaagaaaaatttctgccatttgcaacatcagcatattattcatttttgtaccgctaatgggacctgttagataactaacacatgttgaataaagaaataaattattgaatgagcagtacaaaataatcaatgtctatttccagattaaaataattgcccaactatgtgaccagcaatcaggattgccatattgtgtctagggggcgtcactctaataagctattataaaatatttcacttaaaacatgaacagagttgcacaataatcaaaatatttaccctgaggaccccagttttttcctcagatcgtaacagattttaataattcaacctcaaatactgtttaaagctagtgctttcactaatactatttgacctgaatttcatcagctgggatctggaagtatctgcctacattgaccctataaagcacacattggaaacaggatttgttaaagagtaactataaaactttcttctgtaacagagactggggaccccaaaagggaagaggtcaggaagggagtaagggttgaaaaattatttattgggtacaatgttcacatctggctgatgggtacactacaagcctcaaatccaacaaagggcaatatacccatgtaacaaacctgcacatgaacaccctggatataaaataaaattaaattaaattaaattataaaataaaaaactttctgctaacctaggaaaaatgttttatttgaactgtatattaaaaggcaccaaatcatactttagtaagtaatttgtaatcataggtaaatgctatttcagatggtacaaattcaatatcattaacaactgtgttacattggccactttaagataaagataataaagtataacagcatagacaaggtgtacctagtgagattttcatttttctggcaaaatagccattaaatatattgtttcaatttatcaatctcgtgtggtagggaaaactatcattagaatcaaaaccaaactattataataatagtaaagatacaagtaattttgttttctttgatacttttctttttttcatagtatctttacttctctttccataaatcagaccctgattcactgcatagaagcttgtatactattttatctatcatctcttatttttcattttcccaaaccctaccaaccactattttttgtttggtactttttactattctctttcatatgtatcacagacaccccacatattctcatttatttatttttactaatgctgttctttctacatggaatacatttttccatgttgtacaaattcaattccctagattcctttaggctggagactacatcttctccatagttccattatttaattacggtatttgtataatctctgtaatttgtaattgctaaaaaagtttataattgtggatccttcacctttataacaaggctgattatactcatgatttatttgatgctgaaaacttggttaaaaatataaacaacgatgctgaattttttcttaggaaacatagctcactttaaataatgtgttttatcatgggatttctaaaatgcctcagagtcaggaaatgagttaaggtactaagtattataataaattaaaatagatttctgtattatatatgttgcctattgcatatattcattatattttggatgtatttacatatccttcttttcaaaactgtgagcccatagagggtagttaatgctttatttaactacatatcatcacatggtaggtacttacgtatttcttgtacagaaaagtagtacagaaaaataggcaaaaaaaattttggaagagtaaatacatttttctaagcagaacaccaagcagatgctaaaagaatgtggaaaatactttttcagaaagtattcacttcaggaaatactaaatctttgcaaagaaaaggaataagtgtaaccttctacaatagaactttattttccatcttagttggtccaaattatcttttcctcacaaggaaattaagattcccaatataaacaattattttaaagtatatttcaagtggctttaactactaatatcctgttgctactgtaaacacagttcattttactgacaactactagtgaagtaaaattttctttccttatgtccttattctatgagctttttactatttaatgttgttgtttttgtttttcttactttttaaacttttttcttaaaagtaaagacacaaacaaacatattaacctaggcctacacaggccaggattgtcaatatcactgcctttcacgtccacttccacatattgcccactggaaggcctttaggggcaataacatgcatgaagctgtcatcccctatgataacaatgccttcttctggaatacctcctgaaagatctgcctgaagctaatttatggtgaattttttaaatgtatataagtagaaaaagtacactctaaaataatgataaaaatatagtatagttaatacataaatcagtaacatggtcatttatcattgttatcaagtatgatgtcctgtatataattgtatgtgcggtatctttgtacaacggacatcacagtaggtttgtttacatttgcatcaccacaaacacatgtgtaatacattctgctatgacatgatgatagctatgacatcactagatgagaggaagtttttagatccatatataatcttatgggaccactgtggcatatgcagtctgtcattaactaaaacatcattatatggcatgtaacttttaatttgttaaaatttgcaagtagggaatgagctaacaacaaagactgattgtgtaacacgcatactgatctttttcactccaatggtctttttcatatctgtatgtgtatagatgatacttaagttgtgcatagtttttcatgattttgaacactgttacaagaaacaaatttcctccatttttgattgttttcatttccataaagtaaaatcctgaaataaaaatgaaatttcttggtcaaaatttgaaatattggtcaaacagtgtaactatttagtattttagcaaacttgctctccaacaagttcccaccaatttatactttgattagaagcatatgagaatgcctgtttctccataccttcaccattactggttattgtcatgttattaaatttttgtcaccatattgcttgaataaatgagagttgttttaattttcaaaaaaataaaaaataaaactcagtcatctctcatgtgagttgtgacattagtctggcatgatatcatcccctaaatatacatataagcagtgtccagtctccacttcgtgtcctttaatgtgaattagaagtgttcatcaagagatcttagcccaaactgcccatattgacagggttgtggcttaaactagtgattaaccaaaatggccaggagtgggaaaagcttgacagtgaagcacctcttcttattttattaacagtttcataaagatgttcttttgtttgatgccatttttcccactacagccatatgtgcaatggatgtggcattctaaactctgtattacactcatttgtttatatttatctcctgttactagacagtgtcctttaatgcagatatttctttcacaacaaaacattgtatatacttatttttatgcaaataaagaaggaagttaaatgatgcaagaaatgtgtatacatatttttatggaaagaaagaaggaagttaaatgatccaagaaatattcctaaaaattcctatataattgagatttaggtgtttaggaacctggacatatgattaatgtgaaagttttaaagccaaaggactggaataaaaagttatcattatcatgcaccttcatcaaggtacctgaattataaatgtcatggatacgaaaactttgttaacaaacagttttccaagttttgaacaatggcccaattatttctcatcctgccctggagtctttctataacacgacccatataccacagcattaagcataaggcatggcattattgaatctcatccaaggtgtttattattggaagtaccagaaggatctcatttagaaaatttgctttagttattactctaggaatggattatgtcgtaacatttgatgaactcttcaacagtaaattaagcagaaaacaaattgctagtataattatgtaacaaatgtagataagttataagtttataactatgcatcgccccactcgtggattttaaactatatgtataaaacattatttaaaggaatactaaccagggctactgaatattgccataaaagtacatgccaagtggtttgctgagtggtatgctgagttggtgaattttcttctggctatcaagtatggagttagagaaagaagtttgatcttaagagcaaaggtacatgttgaccaaataaatttagatatggtagaaaacaggaaatcagattatttaaagaagaatacgtgacagttttaactgccatacatgttgaggacaacaagtttgagtgtcatatttggtttggtagattcctgagccctggaatcgaaagttgattctcaacatgtatctactccctccagcaactctagttcatataactgggttgaatgaactgatacaaacataattgaaagaaaaccaaatttggaaagaaatttttaaatttctgtgaaatagccaagtagaaatgccaagtaggaaattaaataagaacattctggctaagagaatagaagtctgaattggaactatttgggagtcctcagtatatggatagcaacaataatagataaaagtgtaggaagtgaaggaaagagagctctgagttataccctaaagaattcaaatatgtgtgcattaactgagaaggaatagctcacaaagacaatgaagaagaagagaaaccaagataatatattcttatggaaatcaggaaaagaaactgtttttacactcttttttttaaaacactctgttgaaaactaaagtaagatgtgtagtgaaaaaaatccactaattctggcaacatagtagaagatatataggagtaggcttgtgtgaatgggagtaaaaaaagtgaagacaatatatttatacaacttttttgagacacttggcactgaacaagagctaagagtatggtggtgattagaagagaatctggaaactcaagaagttttctttgctcatattaagaaggggttattttaggtaaagtacttagcccagagcatggaacagagtaagcactgaatacaggatttttttataatcatcatcatcaccatcctcaacatttatctagatcctgtaaaattatttggtaaaaggttaataataatatgaacaaattattgcactattcactccaaatgtgttattattaaaaccaaccaacctaatgaagttgctattatttcccacatttctaaagaaggtgttgatgctgaaacaatttgccaaataattgacagctagtaaatagaagagctgaaatttcaaccctcattctgtcaaatttcaaagcccatgctctttgccctccatatattgttactcttaagacactgggtaaaaattgttcaatttagtcctgtggttcttccaaaggcctgctactaaatgtttcatttgaaactaattccaaatactactgaattgaatttgtctcagcaaacataatatttaatatataagtattttgcttaatttccaaaagattacagatgtatgtgatttagcactaaatgattcagtccccatgttgctgatagttggtgtttaaatctcagagcctttctacaaaatacacaacgcttaatcatagcttttctatggacaaagtcctgtaaaataagagggggctcttgaaaatagacataccatattatcttgtattagttacttaactacatcattgctgaagagggagaaacttcagagagaccatagaaaatgacaaaaacagtgattttggtgttaaattttttggaatattccaagcttttattattttttaaaatggtttgagatttccataatgaaaaaatcacttttttaatcttcttaaaaatattggagtcttcctcatttttttcctctggctattcttcctagaggaaaataaaaacttgagacagaagctatgacccagattcccactctaagcttccagaattcaacttctttctgctttctttgtaagctgtcaaattcacagctgaagacttcggtgcatgtctcattaaaagtaattccatttccacagaaaggagaaaactctatacggagctgtgtgtcaatgggtcgggtggatcggtgagttatttattttgcctgttttagctcactagccaccaatgatccttgattctaactggatctaatgacaatgcagaaattctcccatcaccagctgaaggcagaaaatcctctacagcgcagccaaaactcttcatgcttgacagcttttgctgaaaaaaagtcgcttctttgacagcagctccctggcctgccgctaccttctccagtttagatctgtgctgtctgggttctgttgtagccagattccctttggaaggacttggtgtctaaacaaagtactgagaggaggaactcaatttggattcagaaatgagaaggaagaattaaaatgtagtataatggctgcactgtcattgttgccaaattttgagcctcatttaagagtgggtaactatgctgtgttcaggcattagagccttggtgactttcctctataatttagacttgtgctgtccagttaatagccacttgccacattgagatgttcagtgtaaaccacaaaatacatttcaaagacttaatacaaaagaaagaatgcaaaatatcccattaatatgtggattacatgttaaaatgatagaagtttagatatattgggttaaataaaatgtattattaaatttaatatcatttatttttactttttcttaaaattataaatatagctagcattacatttctattagacagtaccactttaggcatgcaaagaaatttagatcctatacatttcagggtagaattcaaacttcttaggatatttaatggcatccaaacttttcatgatctgctgcttgactcttctctccagtctcactgcctgccttttcctgaggcacagcacatgctccagccataacaaaggatatgtagatcaaatacactaggcttttttacatctctaaatttcacacaatctctcttattcctggaatacccttctatttagctaattcctacccatccttcaagagttggctgaaagtgacagaattctctaaattaagtttttattgttgttgttgttgctttttctgagacaaggtttcacccctgtcaccaaggctggagtgcagtggtacaatcacggctcactgcagcctcaactttccaggctcaagtgatcctcccacctcagcctcccggttagctgggactacaggcacacactaccacacccagataatttttgtatttttttgtagagactaaatttctccatgttgcccaggctggtcttgaactcctgggctcaagcaatcccaggaggctttgggaagcctcagcctcccagagtgagtgctgggattacaggcatgagctaccacacctggcccacagttctaaacagatatcttccactgtgctgtcattgctcaactcccctccaatgtcataggatattgtttatgttttattgtaattacatatttgtcttactccataaaagactgtgagacagttaaacaaaggggttaattaccctctttatctcaagggcctaggcaacctaagtatttgttgaataaataaattttagaaaatgagcagcaatttttcataagtaaattactgagcatccactatgaatcattgtgtatagcagcttctgttactgaagctactctgcattcattgtgatataaaagcactaaactgggctaagataagatatattatcaaggacagcacagcttagtcacaagtgccctcgacagagtgaggagacagtgattgaaaatctatttgtttgatttatcacttacatggtttttgggaaatggcttaccttttttatgtaaatttgtctcctcaattacaaaattatatgtattctaagaaaccttagagagtggatttttagacctgcttcctacattgttttgttatatatatattttttctttttgtgactagtttatttcacttagcaaactttattgttttttggggaaatatagtcattttcataaaaacattatttatgttaacatgcagagtaaatgaataacaaacacttaaaaatcctcagttttaaattcaaatagaataaatgtcaatagatatatccactgcatatttctatggtgccaatagttgcattactctaattataaaatttaatgtttgtctttttactatatggtgactagtgtgacaaggactgtgtagtattgatattgtatctacagggaagattttattttttcattttttttaagttctgggacacatgtgcaggatgtgcaggtttgttacataggtaaacctgtgccatgggtatttgctgcacctatcaactcatcacctaggtattaagcccagcatgcattagctatttttcctgatgctcttcctaattatcatcagagcaaacagaccatctacagaatagggaaaaatgtttacaatctatccatctgacaatggtctaatatccagagtctacatgaaacttaaataaatttacaagaaaaaaacaaccctattaaaaagtgggcaaaggccatgaacaaacacttctcaaaagaagatatttatgcagccaacaaagatatgaaaaaaagctcaacatcactgatcattagagaaatgcaaatcaaaaccacaatgagacaccaattcatgccagtcagatggtgatttttaaaaagtaaagaaataacagatgctggtgaggttgtggagaaatgggaacacgtttacactcttggtgggaatgtaaattatttcaaccattgtagaagatagtatggcaattcctcaaaggtctagagtcgaaatgtcatttgacccagcaatcccattactgagtatatacccaaaggaatataaatcattctattataaatatacaagcatgtgtatgttcattgcagcactattcacaatagtaaagacatggaatcaacccaaatgtccatcaatgatagaccagatttaaaaaaaaatgatacatatacaccatggaatattatgcagctataaaaatgaatgagatcatgtcctttgcagggacatggactaagctggaagccattatccttagcaaatgaattgggaaacagaaaaccaaacaccacatgttctcacttataagtgggagctgaatgatgagaacacatgaacacagggaggggaacaacacactcatatatattatgttgaccacatagacagtagagctgaaaatagcctaaagagcataaaaaactgtaaaatatgttaaaaggaattatgtttaattagaattgtctgatatttaacttttatttttttatagcttaattattgtttatagaatttaatttttaataatggctgtgtttaacaagagacacttaaaaatttaacatttctcttacaattgcctagatgagctggttccagcacaacactggactatgccaataaaatatcctaaaattcttctagtcaatgatctctgtcatattttcagttactccatgactttgaagggaccactgacttaactggctataatagagactccctttttataaagatccagtacaataaaggtgaacgtttaatgatgtagaatggaaaatactgtcatttctgttttgctgtactaggaaaaggtctgttcataaagtataatttaaatgtgaccctgcagaaggagttgactttggcattctagatggagtaaacagagcataggcaggttaaagtgggtagtatgtggtcaaaatccagtctgcctacagttgaggctatatgatgggagggcaagtaggctaagattacaagggggaggcccaaacttgatacataaagaggtgcaatagaagaggtttctgaaggcaggtaacatgaattaaactgcaagtaagactacactggcaataataggttaagagagtacagtggcgctccagaaggatacaatagagtattacaatgacagagtttaaaatgaacaaaggtgtattcttaggtattttattccctttgtagcaattgtgaatgggagttcactcatgatttggctctctgtttgtctattattgttgtgtaggaatgcttgtgatttttgcacattgattttgtatcttgagactttgctgaagttgcttattagcataaggagattttgggctgagatgatagggtttactaaaaatacaatcatgtcaactgcaaagagacaatttgacttcctttcttcttatgtgaatgccctttctttctttctcttggctgattaccctggccagaacttccaatactatgttaaatatggtgagagagggcatccttgtcttgtgcaggatttcaaatggaatgttgccagtttttgaccattaagtatgatattggctgtgggtttctcataaatagctctcattattttgagatactttccatcaatacctagtttattgagagtttttagcgtaaaggggtgttgaatttcatcgaaggccttttctgcatctattgagatagtcatgtggtttttgtcattggttttatttatgtgatggattacatttattgatttgcatatgttgaaccagccttacaagggatgtgagggaactcttcaaggagaactacaaaccactgctcaaacaaataagagaggacacaaataggaaaacattccatgctcatgaataagaagaatcaatactgtgaaaatggccatactgcccaaagtaatttgtagattcaatgctatccccatcaagctatagtaaccaaaacagcatggtactcatatcaaaacaaatatatatagaccaatggaacagaacagaggcctcagaaataacaccacaaatctgcaaccacctgatgtttgacaaacctgacaaaaacaagcaatggggaaaggatcccctatttaataaatggtgttgggaaaactggctagccttatgcagaaaacgaaaactggatcctttccttacaccttttacaaaaattaattcaagatggattaaagacttaaaagtaatacctaaaaccataaaaactctagaagaaaacctaggcaataccattcaggacataggcatgggcaaagacttcatgactaaaacaccaaaagcaatggcaacaaaagacaaaattgacaaatgggatctaatcaaactaaagaccttctgcacagcaaaagaaattagcatcagagtgaaaaggcaacctacagaatgggagaaaagttttgcaatctatccatctgacaaaggactaatatcgagaatctacaaggaacttaaacaaattacaagaaaaaaaaacaaccccatgaaaaagtgggtgaaggatatgaacagacatttcgcaaaagaagacatttatgcagccaacaaacatatgaaaaaaactcatcgtcactggtcgttagggtaatgcaaatcaaaaccacaatgagatgccatctcaggccagttagaatggtgatcattaaaaagtcaggaaacaacagaagctggagaggatgtggagaaataggaacacttttacactgttggtggaagtgtaaattagttcaaccattgtggaagacagtgtggcgattcctcaaggatctagaaccagaaataccatttaatccagcaatcccattactgagtatatacccaaaagattataaatcatcctactataaagacacattcacacatatgttgcagcactattcacaatatcaaagacttggaaccaatccaaatgtccatcagtgatagactggataaagaaaatgtggcacttatataccatggaatactatgcagccataaaaaaggatgagttcatgtcctttgcaggcacatggatgaagctggaaaccatcattctcagcaaactaacataggaacagaaaaccaaacactgcatgttctcgctcataaatgggagttgaacaatgagaacacatagacacagggaggggatcaccacacactggggcctgtcaggggattggggtctagggatggatagcattaggagaaatacctaatgtagatgacaggttgatggttgcagcagactaccatggcatgtgtatacctatgtaacaaacctgcacattctgcacatgtatcccagaatttagagtataataaaaaataaatacataaaaataaaagcacataaaatgaacaaaggcctgattttggatgtttaccatgaaatgaagcattgacaatatgcaaggccactttttaacataatttgttagagtttgacattctcctggaatacaaagtaaataatgatctttggaattatgctatacaatcttggcttttgttgcctttgctgttggtgctttagtcatgaagtctttgcccatgcctatgtcctgaatggtattgcctaggttttcgtctagagtttttatggttttaggtattagtttaagtctttaatccatcatgaattaatttctgtaaaaggtgtaaggaagggatccagttttagttttctgcataaggctagccagttttcccaatgccatttattaaatagggaatcctctccccattgcttgtttttgtcaggtttgtcaaagatcaggtggttgtaggtttgtggtgttatttctgaggcctctattctgttccactggtctatatatttgttttgatatgagtaccacgctgttttggttactgtagccttgtcgtatagcttaaagtcaggtggcgtgatgcctccagcgttgttctttttgcttaggattgtcttggccctacaggctcttttttggttccatatgaaatttaaagtagttttttttctaattctatgaataaagtcaatggtagcttgatggggatagcattaaatctacaaattactggcaaactgttacttcatttggggttgaatatgagaaaattcaagaagcttagtttagaggctaatgtagtaaggagtccagatgagaaacaacagtaacttgaaagaaagtgatgaaagcaaagactataccatacataggctgttcagttttaggatgttttattgcgtcttttttcataagaagtttatattaacttcttagtgtcatgtcagagcactgctggcttttgttataggccaaactgtgtcttatagaaaattcctatgttgtaatcctaaccccaagtacctcagaatgtgactgtgtttgtatacaaggtctttaaaaaggaaactaaggcaaaaaaatcatatgggtggtccctaatctagctgaatggggtccttataggaagagattaagaaatagacatgcacattatcgtgtgaagatgcaaggagaagatggcatctacaagccaaggagacagatcctcagaaggaacacagcctattgagaccttgttcttggacttccagcctctaaactataaggaaatacatttctgttgtttacgaaccactgagtctattggtttgttgttatagtatctcaagctaactaatatagtcctctgcagctgaccaaaactttcagtcacaaaaagtacccaaatccttaggctacatgaaattaattttattgtcatagagatcataatacttggaaagggcattggcctttgccatatatagactgagtttgattcctgtatccacaatttcctagatacatgaccttagacaagttatttaaatgtctctgagcttcagtttctttaatcatatcagatatagtaggccaatcaccagaccaaagtctggcacaggatagacactcaacaaaatttagtttctgtcttagctctcataatttcttcttctcagtaggcaatcataaagagctcttatgagaatggctctgaaattagatgaaatttgaacttcacttgaattaatcaaagctgatttcaaatcccggctctgacatctactagtttggatgtttgagcaagttattaatctttctaagtcttttttttctcatctataacattttcataaggtggttatgaggattaaatgcgattttgcatggaaagtgcttatatcagagcctgacatataaataaggctagagtagtattttttaatattaattacacacatttttatgagttcttattttgctactaacttcttagttgttggtgtttgtcacaactatgacacattcctgaatgaaaaccatctattctccatgtttcactaatacctatggctcctaacttatattctcagttagatacctggcaaatgttaattcaactattgccaagcattctttctagaaatttaaaactaaaactgctcattagatatgcactgagtattcagtagtttttccaaagtaacagcgtcttagtacttcttaaaaacatggtccttgtctctattgcctatgtgggcacctcacaaagcaaattggaacagatataacccctgtaatcagggatcttaatagctaaagcaccttgattggattcccctagtgttttaacaaaatcacttatggtctaattctcctgtcctcattttgctgctgatgaaatcccacgatagtaccaaagtattggcttttttcaactctgctgcactaatgtctgctgttttccttccacactaatcctttaatcatacctttgagataccagaatgtaaaaaccacttgggattacctaacacacaggaatagcaagttttgctctgaagcagatggaagcagccaatgtggctcctttttttcctttaatctcaagatatctgtaattctgcccaagcctccaggggacacttctggctaagaaaaatcctggaaatggaagtcctatctattcctatttcactgaaagggtgaatcacttttagaaacatttcaaggactcaggattacactgggtcatgagtttatgaaattgtgtaggtagctatggaaaaaaggaaataatcatggatatgctttaattttaattaaaaactcattattattgatacaaaaaatggtacctgtccagtttccaagaactccagcaatgcaatgactgttcataatcccttttcctggaaatagatccctgtttctctgtttatttgatgtgtgtacatgatccactttacttaataaattgtaaggcataaatttttaaaagtgttataataatttatattaataaagtataattttattttagatttataactcttcaacccccaacctcagttattggcttaaaggactgagatgttacctaaactgctcatcgggccttttgcttatgtttttcaaactcaagctaatagagaatcactttattccttgaaaaatatttttattctcttcaaaaatgtgagccaacagcagtcattagtcatggttccaacctcatgaagaaatgaaaagagagaacaatgcctctataaaaaagaggggaaattaataggtgtaaggaggtaaatctgtcagtataaaatccctggttatatttttttagtggcccctactatatccctgttttttcacaattacataaacaagtagattctttttgcttgattttaatttccataacttacagtgatagcatcctgtctttctaatagaagtaagaaaaaatataagggaagaaataattctagggagaggttagaactttagttaggccacaaagaacgggtagaaaagaagaaatacttcactatatgagaggatattctagatatgggacagagctttatagggagtggagtgacagatatggacataaagtatgtttttggttgtcattagatttttctgaatcatagggcccatatgggtgaacaatgggagaaagcactaaaataaagagaagtccccaagacagacagagttgcaacctagtaatacactaggcaatgcagatagtttatgtctcaagcatgaaagttatagaatgaaaataatatttaaaaatatttttctggcaaaggttcataagggtgactggaggcaaaaatggtgtgtgagagagatccattgagaagctactgaaaaaaatccaattgtgacatgacaagaactttaataggtcacagacaacagaaagcaaagaaagagttaatcataaagccacttctacaaagaaatcatggtgtttggtaccatattttgtctagggctaagtaatgcataaaaagaaagaattaagaatgatttcatagtttgtagtctgatagaccaactaacagataggatagccaggcagtagaagctgatgtttgaaagggaatcttgtgttccattgtggacacatggattaccacaaggaatctacaaaacgacattttggactcaaaaattaacctaataatggagctctcatgagaggtctgggcagtgggggatatgggtgtacgtgtaaaaatgagaggtaaagccaagaaactgagtgaagagaaagaacagagagcttacgccagagcttttgctcagaattaaataaacgattaaagggaagaaaggttgtttgaaaataataataataatagattgaatactcccactcaatacaaagaaatgctaaatgtttggatggtggatatgctaaattagtgtgatgtgaccactgtacattatatgtatgaaaacaccactatgtactccatgaatacgtacaattattattgtcagttaaaaataaaatttaaaaatgttgaaaaaatgtatcaatgacatctaacattattgagagttagagttgggtaagcttttatgcacataatctcaatgaatgttcaaaacaacccagtgagactggaatgaaatattatcctcatttcccagatgaagaaactacagcagagagattaaacaacttactcaaggtcaaataactattaaagggacacagaataagaacttaaaatcagttctaatatcaaagcttaggtatttatacacaagcctgttcaacctactgcaggaaagaaaagaggtcactggaaatagaggagacctacatgcatctaagaaagatgatgattccagaatggaaaggtgccctatagtgttaaatgccataatgcaaataaagataactaggactgaaagaaggcagcaagacatggtggttagtaacctgtagcagcactgtcttagtgaagcagtagagcataaatcagacttgagtgcaaagtttggatgaagaataggaggtaaaaagagtatttatggaatgcaaattctagtatatggaaatgaaagaaaggagagaatccatctaagccaggtaaatccacattagcaaggaagaccctagcatattaaggaagtttttattcatgtaatattttcattcttcagagttatttaaaatactgtgtgtactgaaaaggaatttataggtgttgaacaaattgctgtaatttcaaactacataacttattaaagttatttactagactcttaaatatcttgtaatcccataacaaaaaggagataataggttagaaataattataccctataaacagatgaaaaaaaaagttcaatagaattcattaacatactgaaggtcacaaaattaataaatgttaggaaaaaaaacaggctgctgaattttatcaagtactgtttccattatatcacacagaaacctgtaaatctaattatcattcaactaacagaaaaacctacatttttagtgagaaacaaaatgagatggacagagaggaacaaattaacattattaagcattgttaaggtattcctggaaatttttgtgagactaatgaaagctacatgtttcagaagatatcatattatcataaatgcacagagtaatgaaatataaaattaatcaccaaggaagaagcatattaagatgcaggaaacaaggcactaacacagtgtaataagataaattcaatcatctaaaaattataatacaaagaagtgatgcaaattagtaatcatttaaattttacattttattaaagtgagccttctaaaagataaattcattataacttaaggtgaggctgcaattatttctccttcaagacctttatatttttatatattagctattattattaagagataggcaatatttaaaaatatataaattgtgagggaggcagaagaagatggcaaatagaaagctacaaagatcttccctctcccactgcaaggaagggatgaaaaatatatttcacacaaatagaaactagaataagagattttaataaacagacctgaatcactgacaccaccccttcctcaccctggcagtgacagagagcatctctgggaatttagagagggaaaacacagcaattgtgaggtattgaataaaaaacaaggaatcaaagcatattactagaaaaaatcacttaatcacaaagaacaaatgtaaaagaagaaatgaaaaaaggatcaacaaatcaactggaaaacaagtaacaaaatgacagtagtaaccccttacctatcatttaccttatatgtaaatgaaattcttcaatcaaaataaaacagaaaggctgaatgaattaaaaaaaaaaagacccaactatatgctcatacaagaaactcatttcatctataaagatacacgaagactgaaagtgaagtaaggaatgaaaaagatattccacacaaatggaaactaaaataaagcaggagtagctatacttacattaggcaaaatagagcttaagccaaaaactgtagaaagataaagacactcacaatgataaaagagtcaatagagcaacaggatataacaaatataaatatacatgcactcaacataggagtgcctaaatatataaagaaaacattaatagacttaaagaaagagattgcactgcagtacaataatagcggtgggtttcaacaccccacttttagcaatagacagatcatccagatatagtgaaatatagtttatttacatagttaagccacactgtagaccaaataaacctaataaatgtttacagaaatattcacgtaacagcctcagaatatgtatttttctcagcagcacatggaacattctccaggatagaccatatgtgaagtaaaaaaaatactcttatcacatttaaaaatgttaaaattatatcagataacttttctaaccaaaatataataaaactaggaatcaataacatgaagaaccttgggaaatgtacaaataaatgaaaattaaacaacatgctcctgggcaactaatgagtaatgaagaaattgtgaagaaacatttttgaagaatattgatacaaatgaaaatggaaacccaacataccaaatcctatgggatgttgaaaaagaagttacaataggaaagtttatagcaaaaacacttatatcagaaatgtagaaagattccaaagaaataagcaaaagttgcatttctaaaacctagaaaaatgagaacaaaataaaccccaaactagtaacagagtgaagaaataataaagatcagagcataaacagaacatagactaaaaataaacataccacagaaatacaaaggatcattacagactcttataaacaactatacccctaacaaattagaaaacctagaataaatggataaatttatggatatgtacaacctaccaagattgaataatgaagacacagaaaaactgaacacctgaacagaccagtaatgagcaatgatattgattcagaaaggaaagttcaacactggatatattcactgccaaataattctatcaagcttttaaagaaagaaataataccaatctttctgagatgatttaaaaaaaaaggaagtacaaggaatccttgtaaattcatgcttgcatggtatttgcataaaaaacagacatatagatcaatggaacagaatagagaacccagaaataaatccatgcatttccagccaattgctttttgacaaagtatcagaacacacattagggaagggacagtctccttaataaagggtgatgataaaactggatactcatatgttgaagaatgacactataaccgtatctcttatcacttacaaaaatcaactcaaattggattaaagacttaaatgtaagacctgaaactatgagatactagaagaaaacacaggaaaaaaatgctttatgacgtggatctgaacaaaggtttttgcaataaaacctgaaaagcagaggcaacaaaataaaaagtaaacaaataagagaattatatcaaactaaaaagcttctgcacagcaaaggaaaaaatcaagagtgaagagacaacctgcagaatgggagaatatatttgcaaactatgcacctgaaaaggggttaatattaagaatatataggtatacaagggaaatattgctgttttgatttcagaccattacaataaagcaaatatcacagtaaagtgagtcacaaaattttttgcttttccagtgcatataaaagttataataccacactgtagtttatgaagtgtgctataacattaggtttaaaaaatggacatactttaattttaaaatatgctgaaacatgctaatgaatatctgtgccttcagcaaggcataatgtttttgctgatagaggatcttgtcttgatactgatggctactgattgatcagggcggtggctgctgaatgtttgggtggctgtggcaatttcttaaaataacaatgaagtctgccacatgaattgactgttttttttttttcatgaaagatttcttggtagcatataatgctgttggataacattgtgcccacagtagaactgcttttaaaattggagtcaatacactaaaaccctgctgctgctttattaactagatttaggtaattttctaaatcattctcatttcatcaaggctcacagcatctttgctgtagcagattccatctcaaaaaagcacattctttgcttatctattagaagcaacttctcatccactcaagttttaccataagattgtataaattcacattgtgaggctcaccttctaactctggttctcttactcttctaccacatctgtagttaattcttctacttgaagtcttgaacccctcaaaatcatccatgagggttggaatcaactttttccaaattcctgttaatattgatattctgacccactcccatgaatcactaatgttattaatggtaattaaaatgttgaatcctttcccagagattttcaatttactttgcatagattaatctgaagaatcacaatctgtggcagctatagcattatgaaatatatttctgaagtaataagaattgaaatccaaaatttctccctgatccatgagcttcaggatagatgttgtcttagcaggcatgaaaacaacattaatctccttataatttttcatcagagctcttgggtgcattgtcataaagcagtaatattttgaaaggaagcttttcttcttaagagtagttcttaactgtgggcttaaaatattcagcagagcattctataaacagatatgctgtcatccaggctttgctgttccatttttagagcacaggcagagtagatttagcatagctcttaagggccttggggtttttggaacaataaaagaacactggcttcaacttaaggtcaccagccgcattatctctaacaagagagtcagccgtcctttgaagccttgaagcaggcactcacctctcctctctaggatggaagtcttagatagcatcttcttccaatacaagtctgctttgtctacattgaaactgtattgtttcgtgtaaccacctttatcaattatcttatatctggatgacttgctgcaacctctacaatagtatttgctactttaccttgcacttttaggttatagagatggctactttccttacactccattaaccaaactctgctagctgcaatctttccttctgaagcttcctcaccattctcagccttgagccagttgaaaagattcaaggccttgctattaattagactttggcttaagtgaatgtggtggctggtttgatccaggccactaaaactttctctgtatctgcaataaggctatatcagattcttataatttgtgtgttcactggagtagcatttttaaatttttcttcaaaaattttttatttgcattcacaacttgactaagtggcacaaaaggcctagactggttagtgtatcggggcttttgacacaccttcctcattaagcttaatcatttctagctttcatttaaagtgagaggcatgtgactctttcttccagttgaaaatttagaggccattgtagatgattaattggcctaacttcaatattgttctgtctctgacaacagggaagccccaaggagcaggacacaaaagggagagtggcccattggtggagcagtcagaacacaaacgtttattgattaagttcaccaacatagataggcatgatttgggattccctaaacacagataaaaaatgtggtatataaacacaatggagtactactcagccataaaaaaagaatgaaatggtgttatttgtgacagcatggatgaaactggaagacattatgttaagttaaagaagtcacgcacctaaggcctaataatgcatgataccaatcataattggaatcttaacaagttgagctcattgaagtagagagtaggatagtggttaccagatgctggaaagagtagcagggaagaggggaggggagaagtcagtcaaatggaacaaaattacagttagataggaggaatgagttctggtgttttattgcacagtagtgtgactatagccaagaataaggtattatatacttcaaagtagcaagaagagatgattttgacaagtatttgaggtgaataatatgctaattaccctggtaaattagcacatgaaaatatttccatcattagacattagaagaatgcaaattagaaacaattagataatttcacacaagtattagaaagactacagtgaaaaaaagaaactaaatgctggcaaagatgtgaagcaagggcgactcatacattattggtgagaatatgaaatggtatagatatttggggaagagaaatatttatctttttcattaagcagtttattattattattattaaggcagtttatcattaagaaatataacatatcaacctggcccagtggctcatgactgtaatcccagcactttgggaggccaaagcagatgtatggatgtatggcttgggcacaggaatttgagaccagcctgggcaacatggcaaaaccctgtttctacaaaaaaaatatgaaaattagctgggcatggtggcacatgcctgtagtctcagctacttggaacttgggaggctgaggtaggaggatcacttgagccctggaagcagagattgcaatgagccaatatgctgctgctgcactttagcctaggcaacagagagactctgtggaagaaaaaaaaaaaagcagaaagaaagaaagaaagaagtaaagagggagggacagcattgggagagatatctaatgctagatgacgagttagtgggtgcagcgcaccagcatggcacatgtatacatatgtaactaacctgcacattgtgctcatgtaccctaaaacttaaagtataataataaaaaaagaaggaaagaaagagaaggaaagtaaaatataccatatgactcagcaatcttattgtaatcatccaagagaaatagcaatttatgttcacagaaaatctacacaaggtttatttatttactccaggtatataaaattgccaaatttggaaaaagcaaaaaagcacagatgttcttcgataggtgaattattaagcagaacaccatgcaccagttgccaatccctggagaagactccaaatatttctgcccattgcattttggtattgcagttatcatgggaatcacaacacagtcaagcactggatggaacaactctttattcacatagagaggaaacagagaaaaattcattctgagagtatttttcaataccccatggccagggggtctctcccagcaatgaatgcagggtaattgtccatgcacactccttgagtaccacagaaggtccctattccctccccacagtggagctggccaagtgccaagggatacacttgcttaaacagaacaaagggacatatactaggctggcaacggagaaagatattctcacacaaggcaataggccctgcacaggtggtgtgcactctttttatcttggtaagaaagtattccaggcccaaaatccattaggtggctaagtaggagaaagactgtactcatgagactgtcttttccaacatgaatgaattaacgaagtgtagttcatccatacaatggaatactcatcatcaataaagagaaacaaactagtagttcatgcaatggcttggaaaaattccaaatgtattatgctaagagaaagaaattagactcaaaaggtttcatactgtatcattccatttagggctttctggaaaagacaaaactataggaataaaaatcagatcagcaattgcagaagataaaagagactggcacaaattacgtttaggcaatttggcggaggggttgatgaaaattttctgtacctagttctggtgataaaaatgtgtatatttgtcaaaagcaataaagagagaattttttcaaaaagtggattttgttgtatataaatttagatgtcagttataggataagaaatactatggaaattgtaaataaaatataaaatgtgaggaaaaattttgtataaatatttaactgagaaggactctaaatataaatgtaataaaaggggttatgagtgcaaattgaatagattaaatagattaaaatgtaacattttcctctcttaaaaataacaaactgggaggaagtatctggtaatcacagatctgacttgtatccagaatatagaaagtaatcttagtactcaacaacaagaaaataaacaattcaattttttacattgggaaaattttaaatagagataccataaaagagcttaagtctttaagttagatattaatattatattaataattaataaaaaatggcaatgctagtagaaaaatgaataatggacaatagcaaatttcaaaagagaaatttagagtaataaataaatgtaagaaaaatacacacattaaaaaagctggtgagaaatctacctgtaaccagtctccttccctttctttattttataatgtcagccatatgtttccaagattttcatcacctttctgtatttatatgagcatatttttccttgattaatatgaaataattcctgagtaaatattttttacctgtttattttatctaactttcatctaccttggtagatgaaatgatcagtatggcaagcattatcagataatctgcttttagtactatgaggctctcagcagattgcctatagagctgaaatcacagctctttctttgcagcaaattttcagtctttattaaatattacttaatatttccattaggatggaaggtggggtgggaggaaacaaaactaaacactagccttattatagagaaatagatgcatgtatttaatgaataaaatgaataagcctttaatgaagtggtttgggtacacagggaatttctggagaaatgcttgagatttcaatatgaaagactggagaggagatggtatgagaattttgacatgagccagccaagtcttagacaagaatagaagcatcttttgctaggcatgaaatagacagcatgcaatttttggctgtttgattgccaacaaagaacgctatgaggcagggaagagagagaaaaggagcatgaaataaaggaaaaagaaggtcttaacagaaacaaaaatgtgaagagcaagcaatgcgtaaatattaggtagagcacatgaataaataaaatggaattgcaaatatgcattgaagagattatggcaataggaaaaaagtgagtaaaaactgtacattttgtatatttctctaactcatattattcattcattctaccaatatgtattagtcagctcttttgtgaataggaccccaaattggcatagttctatataagaataacatacactgaattaaccttataaaaagccttccttatatttacatttaaacaacaaccctggaatacaattctttcctcattttaaatttgaaatttctgaattactttaaagttatttctgagcaagaacttggtaggaggtctcctgaccctggtccattgtgtttcccacaaaaccatttgacttatatcatgacaagacatgtggcttcaaaaatttgttatcctatcgggaaatcttaagcaaatagaatgttttaaaggaagcaagatttactgacaaaggagaggtacgaacaattaagtgtgttgggaagtgtctagactttaaagtcttattggattgggttcaattctatttctgcacatactatttgtgtaactttacacaaattactttaacactcagtgtactgtctggggaaaaaattgcaatacctatcttatagaattgttgtgaaattaaatagttaatataggtcaagaaggacacaacactgaccctaaataaatgacaggaattatggtaaaaggtaataacattgtatattacagaagtccaggaaagcctaaatgaaggtggtgttttctttgatcccttagtaggatttatatagtcaggggaaggacattaagtgacatgtatttttcagtgtaagcttcaaatttaaaaaaaaaatattattaaaaataagactgtgttaactccatctcattttcttttaaaggaatcctcttaaaaactttaatttttaatggatttgagactttaaaagtttgagactgtcataatgattttaaacaatttctttaaaaatgttaccatgctcaaccataataggcctaaaaaaaaaaaaactgtcaccttgatttcttcaactatgatgatcaacaagagatgaacttgatggatttaataactgtagaaagttacttggcagagggcaaaagataaacatcttctgcgataaaataatgatattaaactataagatatcaaaagaatctgaaaacttaaaaagcaagttagtttggtttcagttatatggaatagcaagcaagcacgtatttattttctcttcactagaagaaaagcagtaactcttcaaaaagatgaaaccgagttcaagtataaatggagactgtagtaacaaaggatgaaaaccatgtgaactcagttctcttagacttttctagttctcatttaaatagtggccatttgttttgctcttgctaacttcagcttcaatactccaatttcctatgggagactttcaggttttgtgaaacacaaaacagaaaaaaaaatccttattgttctgtgaaaattacaaactaattatttaaaaattttgaatacaaatcatatcctacttaagaaagaatccaatggcataataagtacttatataaaactgaggctttggagttcttagaaatttttcattttctatacaaaatacaaatcagaattgatggaatgctgggcacgttggctcacacctgtaattccagcaccttgggatgccaaggtgggcagatcacttgagctcaggactttgagaccagcctggtcaacacagggaaaccccatctctactaaatatacacaattagctgggtggggtagcatctgtaatcccagctatgcaggaggctgaggaaagagaatcgcttgaacccaggaggtggaggttgccatgagctaagattctgccactgcactccagcctgaacaacagagtgacactctgaatcaaaataagtaagtaaataaataaataaataaataataaaaagaaaaatatcatgcctgtaatcccagcactttgggaggccaaggcgggtagatcacgaggtcaggagatcgagaccatcctggctaacacggtgaaaccccatctctactaaaaatacaaaaaaaaaaaaaaaattagctgggcgtggtggcatgtacctgtagtcccagctactcgggaggctggggcaggagaatggcatgaacccaggaggtggagctcgcagtgagccgagatagtgccactgcagtccggtctgggcaaaagagcgagactctgtctcaaaaaaaaaaaaaagaattgatagaatgaaattcacctctcattcagccccttgtaaaattgtgtggagactacaatttatttattatattaataaatatgtcaggctatcaatagctaataatttcaataatttcattgaattcaagatcaaacagctgatgttatgtttattattattattaattatttgtatttccatatgacaaggtttggctgtgttcccacccaaatctcaaattgtagcccaaataattcccacgtgtcatgggaaggacccagtgggaggtaactgaatcatgagggtgggtctttcccatgcttctcatgaccgtgaataagtctcacaagatctgatggttttgtaaaggggagtttccctgcctatgctctctctcctgcctgccaacacgtaagacatgactttgctcctcttatgccttctgctatgatttttgaggcctccccagccacatgcaactgtgaatccattaaacctctttcctttatagattaaccagtcttgggtatgtctttaatagcagtgtgagaacagactaatacagtaaactggtactggttgagtgaggtacttctgtaaagataccccaaaatgtggaagcaactttggaagtgactaactgggagacaatggaacagtttggatggctcagaagaggacagaaagatgtgggaaagtttggaacttcctaaagacttgttgaatggctttgaccaaaatgctgatcatgatatggacaatgaagtcccattcaggtgatctcagatgtagatgaggaacttgttgggaactaggtcactctttctatgcaaaaagactgtgggcattttgtccctgctttagagatctgtggaactttcaacttgagagagataatttggggtatctggtggaagaaatttctaagcagcaaagaattcaagaggtgacagggcataaaagtttggaaaattttcagcctgatgatgcagtaggaaagaaaaaccaattttctggggagaaattcaaaccagctgaagaaatttgcataagtaacaagaagtcaaatactaatcaccaagacagtggggaaaatgtctccagggcatatcagagaccatcatggcagtccctcccatcacaggcctggaggcttaggaggaaaaaaatggtttaatgggcagaccccagggcccacttgctgtaggcggcctcaggacatggtgccttgcatcccagctgtttcatctgcagccccaagccttggcaacttacacatggtgttgggactgtgggtgcacagaagtcaagaattgaggtttggaaacttccatatacattttaaaggatgtatggaaatgcctgagtgtccaggcagaagtttgctatggggtcagggccctcatggagaacctctgctacagcactatggaagggaaatgtgggactggaggccccacacagagtccccactagggcactgcctagtggaattgtgagaagaaggccactgtcctccagaaacccagaatggtagatacacctatagcttgcactgtatgcctggaaaagccacagatactcaatgccagctcatgacaagagctggagccctacactgcaaagtcacaggggcagagttgccccaagacataggaacccacctcttgcatcagcatgacttggatgtgagacatggagtcaagggagatcattttcgaactttaatgactgttctattggattttggacttgcatggagcctgaagcccctttgttttggccaatttcttccattttgaatgtgtatatatacccaatgcctgtaccccactgtgtctaggaagtaagtaacttgcttttgattttacaggctcataggaggaaggaacatgccttgtctcagatgagactttggactgtgggctttttagttaatgctgaaatgagttaaaccttttggggactgttgggaaagtatgattgtgttttgaaatgtgaaagggacatgagacttgggaggggtaagaggtagaatgacacagtttggctgtgtctctacccaaatcttgaatgatagctcccataattcccatgtgtcatgagagggacccagtgggaggtaactgaatgatgagggtgggtcttccctatgctattcttgcggtagtgaataaatcttatgagagctgatggttttataaaggggagttcccctgcacatgctctctctcttgcctgctgccacataagacatgactttgctcctcctctgctttccgccatgattctgaggcctccccagccatgtggatttgtgagttcattaaacctttttccttataaattacccagtcttggatatgtctttattaccagcatgagatcagactaatataccatatttgtccttaaaattgaataatatttccacatttcaaaatttccacattactgccttaactgaattactcattcctaagatctgaaaagaagccattttttaaaataatattttatttatatatgtttataaatgtttctgaatttatatatattataaaatgaggtacatcccattcttgttttatcctattttttaggctctagtttaaatcagtttaaatatataattgttatgttttagatcttccatctactgaaccacaactcaatgtgcagaaaggaaaaaaatacaaaccaagattaaatcctctgaagcatatgttttataaagacacaagtggcaactcaataaaagtattatgattattccacttaaatttcattataattagaaatccttctatagaaaaatccattgagaactttgatttttaaattacagtcatcattagtaaaatttctgaattctatagtaggtaccatgttttttttttttttttttttttttttttttttttttggtaaaccagctgtgtttgaagctgggagttaggggactttagaaaggtatttaaatagtacagtatccctccttaaaaagtttttcagctccagtaagagaaacaaattaatatataaataaggtttccacagataacctgcctttaaaacaaaccaaaccaaagaggcaatatgcagttctcataaaaaaaaatctccagtctctttgatatagaagttaaaaagaaatcacttagggagatagcaagggtttgggaatcctcagtcacactttttacctcatgaaaagcagccccaaatcatttactaacaaagagcagcctggaaagttgagctgcagaggtagacaagtgagctgagagcttgcacaggtgaatgttggcaggaactgaggactagacattttcaagatggcagctccattcttcccttctctgccagccatgtatactgtaaagagcagacgagatggtgccgatcaactggaaagcctatttgcataataagattaaggtggggtgaccagccttctctgcactctatgtaaacatcatacctgatcaaaccaatctatgagccctgtataaatcagacactgcctcctcaaactggactatatattttggtgcatttgcagccagccagtcctttccactcagagacctgtatctctatagagaaagctgtttctctttctcttctcttcggcctattaaacctttgctcgtaaacttctcatatgtgtctgtgtcctaaattttcctggtgcgtgatgacaaaccctgggtttacaccccagacatagctgctttataatgggggctcgtccgggataacaacatacaacattcatcgagatggtgagtagaggagcagactccaactctgtccttttattctgaggcccttggcttccattttagaaccagatcaaaccaaatacggggcccctttcagccatttaaaaataattagcatggctgccagccttacaagacttgggggacaggattgctagggagaacatggagcatcccccagtacccatgggtcactgggcatactggccctgtttgaaccagcttcctttcactgaggacttagctgtcatgtggggctggaagaagtcctggtgtacctgaggatttccggccagggttaccaccattgttatccaaaggtatttggacggaccccagcctctgactaccctgatgagatgtcggcaacagaatctccaactttttatcataatttcctcctttcctgtctgcgatcatcatatctatttcatcctctctgtgtatgcaatgtatgggaaattttatagttcagggaggtaatcttgtttggcaagatcagggaatgtcatagtaaccagcgatatagctcaagggaaggcatctttgtgattttcgaggaacagagggtcaccctcaccacagggagcatctctctctgcccttggtctgaaaagcacatgacatttcaaggccaacagccccacctagtggaatagggatcttttccatgaggcacatcgttggtcctttacccaaacactctagctaaccaattctctccctttttgcatccctctactagacaccatgctttatgctgcttctgttaacaggaaaactctagcttcaacaattaggattaaaatgtcttctggaaccaaatgttagttcttgatactgtcccatcagcaggaaaattgccatttagtccatacatttttaagacacctattctgcctccaattagaatggtacttaattagtaaggggattttaagtctggaagttaaccagaaccattctctaagggaaaacgctttagtacagcccataatatcaggtatagatttcagtctagcccctccattaaagagggcttgcccaactattatgtagttttttttttgagatctatttttcagggagccagacaggtcacacaagtctaggaagtcaaagggaaatcacaggcagaggacagaggactagagccacttgggtgagtgtgacaaaccccaatctctaagtgcctctgtttccatagctggcagtcatgcctgcaactatgggtggcatgttcaacaaggtgccgggacccaggaaccatggaaggaatatagcaaggggaatgcccccactgtcttcctctccactctgtcacacgaaaaggaaggagactaaagggatacttttttgtcatttctctttctagatgggtaccatattcagcctgcactcccctggagtgcattctgaagcacagggactcctcttaaccagagactttaaagaaaaagcagctcattttcttttgcacaagggcatggcctttttactagatccttgcaagcactgcaaaatgaatccagctcttttagcaatcatatcaggcaggccaaaagagaataattccccaaaatgagaaaagcaacttccaggggaaccacccgaggcagctattgtgtgtaccagcccttccagtctgccttaaccggggccacctccaaccatgccaccagttcttctacctccaccatctctaaaattttccattccatcaccttctcacttacccctacagaaaatacataattgaggtgatgccaccaggattcaagtacccttctcattgcaggacctcaggcaattaaagggagacttaggccaattttctaatgaccctgataggcatatagaagttttccagaatttaactcaggtatttgacctctcatggagggatgttatgttgctcctaagccaaaccctaactgcagctaaaacagacagctctgcaagcagcagagaatttctgaggtgagcaataggtctcctatagtaggccaaatgggaaaagagaagatagagaaagtgaagaaacaggggaaacaccattcccagcaggaagagaggcaatacctcttgaaaccctaatgggaagccccagactcttctatggtgtttttccttttttcactgttttcaatggcccttttatgatgttcattcaacctgggagaagttaatttacccaaaccttaaaatgcttggcttacagttgagctgggggagaaagaaaacccagaagcatgacatgccggcaaaaaggtaaaagtttttttttactagttgggtttttggcttctctatccctgtgcaaaccggtaaaagaaataataaggatcactatttatattttctgaaaagttttaattaatgagaaaggatttgtgaggttggccttaagttgtagacaatctggtgtgctttgtgtgtctttctgtatggttctgtccaaagaaaagttactttaggttaggatgcagacccaggaccccctaagcctgctgttcaagccagcccaacaaaatgatcagtaacaaacttggctaaaggcctccatcttgcttcttgtccttgggaacatgacctgtaaccatgtggcgaataatttgttttagtctccaccattttacaatgtttgctgacttcttatgctaagtcagtttctgggtaatggccacaaaatcagataagccagtttgtcaataagggagctgccagctgattgatcaagggcagggtttacaaaatatcttaagcactaatcttgagggctaagttaagagatggtcaaaatcttgtagcctccagctgtgtgactcctaagccatggattttaatcttgtggctagtttcttggtctagtacccaggcaagaggaaagtatattttaagaaagggctgatatcatctttgttttagagtctaaactgtaaaccaggtgcctcccaaagttggttcagcctacacccagggatggacaaggacagctcgcaggcttgaaaaaaaatagagttctttgggtcagatctctttcactgtctcagtcacaattttgcaatgacagtttcaaaagctgcttatcacccctttaaaaacaccttgtacactcactgttacatcgtaacataattaaggcttgttggtttcacctgtgaggttactttttgtaaagttcagaagctgaaaatcttaactgcttggcatagctaaagttgagtaacagtggatttaaagggattttgttaaagagtgctcagcttaattaaaactgggtattcaagtaataaatatatttaaaaggcctttatatttttctcttcttggatcttgttttctggaaaaaaatttttatttttctcagttgactaaatcatctttctccattttatttcttgacactcttaatgcatgtgtgagaggccctaagataacttctggtagtccttgggaaaaacagaggaggtgccacagaccccattgtggggaaaaaagcaaacaaacaaacaaaaaaaaccctttcttttcctcatgaaaccccaggaattaagagcagatagtgccctctctaaattaaaggttctgttcagttttgctttgtgtgttctgaccattttgagttttgggtgtatcaaaatacttcacattaggagagagctttgatgtgtaataagtaggcaggaaatacactttaagggatggcaaatagtagttataaatcagagaagcatgctcttggccacctgaaagatatggaaacatccccacatccccacatccccacccccgactgagagatgatactcccatgggggataaagctgattagctttgggttgccttacaatgaaatacatggtagaagcaatgcactgttttctcccatagtatctccctcctttaggggaccaaaaatctagtataaaatggcacacttaattttagggatctgcctttgccttcagctgtgcctacttattaggccctaaaaatgcatgctacctggcccagttccaccaaaggctccaccctgaagccagtaatccaattaagaaactgacaaatgaaaactcttacaagtgctgaatattctgtttgtgttgctatatatgtgttgtgtgtaatgtctacaataagagctctaattaattggcttaaaaaatagtgcttaaatcaaatatgttttagttcatgtgactttaatttttaagaaataaaaataatcttaaggattattggtaaaatgcaagggtcatcaaaatccaaataggtggtctaaatcgtaaaacagatactaggtttgctaaatgttcaaaggttgtatactgcctgattttcagataagtaaggcctgggacacatggagttagatgctagaaagagtcagatcttatatgcatttctgcctgggtcctaggctccacgcctggtacataattaaaattgcttactaaccaggtttctcaacaaatgtaaaacttgctaagagttaacagtgcagcatgtatttgagatcactgaacagttttaaaggcaaggtgtataaaaacagtaaaatgtgttttttagtaaaggattataagaaaccatagaaatataaatattgcccagggatgaggaattatcttaaatttgataagataaagctacaggtttaagcatgttgtggaaagatggtcttttcataaactgagcattgaaataaaagcactgtaaggctgtcttaagccactaatctgccctttagcaaaatgggttataaaaaaggtttgtaaggatttcatctcatggtcaaattggttaagattagatggaattgtctttagggtggcatttaatcaaattggggttaacattaataaattaacgcaaaggtaaaatttggctttgagcaggatttttatgtaatagtaaaggcttatgaaaggtttttgccttttgagtcatcattttggcaaaataagtaatttatgactatctggaattctatttcataacatcaactgttttaaacctctaacatttaacagacataccaaaatcaaacttcaagtttcgaaattgtctttcctgatgcgtggctttctagattgttcagggggcccctgaaacattcagaaaataggtgaacaggattatttgacatgtttaatcacattgggattgccaaaatgatgtccagtcttaacttatatttttgtgaataataccaatatatgttccaaaattgtatgggatttctaaaattctaatgtctcataattaattttaaaattattgtaaaccacggagataactaaacttctttgtcagtcatgtttttaactgtaactaccctgaaaattttgtcacttacagacaattgttatcttgctatgttccttctcaaaagatgggatataatcaagctataagactttaacagctgttctcaaatgcagatttccaatagctttgaagattgtaacattggaaaaaatgtacaggactcatgaagaactgaaatgtttatgaatatcaagtgaaacaagagttgtcttaaatggattgtgctcagaaagctaaagcaatctttttgacttttgcttagaatattgctgatccttattttgtttttcagagtcaaggaaacttattttgaactatgtgcagcctttaataattaagtaagttatactcttgtgaacaaaattcggagcaggtttgtttctctgtacctggttcctctagaatttggaaaccatctgtgagtaaccttaacttacggcaatatagttgtttgcatcagtgccacaagaagtcttttttttttttttttttcaataagacacaattagaaaaactggttattttatcaaagctttgacaggaagtgtatgcttccccctttaaagagtcaatctcagcttgcagagctgataaaagcaccttggggaagactggcctcataccttgtctacacagtccctggacaggtttcttaatctgtagtcagtaaagaatgtcactttttaacatgtccaggacctccaagtttatcttgggaccttaagtgtaaagtatttggggataaaaacccattgctgaacttggcttgaagaggtattatctgagattccttatggaacagagttccatcaaagccaacccaaaaggcctatgtagggataattattcttgctgcactttatgcaaatattcacgccaagtataaggctaaagtttattctacaaagaacacagtcctatcataatttgtttttaccaaaaatgagcaatggagagagaaattgtgctccaaagcttatcatacatttgtcattaaatcctagtcacaataattgtttttaagctttttacctacattttagactaaccctgcttatttctgtgaatcaagtggtgatctcctgcagcttggaagaaacaaagagagatgggtaatgtgaaaatctggataaatatgctagttctgggcaattattctgcaaattctgccaggtaatgaaagtgagtagggtgcccataacccagaggtttatttgtttgggaaaataaagccaagaaacttcatagactccccaaagggaaattctgtatcttggcaggtaaaactttagatgaaaattatctactacaccacacttgcagaaattgctatactccctctactattcacagtagggctatacacagtagcaccttctaactggaatatcagacagagagtttccactgctgtagtattttgcttaattattatccttacaggagggataatagtcaccaaaaaaaaaaaaagaaaagaaaaaagaagtatgaaagttttactatcactgaatctgctagaacttcttattgggtttggtaatgtcacaccctggctatatacaaaggatataaaggaaaaaatattttacataagaaaggatcttgtatgataaatacttctcctaaagagaacagttggttgtttaaaagagggatgtttaggagaagtcagaagatttgagcatgttatagatggttgtggaagtcatgaaaagattacaaggatggtaaatacctgtcctaaaaagaatagttggtcgtttaaaaagaaggatgttaggacaagtttaagcacgtcttagatggtctgttgaagtaatgagggaattaatacttacaggaaagatttagccaaggttaacactaaagttactctagctacccaaatccaataccacttattcaaaaaagaatgttacttgtatattaatatttcagcagcacctggtggaggaaaaccagtatcacaacccattggaatgactgacagcaattaaactccaaatggagctttagactgaacaacacatggatgcatctttcttccaggaacccttagatcgaaccaagaggagccctagctgctgttccccacatgacgtcccttttcagcaggaagtagccagaaagagtcatcatccaacaccccttaacagcagttagggttaccactccagagaggggaatgatagaggagttaagaagaaatcacttaggcagatagcaagggtgtaacagtctttggtaatgcttttctttttaatgaaacacagccccaaatcatttactaacaaagagtagcctgtaaagttgacctgcagacatagacaagcaagctgggagtttgcatcggtgaatgctggcagaaactaagcactagacattttcaagatggtggctccatcttctcttctctgttagctatgtgtactctaaggagcagacaagatggtgctgatcaactggacagcccatttgcataataacattagggtggggagaccagacttccctgtgcattatgtaaacatcatacatgatcgaaccaatctataagccctgtgtaaatcagacaccgccacctcaaactggactacaaaatttggtgcatttgctgtcagccagtcccttctgctcagaaacccctttctctataaagaaagctgtttatctttctcttctcttctgcctattaaacctcagctcctgtactgcttgtgtttgtccgtgtcctaaattttcctggcgattgacaacaaaccctgggtttataccacagacaatgtagctgcttcatcttgaggtctgcctatggcactaaggtactttctctttggtcccaccactgcaattttctaacctgtgttctagtgcctcccaggcactaatcttcagaatttcagaacttttttctggctgtgtgcttgaacttggaacttaatggcagaatcggttttatcttcactgcttgtttgttcctattcctgtttgtgttctcctcaaaaaatcatatgttaaaatcctatccccaaagtgagagtattaagaaacggggatttggggacaatattaggtaatgaagacagaatccttatgaatgaattagtaccctcataaaaacagaaatgaaagaacacattttttgtctctctgctctccccaacatgagaatacaatgtgaagattgtcatcaacaaaccaggaagtgaagcctttccaaacaacagatttgctgccaccttgatcttggacttcccagcctccagcctgtgagaaaaaataatatctgtttttgaagccacctggtgctatttttgttatagtagcctgaactgactaagagagtagacaacagtggtaactctggattaaaatatacatattactggaattaagttagtgtaaatttgaagcagactgataaattgagatatatattgtaagccctattgaaacaattaagaaaataactaaaaaagtaaactaattaaaaaaagactgagctgatttttcattgtagaattcaattgttttggatgggggaaagtgatttgtaacacataattaaataattacaatctttttgaaatagtttcctcatcagtaaagtggaggtaaccctacatcctagttaggctataaagaatgatgaatataagtttggcagtagacaagttggaatttttaacctcaacttgtagctttgtgacttcaagtgcatcactaaaccttaggctgtctctttaactgtaaagagggaacaataaccatgatcatatcttaaaccattataattgaataatatagtaaaaattttgcacaatcaacgatgagtattaactatcataattggattgtgaaaatatttataaactctgaagaatttattactattggtattcattatttttccccacaagctaatctgattatttgtaaaggcaaaaatggaaaaaaacaagtccaccatataattatcacttggtttcttaacatctatgctacttttaaacaataatgtcaatatgtgaactattttaaattggtttttctatgaaaacatttgctgcttattgacatacactgtgcaataatatgcctctcacatctattatagaattaaggtctgtgtgatcaaatgtaattcaacaaatgtttattgcaccttctaagtgttagtcactatgttatgtgcttgtgatgtagaagtttaaaaacgtatgtttactagtaaaaaacattagtttttataatattttagaagaaacagcactagaattgagaaaagtaacattaggatgaaattagaattttgaaggaggttctccaggcaaagaaatggacaaggcatttcaaattgtattattaactgcctattagagagaaggtaatatgtattgaaagttttgcaacaaacatatcacttacacaataactactccatttcatagatgaatttaatgaatttgatgaggtaactacatctagtagagggtaggccaaggctcaaatctaagtttgcctgtttccaacacttgtgcatctaatcactgacatacataaataaggcaattgtcagagaagcatttcaaactttcctgaacattccaaaagggaaaggcatcgtatcataaataagaagataacaacaaagatttccaaaggaagatatgtagaaagggatacgaaaaaaaggaggaaataaaacaatagcaagtatcaaaaacaagagttgagatggggcagagtgggaaatgagagtattttagggttcaacagagaatcagaagcaataggagaatctattatctatctatctgtctatctattaatatagagaggtttatttattgtaaggcatttgcttacacaattatggaagcaaaaaaatcccataatctgcaagcttgagactgaagaagaccagtggtgcagttctgaggaccagagggccaatgatgtgagtcctagtctgagaaaatagaaagaatggtgtcccaaatcaaacagagagagtgaatcctcccttcctatcttttgttctattggacatcataaaagattagatgatggccacatacattgggaaagtcagtctgcttttcttagactactgattcaactgtttctggagattagcctgattcttagactaatctccagaaacaacctcagagatataaccaaaaacaatattcagccaaatgtctgagcaccctgcaatccagtcaagttgacacataaaattaaccatcataaagtgcaaaatttgttaaatgtctgagcttgcagatccttttagggcaacatcacagaccctgaactccaggacaaaataccctaatcaaacgaactgcccaactagtgttctgaaacacaggatgaatcatcagttcaatcatggatggctaaacctaaaaaattattccttaataataaccgtatgtctggaagaaatcaaccttctaaaaaagacaaagttgaggaactgcaaaaggaaattcaaactcctctgaaactcttaacaggcaagaaaaaatatgcagttggataaactgacattcaccaaacttaaaattttgatataaatattcatagggttcatcccttttcttctgtctagcactactagctagaagtcagaatttataaaggacagcccaatatttcccctcctgggcccacagcagacacaaaaaattcataatgaaacgttttttctttaatctgcaaaaagtctattattccttcttaataccatgttttgggcaactactcttaatcaggtaagatgcatgaaataaatttgcttgcaatactgttgctgggtgaacatcagcaagttactgatggtagtcgttctctgcaggatcatttttgcctcctgagggacatttggtaattggggacattttttactgtcttagctgaaagaggtgctgctgacatctagtaggttgaggtcagagatgatgtcaaacattctacaatgcataggaaagaccacctgaaaatatatgtatattcagttcaaactgtcaatactgctaaggttgagggcctttagagttagcctgaactcacaaaattttccgataaaaggcactttcctttcccttccaccttataagctttaattcatccttaaaaggttttggtgaagataattttctttgtaaaggagaaaacatgtaagctttggaaccaggaaaggatgattgtgcatcactacttactagccccatgtttgaccaactttgtttccttgggcgctataacaaaatacaataaaacaggtgccttagaacaacagaaatactgtctcacagttctggaggctagaagaacaaattgcaggaccatgctccctctaaaacttgtagggaaattcttccttgcctctttccagcttctgagggtttgacagcaatctttggtgttccttggcctatggatgcatcactccaatcctccatcttcacatgaccttctctctgtgtatgtctgtctctgtatccaaatttccctcttttgtaaggaaaccagttatattgaataagggcccacactagtaatgtttaactcgattaataataataattaataataatgtttaactcagaatatgtttaacttgattgactctgtaaaggccctattaaaaataaggtcacattctgtagtaatgggcatttggactttcacatcccttttttggaggcgggaacataattcaaccaaaacaccagtttgcttaatttcccaaaacttcagtttccttatatgaaaaatgcaaataatactgactgtctgtagcattaattgaaagattaaaataaatggactaagaaataaactatggaaaaccaactagtatagcagctgctgtatcacaggtgctcaaatatatatacggtcaccctgttatccagtcatatgtgtcatatatacacacacacacacacataaacacacagatttgtgtatgtgtatgtataaaactttcccttttctcccaggtatttatgtctctttggtgttcacacaaaacatgatgtatttttctttccattcgttacattatatttgaactatatatctatttatctatctggcttgctactactttgatattagaaactgttgcagtaatttttagattgatacctaactttgtttactaattaataatttacttatcaagtaaaggactaaatggaaaaatggatggatgaacatgactacagcttaccaaaaatgccctttatacctgaatttctcttagtgggtcagagtttaggtggtattcgaacgaatcaaagggatatacgtattttgcttttggtatgtgtttgtgtacattctcattattgttacttgtcagtttcctaggtttccgattgtgatctttagatttttttgactagcctacaaacttagatttttaaaatcctaatgacatctacagcagtttcccaggagctttctttcagaatatctgccaaaataatttattgctgtcttaggttatttcatcttgagcaacatgaacattccatcaagcagagggtatagggagaagtctcatcagtaaataagctggctaaaatttagacgtccatcaatctctgttaaattttatctcatataccctgagataggagagtaatataaccattttaaaataaaacttatttcttgcccatttactgtatttggaagaaaaaaatagtggataattaggaagtggataattctggaagaaaataattagtagacttactaattatttatgagggaaagaactgagaacagtaattttaaaatatatccatgttcttgaatatttccacccttaagtaactacagaggaaatggactgatttaccaccaaagattactttataataataacctacagtttgaaatttaagctccatttaggagccagaaccaattatttataatactagaatggcctgaaataatcttgtattatcctgaaaaaaaaatctgaagtgggaataagcccacacctcatttatgtgtgtaaaacaatctcagctttacatcttttaagaaaagtctgaataactgccttatttccacatttctttgcataaataaggcagtgcaaaagctttgtcagctgattaaatttatatgcaattttggtaagacattgttttctagttccacaatatatttttgtccagtccaccgaaatttgagtttgattcactcacaaagctgatcctcccaacttcatttaataaaatgtaagaagactttaaaagatatattaggaataactagttagatatggagaccgtctcatattaattatttattttatgagtgtctgctaaatatataaacaactctgctggtaattatttatgggtacccaggtggcataaaaaatgaagcagagacagaaaattagatgtagcttctaccgtagattgataaaaaccataaatgcagaactacacagactagagtggatagtattaaaaactatatgtatagtgatgtactggtaaatgtataacaacctggtttctgaggaagaaaaaatctctgctttctaacattagttgatttccatggcacaagcactcctatcatgaccagtttcaagccacaaatgtgaaatcactgaacacagatttgggaagagatggacacaactcttgaaagtcagtgtgacaaactgaaacacagcactgcttacatatagatatataaagtggatgactattttaacagatacaaaagcaaagaatctatgtgaatttttaactaaaactgaaaatattatatacctaaaagcatgttggttaaaatgatcattttgaatatctaaatctacacagtcataattatactgatgctattaaaacatggtataatggccttctgtatggaactcatattaattgtaataaatattcaattatataaaattttagagatcatctactgtatattagacattgtgctatgaacaggagttacacagatggctaggacttagtttctatttttaaattataaaaagggccaccaaatggataattccagtagataaaataataaatactaagatagaggtaagcatctgtcccgcagtacagagaagagccatttagcccagtcttgtttgggatggttttctgggaaaatgatgttgtcaaaaccaccttatgaaatgcaggctctgtcactttacagttattcctagtattgccaactacaacttcgatcccatatttgaagtgatctctgtaaattttgttaaaggtaaagcaggtccatgattttgtggggatagtaaacagaggcttaaaataagacagaacttttaggccagttatcagatctttaatggaacttaaacatattacctgacgtggacaggtagggagagccctagaggaatgctgatggattgggtaacttgtgagatccgtgtgtgagcttagtcaagtcattttctggtatgtcggtttccttatcaatggaaaaataatggtttggggtggataataataataaaatcatagctaatatctattgattgactttgatgttgttatatcccttgacatatattaattcacttagttctcacaacaatcctataaagttgatatccttctttctctttttatattagataaatctgagataattgtaagctatatacaatttcaatgttaggaaagacctgaggtagaattccaacctagttctttctgactctaatctcttagacattccctgaagtcgtttccagccttcatgttctttgaccccagaagtatcttggaatgtttccctaattgctgtgatggcaacacagcagagctagggaaatcaaagacctaggctatgccccttcatgtttgtgcattatggtgaatgagctctgaaagtgccagggaattttgccaccaagtcttcacattaacttttcagcaatattcctcagtttaggagggaggcctatccactccttgtcctttgaaaagtgatcatttgcttgattgctctcaacagaagtcttcccatagcctctgatattttcttttcatttcttctgagttgtttatttttaattacttaacatttttgacgataccttttccgaatgcatctcaaacttagggctaaaaagccaaatgcttcaactttgttttcccatctcttaggcaaacagccaaaataagttccatagttgagcgaggtttttccataactctggaattatacaagtagttcccatttcagggcgtggttgccatccttttctacatttcttagcatggctaaattctctttattctttatggtttagacgatcccctgagaaggtcccaaaatgccgtgtgttaactttatatgctgcttttctctttctggcttaggctgcagactgcctaagggcagagaaaagtttttttgttttttttttgtttgtttgtttttttaatgagtttatcttttgaacctgatgcaatgccagtataacttagggtggaagaacttgggatctgtagttaggatgtctaggtttaaatcttacctttgctacttaatagtcatgtggacttgggaacatttaaaaatttcccccagactcacattctatctgggaagagaagatccaacaacttacttcaaaaggcttttgtgaggattaagtggtccatgtaaagcacttggcatggtatctagcacatactgagtattcaaaaaccattatattgttattaggtactcaaatgttaaatgaagagtaagaaaatgaatgtacttattcattcagaaaatatttattggtgctagacccatttctaagacctggaagggtagcagagagcacatccaagttgctccctggtttttctagagcttacattctctcaaagggagaaagacaccaaacagaaaaataaatatgtgtgaaaataaagcagagaggccgggtgcagtagttcacgcctgtaatctcagcactttgggaggccgaagcaggcggatcatgaggtctggatttccaggccagcctggccaatgtgaaaccctgtctctactaaaaatacaaaaattagccaggcatggtggtatgcgcctgtggtaccagctactagggaggttgaggcagaagaatcgcttgaatccaggaggcggaggttgcagttagccgagatcgtgccactgcactccagcctgggcgacagaccaagactccatctcaaaaaaaaaaaaaaaaaaaaaaaaaaaaagcaaagaaaaggaaagaaaagaaagcagagtaagaggacaagcaacagcaggggaaatgttactttagataaggtagccagagatagactcctgtttatgataatatttatttgtgcacctgagtgaaaagagggatagatctgtaattctgtgggttggggcaggggcgaagcaaatgcgaaggccctgaggctagagggtttctgtcatcatcaaagaaaagcaagagaaaggactgatttggtagaagaggagatatgagaggatgtttaagagggagaatgttaggagaagagggtgagcatcaaagtgtgacacatttttaaactagtacaactgctatggaaaacagtatggagatttctcaaagaactaaaaatagaattaccatttgattcagcaatcccactactggctatctgcccaagggaaaagaattcattataccacaaagatgcctgctcgcatatgtttatcacagcattattcacaatagaaacaatatggaatcaacctaagtgtctatcaagagatgattggataaagaaaatgtggcatatatacacaatggaatactattcagccattaaaaagaacaaatcatgtcttttgcagcaatgaggatggaacaggaggccattatcttaagtaaaacaaatcagacacagaaatacaaattcaacattctcacttacaagtaggaactaaaataacatgtttgcatgaatgtagaatgtgtaatgatggataatagagattaggaagattgagtagtggagaggagcacagattatgagcaattacttaataggtacaacgtacattatttgggtgatgaacaccctaaaagatctgactttaccgctgtgcaatttagggatataacaaaattatacttgcattccatatatttattaaaaaagatgtgacagatttttagggattgttggccaagtaaaaactatagatttcatgctgagtgagatggaaggaatttcagggtttggaatagcattatgaaacgaattgaagatgctctcattgagaatgaaataaatgattaaagggtctcgagatagattcagataagtaagggtatagtagccaactgatgaagaggatgcattaaaaagataacattcggggaagggcagagagttgacaaatgaggtgttaagaagtaaaactagactgacctcacaaaagagaaaattaagacaaaggcattgtgatttatgcataattgtcaatttgtatgtgtacatatatgggtccacttgtcaagctttcattgcctacagctcttttgactatttattttccttcaggagcccatactttaaaaacattttctcaaccaaagataatttatttataattaattcatgccatcatattttttcaaagccataagtaacctcaatctcaacttccaatgggtgacagcaaaccaatgtcatcctctcctggagtcaccattctagccaagagcaaatgaacctatgatttccatcaacctgtactgccttattgcaattaatatattctatcccttagtttcttttaaacactggaaatagctttagcttgtatactcccttttctttttcggtggaatcccaggagtctctgaaccataagtgtggtattcaaattactcatgtaaacctacagatacaatgtgtatcttacataaccattatatacatattccatcctatatgtgcatgtattacacacaatgcattttatctctagaatatatgtatatattgtgtatatagtgctttcaaataaggtcatattcacaggtttacacagttagaatgtgtacttatcattgtagggaataccattcaattcaccgcagaggtatttattggaaaaatgtgtattggaaaggagaactatcaggctgcattatttgttaaccatctaagattattatgttaatataaaagatctcataaacagaagctcttattacctagtcaatagttgttttatttcttattgatatatgattatgctgccgaattgtgaatttaatttggggcatgaatgtgtcatacatcttcatccaatcagaagattcagttcagatgtgtctatataatatatgtgtttatctttcagaaactttgtaagtaaagaatattacccttacagataagtcactctcactggagagaagatcgtgaggtagggaagaatgtggaaattaacatctctgagtacatgttcccaacgatagggccatattgatgaggggtcggaaagcaggagcctgccaaagagcaaaagataggcccgtgtggacaagaggttactttattatttatttattcattaattcattcatttattcatttacttattttgagacggagtcttgctctgtcacccagactggagtgcagtggtgcaatttcagctcactgcagcctctgcctcccgggttcaagtgattctcgtgtcagcctcccgagtagctggaattatgggtgcccatcattacacctggctaatttttgtatttttagtagagacggggtttcgccaggtttgtcaggctggtctggaattcctgacctcaagtaatctgtctgcctcggcctcccaaagtgttgggattacatgcatgagccaccatgcctggacaaggttactttattaaacggggtaggacctcttattagattggttcacctggaggatggtcttagtgatacctgactttgagtctctttcagtctctctgcaaagctcattttgaaagacatttctgagtctcctactaaatgccagacactgagatgagcaaatgaacaaaataaaagtctctgactctagagaacatcaaccccggagtgtggcaaggcaggaggcagtggtgggggacaaggaagagaaacatatgcattctctacattcaaatcttattatactttaatattttagagaataaaacaggaggggaagtcagaacaaataaaggacaagatctgaaaactgttaaggactttaaaattatattcaaatttatttaagtacccttaaatttacttagtgtataacagaagagaaagctgagttatattggttaccttctgttttgtaaacgcaaattaattttacagtgtctctcttagccagataaaaccattgatatttattgacaagtaaatcaaaagcatttatggttactggcttcttaatttcatctactcttgtttctgtcactggggagttttcagcacttatattggtctattttgatgaaagactcacaacagagggcaactaaaacaagagtgttcctcaagtgatttttctaggatgtaagacatagattattactttattagccctccccaaattttgaggacattcgtacataaatctgagagttattttcatgagattatctcaccagatggcttacttaaatatttgtaccattgtagaagtaattacttcatctgggagaaaaaaaaaagttcaaaagccctggattatttttgtctgttttcatttgtttcatttctattttactttctagacaggagtaaacttacatttctatgataaatagatgttggtaaggttttggaaaatacatatatgtcaaaatataggaaattctctgtgtcagaaataaccacaattatggtgtaatgaatgcaatactcaacagagagttggaaaataaggcataaattttgagttttagtaaatatgagctatgtaaccttgtgcaagtcacttaatcttactaacatcatattcatctgctaaaaattgagtaaataatggaaactccattgagccattatatgaattaaaacataatgccacatttgaaagtgctaaggaatccacgccagaaaaggctaattaaggagttaatcaattaccattatcaattttttaaatactaaataattactagtttgaacatctagtactgctagtaacaggttatattttgcctagctatttgaagcagttaaaaagagttcctttgaggatttgaggcagtttggctaacagggaaagaatcctggcctggaagcagatacccaagttcaatttctcggtgttctatttgcctgaagtgacaccttgggtagattatttgacttttcagggccacatgtcctcatctatataatgaggatggttatgaaaaataaattactacttgtaaagtacttagaggcttgtctggaatgttatgtcagccctgtggatgttagctagtagcgatcatcactgagttttcctgaaagccttccaacagctgggaggccacagctggccacactctagtgtcccacagagggaccacaggagtctcctcctcttgccttccatgcccccactctgtccaaaactgctagtagtgccacacaaggacatagaaactgagagcaagactgagagaataagactaagagagagagaattctgaaaatagaacaaaatgctattttatcaaaacagagcagagtttggaaggcttctagtgctctatcttctcactaaatatttgtatgactttaaaatgtcacaatttctctgcagcagtatttactcatgcgaatattagaaattattataattacatggaacatttgtttagggttttaccatttacaaggtgggagagcagaataacttaatcgtgaacaccagagctttggaatcaagcaggattagatcccaggtttgttgtttactagctggtcaagtcatttaacttctctatgcctcagtgttttaatttgaaaactagtaattcagaaatgttcctcagaattattaaagatttaaataaaattgtttattctcatatatatatttatagaatctcatagcagaaaatttggcagtggtgatgcacataaatggtagctttaaaaacaattttttctgtctgttgtatgtaatttatataatttgcgtgtaatcccaccatgattagaaaaaatattatctgaggagactaaatgcagcataagtcaattttggagaaagtggttataaaacaattccacagaaaacatgggaatatgccctaaaatattgactatggttattaaaatgagggaaaatatgaggcaatatttcttatctatacttatccatattttagcattccatacaaacatcatgttttccatatttgagaaaattatatgtgccatgaaaatacttgtcaactttgtccatcttgcaaacctactctcccctgtcttctacctaggaactgtaataggaggtattgctcctaaaaatctatgatcgcatgatatattttgaaaataatggtcataattcaccatattttcttacatgatggaaaaaatttgttagtctcttttctagtaatatgaataaaaatgatcatcttgggtttggtaagtagtgactgcatgcttactaccatccctgctaggagtttctttcctctgcaccacctctttcacatatagcccccagaatatatctttctaaacccagattcggtaactatctttccacaagcttaaaaatgactgctcaaagcataaaaataagaggctattttttgcctgttttaaaaagtagtatggccttaagttctattttcagcttcttatcctattataccttattttaacaaagtatctcattttctaggtatattggaatacagtcttcaagtttggggtcattttctctctctgactgacatgaattatgatttcctcattattcgactgtgaaaatccttttaatatctcagttcaacctaaaacttcaccaaaagcagatattaaactgtttgttcagatttcagaatgcccagtgaatgagtcacatttacaaagtgtgagtttacctatatgcatatggtggtcccttctctccatactgcaaggaaacctgttattctagcattcttagttgccttatattagtactctgatggtcagaaaccctaatcactttgaacttggcagcctgttagtggtaagacttggactttgaggccgaagtcctttcttggagacgttgagtccaaatttatatattgtacttgaatccagatttttcaaaacgtttaattggcagttacaggcaatgccccaactaaaattaaagtggaacttacatttctcatttgtccttgttccttgagtatattattgccttggaaaccttgtgggaaatagatgatttataaagcatggttctattaatcttgggtttctctagccaaacaacatttaacagcaatctaaaacttatcgtacatgtagtatattagcaaaattgccatcctgttcttactcatatacttcctcgctcaaagtggctggtgtctaaggtaaaaagtgtctccagactcgttcatattattcttttctactttccactgccaaggtaaatcaatggccagactacactgccatcccttttttttctgaatttttgtctacttttttttttttcactctgaatctcatgcttctttttaataaagcaggatgttcccaaactcttcatcctcaccagtacacacacacacacacacacacacacattttctattttcatctctagcttgtttccgtgatggcacttataacttaaatttgcttatttctatgtttgcttgttgtttcttggccatcctcactggtatctccaagatgcagagggtgtgcctttcttactcatctctataaccccagttaccatagcagtgtctagcacaaatgagaaacacaataataacaaattcattctcatctaatattaatgcccaaagctctggaacatgaagcccacctactgcaataatagtcattttggggacaaatacgatttttcctgctacttgtgtttttcctctagagattatgagtatatacttttttaaattatggtaaaatacatataatcaacttttccatctgaaccattttaagggtaaaattcagtggcatcatacatattcacagtgctaagtaactatcagcactatttccaaaatcacttcacctcagatggaaactccatccccactaagcaatcactccccagttcccacttccccagtccctggtagtctttactctactttctacctccatcaacgtatctattccagatatttcatataattgaaatcatacaatatttgtcttcttgtatctagtttattttttcagtctagtgttttcagggtttatccgtgttgtggcatgtatcagacttcattccttcttaaggctaaatatgccattgtatgaatatacaggacaacattttgttcatctatttatctactgatgaacaccaagtttatttggctatcataagtaatgtttttatgaacattgatatgcaaatatttgtttgagtttctgttctcaatacttctttgagaacctaggagttctcaaatacctaggagtggaatttttgtttcatatgtaaactctacatttaactgtttgtggaaccaccaaatggtttccacagcagttacatcattttacattgtgatgggtatagttttgattggctttctttctttagctgaggctgtgaagagggagtgaattagacaaaaacctgaacaattctcaaacatatatgtttagactatatatgtctaagattgtcaaatggttagacaaagaggaatatcctatatggtttgaatcagcagcacttttaagcaagaacatgataaaccatacatttaaaatgtatttcaagcaagaatccagtaggtgaaatgtctattcacgtcaatatatagccatagaaatgggctcaatacttaaaaacacacaatgtagaacgtattttttttttgtttcagataaagtcctaaaatatgcaacccaaaatccaagaaatattttaaaattgctggtctctatcccttttcagtagctagagaatgggaacaaaaacaaatccaaagttctcctgaattttaaggtttaaatcttttattgaaatgctctaaaataacaagcgaatgcgtccagtcatgtttggaaaaaaaatgttgctttgtaaataagaatatattttttcctagtcacttcttgatttttccatgcaagtcacgtgttcccaaaagatgaaaaagattaaatatttaccatagaacatctaaaaacaataaaaaaagggactagtccccactgtatataaagctctgctccaggcagaaggataactagttggagtctctgggcactcataagagaacagattcatttttaacaagtccttcgcctacacagaactgtaattgcatagcttgtgtggtgtctgtatctttatcattttctatttattcatctatcctgtgtttcctgttcatttcctgtgaaaaatgaataattaaataagctaacaaattaaacaaatttaacaaattaaaacaaacaaatgagaaagcatatagattttttgtactcaacagtgacactttccctcactgttggaatactctaaacacctttctatccatatgatgggtagtatatttaattcgtgtaccacccaggtagcatagtgtatagaaaacagcattagggttcacagactttgtttttatcctggctctacttctaataagctgtttgactttgaatatgtcactaaacctctttaggctatgtttccttattcgtaaattgagcaagttgaaccagatcactggtttacacattgtgttgcctcagaagctaaaattggagatgagggggaagtaaattagtagggctctgtgctcactgtgcttactttaaatacagtggttttactttcatttgccttatgcatttggcatctgtgcacagttttatttgggaagaagaaaaagtccctcttttggaaatggtggtggggaacctagaaatatgaactagtcagtaacaattctttgctacccaagtacgaaattttttattgtcttaatatacaaccagtaaaaataacagcatctaaccagttggggtgttgatgagaagtcacaaataagtattgtacaatactgtaagtattggcgaagttcagaggaacgtgtatctgtataacttcctaaaatgaccaaatgaagagtattagagcattcaaaaattgagattgtgaagcaggagtattgcttcaaaaataacattgttatttttcaataggtattccgcatcaagataatacatttttaaaaatgtacatactttggtataactaaaataatgataatgcaacatttttcaatttactgccatcaaacaaattgatgtttgttactttcttaaaggggctgacttatcctaaggaactttattctctcatatttcatggaaataacattagactagaaaacaaggctctcatctggtcttggcttcctaaagtgcacaggtaaaggcttgcatttgccctctatgcatttgatttgctctctctttctctgcattgtcacacttttgccatggagatcattatatactgtgtatgtatatgcatgcatgtgtatgtgttggtgggaggggggagggctcaggctaacctgtccataatgaagaataatatctcagttcataagtttttaaaaaatgtcagatttctccatcttcagagttgaaagcatccataatagtcattttgtccaacatccttgttaatgttcaatctttctatagtatctcttaaagattttccagtaatagaaactatattccattatgaaacagctgaacttattttaaaacaaacaaacaaaagcacttgataaaattccattccttggatgtgagttttactctcttaagacacagactattctttacctattgacctgttgtcctcatgccagtcccttaaatgcctgatggaggctgacatgttcccaggtctacatacatgagcatggaacttgggattgcaaatttgagtagcaatatgcttgattcaatcctccctgttgctattttaatattcttaataacttttgaacaaatgctccctgatttttattttgcagtgggccttgcaaattatgtagccagttatgcataatccttaaatcatctatcctcaagcttaataaccccagttcctacagtatctgttcatgatcattggtattaaataggtttgtttgtcaatgaccatgttagaaggtaatggccagaattgagcacagtgctctaggtgtggtctgatcagtgagaaaatcagaggcatgattatatcccatggtgatatctcctgtgcctctctattctcacccgctcaagatccagtctctcgacaattctctgccctgctctgagcccaagaaggcaaactcatgcagagggtagcagttgagatcccttcctgtctggcatccagctgggttaatggaaggcaataggggatggcaatgtagaagagagaattcagggtatttccttcccctcccctgtctcagagctgcatccctctctgtggtaaaaactgcatccctctctgatgagaattcctactggttggtccctcttttacagttccatatcttctttttttttccttctctctctctcttttttttttttttttttaggtggagtcgtgctttgtcacccaggctggagtgcagtggcacagtctcggctcactccaacctctgcctcccaggttcaagcaatcctcctgcctcagcttcccaaatacatgagattaccagcatgtgctcccatgccaggctaatttttgtatttttagtagatatgggatatcaccatgttggccaggctggtctcgaactcctgacttcaagtgttttacatacctcggcctcccaaagtgctagaattacaggtgtgagccatgtggcctacagttccatatctcactggtcacacaatactgttttctctccttgttccttcagccctagtgggtattaatggtttcctgctgcttctgctcctttaatcctgatcacataccatatgcattcctttcgtagaaccatcttcatttgaatcatatggggtaaattctgtaccttgccaatgctctgataaatcactcagcatgttggtgtcatatgtctcttaatgtctccagttagcatacattttggacatttctctagaaggatgaagttgacattctttgcttcactgagtcactgatctagggtctccttccacacttccaatcaccttctgaagagtgacagagggtgctcaaatttctatctttgagacatcatgcttccagaatataattaattcaaaaatatgaagaaatagttcctacacatcaagcattctctctcccaagaactggagatatagtagtgaccaatcacatcaagttctctatcctaatggagtttagtgagattcttgtgagagatcaaagatataaaccagaggcctctaagaagctaaataacatgactggcctaatttagaagttttactctggttgctgtattcagaatacactgccagaatccaggagaggcagcaagaacagttagaataatacaagtgaggagacatggcagcttggactaaggcagtggcagcaggtggtaaggttattctgtgactcagcacacatccttgctgccctgtttctctgttccattgaatcccaaggtaggatccatatcttatcctgtactttaccagcttactacaaacaatttgtgaataactgcatagtgaattaaaggtcaacaatatccactttactttcaaggaaaataattttcctttttcttagcaatcataataggtatttttcttcttttctcaaacgtaaagaaaaatgttgtaatattcctggggactatgaaagaaattaaaagtcaaatgaaagtgctcattgaattattcatagaaaattatctaaaatgaaatgaaaaaggggattatcatcttcaatttgcctcaatattcaggtatgggtaagaaaatactcagaaaattaaggtttccttaacaagatttttaatggttttgttagtaacttttacaaaaacaaaaaggtcacattttccagaagatggaataatcaataactatactattttgagcactaggtttgactacttctgcctactctttgtagaataaaaaaaaatctaatttttagttatactgagagcaagagaaattcagtgaaggaggaggacagagaggaggaggaggagaaaagaaaacatcaataaatatactatgaagtagtaccccagaaataaagctgcccgatagagctttcctaatgtaacaagattggtggtttataaaacaaaatgcaaccatcttttgttgttgaattgtaagactttttttaatgtgcggcataagtttgattcaaaaaccagtgatatcgaggtcatattagaataaattagtggagagctgaaatgtaattaattgaaaataaggggaaggggataagttcttgctcccttgccccattatggagagtatctgtttctattacagctgttgtagctatccaagactaaattcaattttcttgcaaaggtcatatattctctcattatctaatcaaaaatatattattaatatataatgcattaattaatttaaaattccattaatacttatgtgacaggcttttggacctggatcttcaacagttatttgacaatccatttcttcagttcttaggaaataatctgacaatatgtatgggctgcaaacaggtttctttggaggatcttcaaagcaccactaccaacatcttctaacttcatatctgccagtcaggaagaggcttgataactagaggttttgttgtgcagacattatgttccttaagaacagttttttagtctcatggttgtctacaaaactgaaggccgaatagtcttttatcttctgaagaaaatgaagtttttacttaagtaaagaaaacaaaaactaccacagaatagtcaaacaatcctgaaaggctatggtcacaataaatttcttataagataagataataataagataaatttgagaattaggtaaataatggctgtgccatttattcttcttaattattcatttggtaggaggagaaacaagatggctgaagagaagcatccagcaattgttccccttgcaggaacaccaaattgaacaactgtctacataagaaagcatcttcataaccaaaaatcaagctagcaattacagtgtatgcctttaacctcatatcaaggaaatagatatgaaagaaggtaggaaagacagtctttacttgcgtacaccacccctcccccatcccccagttcatcacaaggcagtaggacagagaatctgtatgcttggtagaaggagagtgcattgattttgagacttcacattataactcagttctgacttgtcacaggggaaagtaatgcaaggcagaattcagccagcctccaaggaggaaggatttagaccagctctagtcaaagggaaatagcacatctgaggagtaagaacctgagccatggctagcaccaccaccatgagttaaattgccctgagatcctaaataaactagaaaggctgcctagaccacaaggactgtaattcctgggcagtcttggtgctttgctgggcttggagccagtggacttggggtgcatgtaactcagtaagaaaccagctggagcagcaaagggagtgtcatccctcccccaactctggcaacacagctcacaattctgggagaattcctccagcttgaggaaaagagagagaaaagagaactttgtcttgcaacttcggtaacagctcagccgtagtacaataaagcacaaatctaatccataaagaccccaatactaggacatagctcccagatgacatttctagactcaccctgggccagaagggaacctgcagccctgaaatgaaagacctaggcgtggcaggattcagcacctctgactaaagagcccttgagcattgaatatacagcagccatagccagacactagtcaccataggccttgggcaagacccagtactgtgctagcctcagctgtgaccaagaagagtcccagcaatggtagtcacaggagggcttgtgacaccccttctccaacttcaggcagctcagtacgaagagacatagagacactgcttgggagaaagtaagtaaagagaacaagactttacctgctaatactgggaattctcttgtatcttactgaagatcaccaaggtggcacctgtatgagtcagcaagacttaaagtgttactgggcttggggtgccccctaatgcacacagtgaccaaagatttagaacaacattcaattccctttaaatacctggaaagccctatcaagaattataggtataaataagctcagactgcaatgattagaataaactagtttttcaatgtccagacattgacaaacatccaaaagtattaagaccatctaggaaaacatgactttgccaaactaaataaggcaccaatgagcaatcccagagtgacagagatatgtgacctttcagataactcaaaatagctgttttgaagaaacgcaatgaaattcaggacattacagagaagaaattcagaattccatcagataattttaacaaagagattaaaataatcttaaaaactcaagcagaaattctggaacagccctattaactgacaaacagaaaaatgcatcagagtctctcaagagcagaatggatgaaggagaagaaaggatttgtgtgcttgaacaggctatttgaaaacacacagacagaggaaagcaataacaaaaaaaatgaagcatgcctacaagatttataaaatagcatgaaaagggaaaatctaagagttattggccttaaataggagacagaaagagagattggggtagaaagcatattgaaaaaaataacagagaactttccaaacctatagaaatatatcaatatttaagtacaacaaggttatagaacacaagcagacttaacccaaataagactaactcaggagatttaataagcaaactcccaaacatcaaaaataaagaaaggatcataaaggcagcaagaaaaaaagaaacaacatacaaaggagcaccaatacatctggcagcagacttaaagtcttgaccttacacaccaggagagagtggcatgacctatctaaaatgctgaaggaaaaaaaaaaaacaaaaacaaaccaaacaaacaaacaaaaaaatcttttatccaagaatagtatatccagtgaaaatatcctgcagacatgaaggagaaataaaaaaattcccctggcaaagaaatatacctaatgctagatgacaagttagtgggtgcagcgcaccagcatggcacatgtatacatatgtaactaacctgcacattgtgcacatgtaccctaaaacttaaagtataataataataaataaattaatttaaaaaaaaacctgagggatttcatccataccagatctttcctaaagaaagtttttaatctgaaagaaaaggacattaaggagcaataagaaatcatttgaaagtacaaaactgactggaaataagtacacagacaaatataaaatactgtaactgtaattgtggtgtgtaaactactcatatcttgagtaggaagactaaaagacaaatttatctgaaataataactccaacaacttttaaagacatacatagtataagaagatataaatagaaacaacaaaaagttaaagagcaagaagtatgaagttaaatgtagagtttttattagtttttctttgtttttgcaatcagagttaagtagtcatcaatttaaagtaatgagttatgttatttgcaagcctcatggtaacctcaaatcaaaaaacctaaaaaatataaaaacacacacacacaaaataaaaatcaaaaaattaaaacataccaccagagaaaaacactttcacaaaaagtaagacaggaaggacagaaggaagagaagactccaagacaaccagagaacaaataacaaagtggtagtagtaagtccttatttatcaataataacattaaatataataggctaaacactccaataaaaaaaatagagtggctgaatgcattaaaactaaactcaacaatatgctgccttcaagaaacacacctcacctataaagacatacactgaaaaaaaaaaagatggaaaaagatatcccacaccaatggcattcgaagaacagcaggagtagctatatatatatatatatatcggataaaatagattttaagacaataactacaaaaagaggcaaagaaagtcattatatattgataaaggggtcaattcagcaagtggatataacaattttaaatatatatgcgcctaacactagagaacacagatatataaaacaaacgttataagagctaaagagagtgatagatcccaatataataatagttggaggcttcaccatcccacttgcaggattggacagattatccagacaggaaatcaataaagaaatatcagacttaataggcactatagatcaaatggatctaatagatatttacagaatattttatttaacaactgcagaatatacattcttttcctcagcacatacatcatgctcaaggatagactatatgttaggccacaaaacaagactcacaaaattaaaagaaaatgagatcatatcaagtgttttctcagagaacaacagaataatattaaatagcaataacaagaggtactttggaaactataaaaacacgtggaaattaaacaaaatgttcctgaatgaccagtgggcccatgaataaattaaaacaaaagttttaaaaattcatgaagccaatgaaaatgaaaatgcaaaatcccaaaatctatgggatacagagaaagcaatgttaagaggaaagtttataccaataagtgcctacattaaaaaggcatataaattttagataaaaaacctaataacacatcttaaataactagaaaaataagggcaaggcacactcaaacttggtagaaaaaaagaaataatccacatcagagcagaagtaaatgaaattgaaacaggggaaaatacaaaacatcaatgaaatgaaaagatggttttctgaaaggataaaaaaatcaacaaacctttagccagactaaaaacaaaagagagaagatcaaaattttaaaatcagatgaaaaaggtgatattacaactgataccacagaaatccaaaggatcattgtagactactatgagcaactatatgccaataaattggaaaacctagaggaaacaggtaaattcctagacacatacaaattaccagtatcaaatgatgaagaaatctaaaacctaaatagaccaataacaagtaagaagattaaagtcataagaaaaattctcccagccaaaaaaaaaaaaaaaccaaaaaaaaaaaaacctcagggcccactggatttattgctaaattctaccaaacacttatgaggaactaatacaaatactactcaaagtgttccaatatatagaggaggagggaatatttccaaactcattggaagtactactaattctatgaggccagtaatatcctgataccaaaacaggacgaagacacatcaaaaaaacaaaaatgcaggacaatatctctgataaacatagaggcaaaaatcctcaacaaaatactagcaaaccaaattcaccaatgcattaaaaacatcattcattttactttaagttctgggatacatgtgccatgccagtttgttacacagatatacatgtgccatggtggtttgctgcacctatcaacccttgttctctgagagcccagtgacaatacctgcctcacctcacattacccaatggaaaataggaacaaatctactttgacaggaaaagtgctacataagtgtatggcattcttattttttaaaaacatatatgtgcaggttataatggctttcaaagctggcctccttataagtgaatgagatatcagcaaattaatagaatctattgtaccctcagtcctgaaaatatcttaatattccacacttaaaagaccactgcgtttttttttaataaagtgaaatctcactgtgttaaaaatagtgtgattaaaaacaatattgttaaaaaaaatcattcaccatgaccaagtggaatttatcccagggatacaaggatggttcaacatacacaaatcaatcaatgtgatacatcatatcaacagaatgaaggataaaacaatatgatcatcttaatcaatgctgaaaaggcatttgataaaattcagcattcttttatggtaaaaatcttcaaaatactgggcttaggccaggcgcagtggctcatgcctgtaatcctagcactttgggaggccgaggcggacagatcacaaggttaggagattgagaccatcctggctaacacggtgaaaccccgtctctagtaaaaaacaacaacaaaaaaaattagctgggcatggtggcgggcacctgtagtcccagctactctggaggctatggcaggagaatggtgggaacccgggaggctgagcttgcagtgagctgagatcatgccactgcactccagcctgggagacagagtgagactccatttaaaaaaaaaaatactgggcttagaaggaacataacaacaactgaaagccttggatctaagatttggaacaagataaggatgcctactgtccctactgttattcagcataattctggaagtcctagtaagagccatcaatagaaagaagtaaatggcttctaaattgtaaaagaaaaaatcaaattatctgcatttgtagatgataacttatatttagaaactcctaatgatgccatcaaaaaccttttagaataaattcagtaaagtttcagaataccaaataaaaatacaaaaaaaaccgtatttctatatgccaacagtgaaaaatatgaaaaagaaatcaagaaagtaatcccatttacattagctacaaataaaataaaatcccaaggaaaaaaccaaaaaagtgaaagatctctacaatgaaaactaaaaagcattgatgcaagatattgaagatgatacaaaaaaggtgaaaatattttatatttatggattggaagatttaacattgttaaaatgcccataacacccaaagcaatctgcgattcaaagaaatttctatcaaaataccatttaccttctcacataagtagaaaaagtattctaaaatttatgtggaaccacaaaagactcagaacagccaacgctatcctgagcaaaaggaacaaaactggaggaatgacattacctccagttatactacagagctataataaacaaaacagcatggtgatggcacaaaaacagacacatagaccaatgtaacaaaatagataacacagaaataaatccatatatcaacagtgaactcatttttgactaaagagtcaagaaaatacattagggaaaggacagtctctacaattaatggtgtttggaaaactgggtatccatatgcagaagaataaaactatactcttttcttgccgtatacaaaaatcaaatcaaaatggattcaagactgaaatctgagaccttaagctacaaaactactaaaagaaaacatctgggaaaggctctaaggcatgagtttgggcaaatatttattgagtaacacccaacaactacaagcaaccaaagcaaacatggacaaaggggatcatatcaagttaaaaatctccttcacagcaaaggaaatgatcaacaaagtgaagagacaacccatagaatgggaaaaatgttagcaaactctacatctgacaagggattaataaccagaatatataagaagctcaagcaactcaatggtaaaaaatctgataatccagtttaaaatgggcaaaatatctgaatacacattcctcaaaagaagttatacaaatggcaaatgagtaaatgaaaggtttctcaatatcattgatcatcagagaaatgtgaatcaaaactacaatatgatttcatctcacccatttaaaatggctcttatccaaaagacaggaaataacaaatgctggcaagtatataaaagactgggaatataaattactaccaccactatggagaacagtgtggagggtcctcagaaaactacaagtaaaaccaccatatgattcagaaattttactggtatgtacccaaaaggaaggaaaacagtacattgaagagatacctagactcccatgtttactgcaacattattgaaaataaccaagatttgtaagcaaaccgaagtgttcatcagtagatgaatggataaggcaaatgtagcgcatatacacaagatagcactattcaggcataaaaaaatgagaccctgtcatgttcaacagcgtggatggaactggaagacattatgttaagtgaaataagccaagcacagaaagacaaactcatgttctcactcatttgcaggggcaaaaaattgaaataattgaattcatagagtagacagtagaatgatggttaccagaagctgggaagtgtagtggggagtagaggaaaaggggggtggttaataagtccaaaaatatagttagatagaatgaataatatctagtatttgatagcatagcagggtgactacactcaacaatttattgtacatttttaaataacaaaaagagtatagttggaatgcccataacaccaagaaaggataaatgcctgaggtgatgaatatctcatttactctgatttgattattatgcattgtatccatgtatcaaaatatctcatgtaccccatgaatatatatattcgtatacctgaatatatatattcatatatattcgtatttatgtgagtatacatatgaatatatattcacatacatattaatatatatacctactatatacccataaaaattaaaataaaaaaattaaagggaaaaataaataaatactaaaaatgggcaaaaggtctgaatagacgtttttctaaggaagacatacaaattgtcaacagacacatgacaagatgtttaatgtcactaatcatcagggaaatgaaaatcaaagccacagtgagatatcacctcacacctgttagtatagctataatcaaaaaaaaaaaataagaaataatcattgttagccagggtgtggagaataggtaactcatgtacactgtttctgagaatgtaaattggtacaaccattttggaaaatagtttggagcttccttaaaattttaaaatataactactataaaaccagcaatacctctgctaggtatctatgtaaaggaaatgaagtcagcaccttgtagaaagatctacattcccatgtttattgcagcatcatgcacagtaacaaaggtatgaaaacaactcaagtgtccatcagtggataaataaattgttattttatatatacatacaaatgaatactattcagccttgaaaaagaaggcaatcctgccatttgcaacaatataatgaatctgaaagacattatactaagtcaaataagccagacacaggaaaatagatactgcatgatctcacttacatgtcgattgtaagaaatagtcaaatatatggaaacagaaagtagaacactagttaccagggacacagaggaagagaaaatggggagatgtaagtcaaaaatgtacaaacttgcagctacgtaaaatgaataagtttagatatctaatattataatgtacagcattataatattattaactacagttaataatattgtattatataattaaatttgctaagaaagtagattttaggaactctcaccacacataagtcacctatggaaagtgatgggtatactaatttgcttatctatagtaagcatttcactatgtatatgtttatcaaaatatcattttgtatatattaactatacacaataaaaataaatttaaaaaaatcattttgggggagggaagctgtaaatatctcacagatgttttacttcagctaggaaaaaacctgaagagttataaggatcatgtgtttttattaaaattatgtagttatatataactacacgtgttgttgaaacatagatagataccaaagcaaagaaatgatcgattggcctcaagatagacaggaaggatttaattagctcaacagtgtcatgatttaaataaaaataataatgataaaataactgacacttataaaatggccactgtgtctctatgtgattttagtgcccaagaaaagagctattactctttcagagttgaggaaaagatcagagatactgactactttttgctgctttatttttttccttttccttagaaactagcttcatctcccaaagtcccacctcatcctctgcctttactttgtactatgcttggccccattagcaacttaattgctgacccgtcatgtatttctctctgatatttgacatatcacatccttacaacataaccttattcaccatcaggggttcctaatccaaatttcaaggcatagataatagtttactgagtcaattgtaatgtattacacgggtttaaacacttacctaaaaatcaaaaagcacctcaagagtgttctaagatgtggcactggccgggtgctggggtggctcatgcccataatcccagcaatttggaaggctgaagcaagcagatcacttgaggccaagagttgaagaccagcctggccaagatgacaaaaccacaactctactaaaaatacaaaaattacctgggtgtggtacatgcctgtaatcctagctcctctggaggctgaggcatgagaatagcttgaacctgaaaggcagaggttacagtgagccgagattgtgccactgcacgctagactgggtgacagagcaacactcagtctcaaaaaaaataaaaaagtgaggcacatttcttcttttcctgcccattaaaactttcccttttactatatctggaggcagctaggtacactcttaaaggagccaggattaaatcaagcacatgaaatccaaattctggtcctgtaaatacaaatgtccagccactgattgaccagctattatatgcacaacactatgttaggtgcctcctgcaccttttcccatttgattccctaaactctcaatgaatacattacttctgtgtcttacagataaggtcacaagcagcagtctgcagagcccatattcaaaaccaaatccttctaaaatcaaaaaccaggctgactcccctggatgctattctaaagtcaaatttcaaattatactttgttttctacagtgtgagttgtgaaaagtagtacaaattcactgtgattaccactagcatgttgaaagataacattttatgggtaaaataagtacttattgctttaaaatgatagccacagatatcatccaggcattaagtttatatctacagagagtgttcatacaaaacttacgtatatatctactgatggtgttcatataaaacttgacctttccatccattcagtctttatctcttcacatatacctttgtatttgcttaaagactactttgtctatttagcaactcaacttttggttcattggagctagaattttcacctgtatctctacaaatctatattaattttatttcaaaatgactgtttttgatttgttttcccagatcttacagtatgctccattggaactagacttctaaatcatagagaaatctatttcttaaatgacatcaatctaagatccaccaaaatgttaaccctatgagggcagttctgtgttctgttcattgtttatcgcacacctagaatggctctttacatctatgggagctactcagcaaatacttgttcaatgattgagtgaatctagtccatctattttgactacataaattaattatttgataattatatttcaactatttaactaacagttaaatatttacatttcaactatttacatgtttgaactattcacaggaaaatgctatgaccaatttcttttcttgtagcctttcttttcaggagactaaaacttcaatgcatgcaatgctaatttgttgtcagcctcatgacatcttaaataaagaaaaccctctttatcctggggtggtttggatgaacttagcggaatgctcaaaaactaaaggtgaaccaaaaagaaggaagtcaatatagttcaggaagctccctcctcctgttggccttatttcgattcttctagggctatttacacgtagccaaataccccagaatttaaaattaaagcctttggaatgtctggcagaaagaatatattctagaagtaaaacctcagacttagattcttttgactgtttggcatcattattttgaatttgcaatgtgaatgagaaacaaacaaatgaaaaagataaagtaaaagaaaaccctcaatttcaaagttgcacatatttgtcattatttaaaaagaagagtacatgttaaaggcctaaatattttaaataaacattttctaccacaaaagatagcattttatcataaaattggcaatttttagaccattgaacttaatttgaatggactaaactttgtctcttggcaaccagaatccacacaaattggtaggcactttctctggaggaagatcatgcttctcaatacttatgaactccaagctaaaggctggctttactactgaaaacatcacaaagttaagccaccagtatagacaggaaggattttaagtttctattttctcttgtttgtgtgtgtgttcaattaattttaaagaaataacagtgagattcagatttcttaaaaatattttttaggacattattaatagctcaaataaagccattaatacatgcacgttatgatgatcaagtgatcctggttaaaattaagggaaaggtacactttaaaaatatgatttaaaaagcccccccagtcacttaacttcagaagcagggcccggtagcccaccctgtccttggtttttaacatagaaattaaggtggtagcttcggcaggtgttattaccaggggctcatgagtagaccctaaaaggtttgtgaaccctcttaggattatgtgcagcgtttcacatggatgggcacatatgcatttccctggggtaaaaggcatctgattctcaaaggagatatcaacaaaattgatgagaaattttggtgtagggaaaagtacgtaagaccaacatttaggaattctgggttttaattgtaataaggtgcttaccagttatataattgtaggcgaatcatttctctgggccccagttacttcatctgtggttactgtgggccccagttacttcactgtggttccacacttgtgggttgcgataactgcaactccaaagagtagttgtgggtctgtgaatccataagtgtaccaagtttcatctatggattgacaatctatcatatgtgtgtgtgtgtgtgtgtatatatatatatatatatgtatatatgtatatatatatatgtactattaattcataatgagtggtgatgttactgtgatttacaagaacacaaaagcattttaaaatatccttaaatttattgtagtttttggtcactacatgttttctgaatcaatcactgataaaatgacaattataagttttgccaaaacacattggaaggactagttcaaacaattctaagctgtgtccagctcaataagtgtaatgtttagatattttattaaatattccaaacgtgggtctgtgattttatgttttaatttataagtttctgtgtaacatataccaacatatttttaaaatgtacactgtttgttatcagtgcagtaaatggatagtaagaaatatggatgaaatttttttcccttattggtttgtacctatgtgtatgtgtatatacacacacacacacacacacacacacacacacacacactcaagagtttatttctttggtactttggctgctgaatatgagatttagttttagacaattttaagttgataacattgctctttctctcaccaaaaaagtggtcaagtaaattgacatatctaaattcaaattcatcatgtgaaattggaataataataaccaaatcatggcactactgttgctcaaaaattagagcctacaatctacctctgataggtccttggttctggcttattggtcagcctgcactcccatggataggtgtacccaactaagactaaagaaagttcttcaattatcatttaaagaaaattatttattaaactattaaactagttaaatattaataagcccaataataaaaatatgctttgtaaagcaagatttaaacaattaacaacatacaatttacttttcatctttattattaaacatgaatgaaatacataaattaaaaatacatttaatatgtttaattgggaaatttagtttttcatatttaaactatcctatatatatccaaaagcaagataaaaactctaaggcaattctaatttatcatgaaaagcttttgttcagtctaatggcctatttaatactaacgaaaagtccggcaacagaatttgggtttcttaatgttcctttacatgactaagcattttgtgttattattcaaaggtattttattatcttgtaaacttaagtttatgtttgtcaatgagacccccaaattcttcatttttaaaataggtaacaatatgaaattaaatgcatttattacttattagtgaagctctatatgtggcttctaattacatatgaatagtttggtcaagagaggcctcaaaaaaatgagaacaagttttcccagttcatctggactgaatcactatatgcataagtgatacatgttttattctcaaacacttgggttttgtttaagcacaccaaggattctagtttggctgtttcccaagtttgctttaaagtaagattattggatcagactggtgtttcaaagaaataaatcaaaatgtacacagtcaaatttgttaggcagaaaaaaactgtcatctctccaaacgttttttggtgcctatgtttctcaagctcaaagaaaataagacatgccaaaaaaggagcatctgtcttaatgtaagtaaagaaaagtgataaaaaataatttgtgctgggtgcagtgacctgtaataccaatgacttgggaggcggaagagaaaggattgcttgaggacaggagattgagaccaacctgagcagcatagtgagacccagtgttcaccaaaattaaaaaaaaaaaattagtttggcatagtgaagaatgcctgtagtcccagctactcaggaggctgaggcaggacaattgcttgagctcaggagctggaggctgcaatgagctgtgtttgtaccactgtattccagcccgggcaacagaagtaacatcccatctctaataaatacataaataagtaagtaaattatctgatgcattattcaaggaaaaaaggaaagcaacttttatcatgtggccctcaaatacaactttacctcatattgccaacttctttgtttttttgagatgggagtttcgctcttgttgcctaggctggagtgcaatggtgagatcactgcaacctcactgcaacctctggttgctcactgcaacctctgcctcctgggttcaagcaattctcctgcctcagcttcctgagtagctgggattacaggcatccgccaccacgcccagctaattttttgtatttttagtagagatggggtttcactatgttggccaggctggtctcaaattcctgacctcaggcaatccacccaccttggcctccaacagtgctgggattacaggcatgaatgagtcaccacactcggcctcatattgccaactccttaatggtagagaacaaaagtaaatagatttatgaaccatttcaattctagatgaagggaagtgtagtaggtctttctttaaaaaaaaatgggagattgtagttgctgattttattatttctagaggtggaaagtatacaaagcatgctttatacaattatattttatatacaggtatataaaaatggaggacattcttttaatgagagtttttttaaatgctattatatgtgctataggtaaatacatgactattttcaaatgaaaagcttaaaacttctcctgaaaataattcagtgtcatttttagtgattctccaatgagtttcaaatactatatgctatctgaaaagcattacaaataaaacacttcatcttacttattcaacaaatattttatgtactttgccagtcactgtaatattgagttctgattatgctacataattgagtaaaatatataccactttaaggaatatgcataaaaatgagagaaatgactttattaacacctaaccatgcaaaattaaaatgaacacaaagatagagaaagcatattgaaagaaccaaagtaaaaaaaaaaaatcatcctaattagagagattaaggaaggtgcaaacagacactagcctttgatctgggtcccattgataagtacaatgtaaacaggcaaagaagaaaccaaaagcagggctggaaaaccatgttgaggaactagcatgagcaaagacagagacttgtgaatttctagccccacacagggctctaaaagagataaaatacagttgttattgttgttgtttttcctttgtaccggctctatatcataaactgagaattattttattgtggatgatgtcacatctcaccttatttcttatttatattgccatttgttatttctgtatatgaagaaagtgggctgaaatatttttgaggctttttcatggttcacctttgaactaaaatgatagtattatttatatcttcgctactgtctctgatatataaacacattatatatgtcatgaaaacacactgcatggttcatcaattaagatatcctaatatttgatctcatctattaggagaaagagtagcaattgagtgcatccataaataaaataaacctgactgtttttaagattgacccgtctcatcaaagactaaaacacataaaaccagagtcagcaaggatgtagggaaggaagtctcacaaagttttattgggtgtatagaccagcatgggattactgagtttatagttcaacaatccatttcaaaaacctccctgttttctattttttatcttttgatacaacagctaaataatgaaatttcaaaggaacatgtaaatgttttggtttgagtattatacttctgacaatttatcctgacataataaatttggatgcacaaattaaaaagaatcttatgttagtatatataaacacaaatatttggaaattacataaatgcctaacaacagtttattggctaaaaaagttataatcatataataacacactatgcagctatcaaaacttacagtgtatatgcacatagttagctagtgatatggaaattttcataatatgtgtaagtgatgcttagcctagttcctcatatatagtgagcacttaatccagtttagttattatatctgctgttgtgtctgttattaataagatgttatataaatatataaaaaataagcaggttttatatctgtaaatacagaatggtcacagagagataaatagctatatatgtaacaacttattaagagttgtcatatttaggacatgatattttggtaatttaaaaatcattttttatgaataagaaggggttctgtagacattttccaaggttaccaatatttctatatcacattggctcacttcaaattaaaattcactctagacaaaacagtgtaacatggaagcttcagttccctgttgattcattaaataaagtctctaatgtttgatgttgccgaaatgcctggtaggatttcattaaagaccgcctaaactgtaaacattttatttgaaattagttatcttctctccttgacccacatatctctaaatcatgtgtatgaccttttaaaaaatcaattttatttggaaaacacactatctgagattcttttaaatcatctcagagacaagtcttccaaatgggcaattcagaaaggtcactcataagtaatttacatttaaactttatattactttctatcttttaataaactccaaaaaattgagaggttttcagaaaatacctcaggtctgcaattcaaatatttggggcattttttttttttttttttttgctaagcatatgtttgatttgccagtggaacagaattgtgttatccttctcctcaagtaacatctaactaagtgcagagttcataattaaaaaataataataacagcaatgaaggtgtaagtgaaagtacataagctggagttcctctattggtgaaaggtctttgctgcatcagctgggactctcctgacttactgttcattgctaaacttcaaactgatgtattgagaccaaattaaaagcaatctcaactgctcatatattctatcttatctctcaaaatctatgaatgtgctactctttggacagatttcttcaatttttaaaagtttaaatactttcagtagtgttctcaatttatcactccatgtcacatattcaatttagtcttacttgtaagacctatttcgtttgagtcgtaaatcaatctaacaccacacaattgcataagtcaacttttactatcttaattctatccattacttactgctgctctagattcaaatcaatgaaaccaagaaatcacacatgtttgagaatgttacttaattcattcatttgctttcacataggctacctaaatcactccaaggggtaaaaataaagtatcttttaaaatattctgcagataataaaattactcctttcttcagtaaagggcttggaacatctcttacatatgtttgacactgaaggaaatataaaagtgaaccagacctgggcctattaaaattaaaacttaccctaagaaactagcaaaaagaaaagtacttttaaggacagataataagatctgtctttatcttgctgataattttctttctttgtaaaagggattcaacatcataaaagtaaaaagaaaaaaaaagcaaacaaaaaatcttcatttcacactgccacacaactcacttctctaatttttactattttgataagtcacaatcatcaaaacaattactagaggccttcttcttgattcctgtattggtcttttaatacagaaagattttcaagctgtgatctctattttttgataatagagttcacaatgagctctaagaatgtgtcaaactgtcaattgatttcaaagataacctaacaaggttaataactcttatcttccggatgataacctaataactaagtattgcacatctttagtgcccaaagctgctctatttgtcatgttatttttcaggaaaatacaaatggctattcaaaatttacatgatgcatttgcaccaggtgagggttaaatcataccaggacccaatgctgaaataaaaaatttgaataatttaagtgaaaagagactcaagtcaccacataacatggtgaggtagaagcacgatgaatgcaaaagtatatccagtactacattcagttgtacatcgtgatttaatttcagaaagataacatcctcaatcacattaacttaatgattttatttgaattttattttattttaattgtattcaaaccttatttgaaaatttgctctggtcttataattgaatatacattataaatattagggtctaattcataatgcaatggttttatattttaaatattattataataaaaatgcataagttagtggcaggatttcaggcaaatgtttttcttttaaaaggagttgaaagttaagtctgaaaaacactggactatagaaacaggccgtcaatagacaataaggtttgccaaattctatgatctaaagctttcgtgaagcaacaggaaagggcaaattaatacctgtcaattgcctactgtgggcctattatatctcaagcactgtgctaggtactgttgtgattagcaatttcatttaattctcacatgaacactataaatctgctatcaaactgttaatgtccccataccatgggagaaaaattaggacatataaggatttggtgacttcaccaagctttcaacttcactaacaacaaagctgagatttttagaccctgattttagttttctccacaaccccatgttctcttccaaagcaattgtgttggctgtcaattttcaggttagaaagtgacaaaaataaaaggaatgtataaggtgacaagaatgtttagaatagtgaagaaagatcacatagatgaagacaaaaaaatagtgtgtgtatgtgtgtgtgtgtataatttatatataaataaaaatcatcactcttccaattactgacttcctattttgcatataaggaaatgaggctgagcaagttacattgctaaaaaggggcagagaaggaatgatcaatcttgcttgcttaggcccaaaggtagtgccctagttaatatgagcaactgtgattctaaatagagatttctttaggaaaatccatgagcaaggtgtaaacttcccccattaggaagagtgtgatggtcaaaagtccctcactacaacaaaaggcagcttggcacaggataagactcgtgttccagcctcactccttcaacggatgaatgaaaagggaaatactctttttgaagaccttcaaaggaatacatattttacaggatggatatccttcatttataaaccacacattttaggttgttcatatattatttcccgttaattatattttttgttaaaagatttttaaaaagatacagtcaaacatttctgaaaagagaatattgcctcattagtacagaatttatttggggtaacactaattaaaaattaaactaaatacaatcccaactaatcctagtccctttgacaacatttagatgacatcaagaataaatctattttaatgcttttgtcacatattattctacaaagtaaatcccacagttcatttttctaattattaatagagagccaagaggagaagctgatgattaatggagtcaggtacaagactacaggcaggtgtgaaaagtgtgtcagaaagacttgcgctcagatcttgtctcagccaacagcagctatgtgacttgatcaagataattaaattccctaagatttaggttgctaatctgactagcatcttccttgcaggatggttgtaagagatttaaaataacaacataaatatttaaataaaggcctagaattggcaagaagtcaatgtatggtgagtattattattagccagatgaccatattgttttaagcctaagtgaaaacttaacaaataaaaacatttattaaaggaaaaaagaggtttgactattaggccaataccagtaagatttatctgggtcatcaagctttttctcattataatctctcatactttcttctgtttactagtatgtttactactatgtcaaataaagaaaagctgtgaaaacatggaaaacaatgtgaaataaagtatcttttaacataaaccaaggaaagctgataaaactaaacaagacacatggtaagaacaaatacttgatatgaaggatggaaatattaattggataaaaagctaagtttaaaatacctacctgtaatatttttaaactgataactttaaacagtcattatgaacgttaataaaaatatcattaacccatttattcataaacaaacaccaagatataagggcattgaaaaagcccaatcactttaccctttcagttagttttgtttggaccaattgaaatattaaaattgaacagcccaacattgagaaaggagcaaagcctggacatagtttatgaaatagtaatcactttgaatgctaatggtattttaggcttagctgttttagtttttgaagtataggaagtggaggatggaaagattagaagctggaagattcccaaagagaagttccaatattggctatggtataatttacaatttattatagaacaaataagtagcattgttgagagtaatttaaaaaaactcactacaactcaaagtgatctataacaagttcatttgagtctggaatctttaagaaaggtgagtattgagcttaatttgagctcagagggaccaactgggtttgaccttaacatgtggaaatgttctcatcatttcttggataaaacatgctaccacatatactggcgtttatggtacttaaagtcaaataaatagtaaatgatattagtaatgatattctctgtatagagtatgaaaaacttatagtttgagaagtagataaagtaatacagtatttatatttgctttacttgtcttctttcaacatttataatgactttgaaatctgacagatttctcattttctaaacaatgacaacacagccttcatcctttctgctaacaatttgcatagcttcatttatcagtagtattataacatattaaccaaataagaacaattatagtaaagtttctcttacccagcattcacatggctggatatttacacaaaatacagtcttttaactagaaggaaacaaaatgtttccaaacaaattctgtaacacaagtttgttggactctgcatgtctttttcaagagagtccaccaggccctcaaatacagtagaggatcttttattttatagacaaattttaaagcaaattcagtcctccagtttccaagatgactgcagaatagaagcagaaaattagaagaggtgtttgttatattcacatactaatacctgtgagcaaagccagtggatatgtgggcaaacaggagaagtaatgcatgaaattgtatctcacactatcactgtcattttctaaagaggcaaacagttgtaatgattcaataactttagatagcacagttgaattaaaataaaatgtgattacaaatattcataatgagcatgatgcctagagctgaaaataatgtattatatacttgaaaattgctataagattagatcttaaatattctcacgaccaacaaggaaaatgattatgtgaggtgatggatatgtcaattaacttgatttattcatttcacaatgtgtacatatatcaatatatcaaaacatcatgttatacactaaatacataaaattttatttgtcagttgtatgtcaagaaagctgggaggaaccaaatatttataatgagaagtgtgctggataagaagctcttagccttatcacattttactcctcttaggaagagaagaaagtatttagtatgactttgatttttgtgttttaaagcaatacattgttattttaaatgggagagacatcttttatatttttcatacacgaaggactatatatccattatttagaaaatttacttaagaaacagagcctgacattcaacaagaaaaagaaaaagataattattgggtctgtatttagtgttaaacattgtactaattctttttatatacttttaattcgcacaatatttttatgaggtattacttcattttttttttttaaagaagaaggtacaccccagagaagtcaagtaatttgtataaagttacatattcagcaagcagtagaaccaaatccagtcattctcattcactgggtcctctgcacaaacactgtttatctactcactgtcttctcatctcacctccacataacagggttcaagtaaaagtaggtcattcatttgaatgtctttttttaacgaatattaaaattggattatgtttttacatctatatatcagcaccaaatttagaaaagcttacatatatttttgatttcctaagttatataaggtttgcatctttcaagatggtatcaaacaaactgtctccattaacatgttccaggatggattctagtccatattctcttttctctccataactgtgaatttgtactgttttctgcactactgatatttgcctaaaatgttcttgattgcagtatattttaaattcacaattgctctattttttatcttctgcaataattttcctttttctttgcatattctatatttttagtttatgactaattcatctgtggatgactcaagaattctgttttattctggcacatctgaaataatttctcttctcttgagatcaccaaatatatattcaaattttattctctaaatttcaccactgaaggcctaattgtttactcaattttgttttgtttttaactaccagaactttggtacccggtgtgcttactttaaaataatacttttataatgcaaaataatttttaatcaagtgatacaagggtgcccacattaatcatattttcatgaaacccaaacataccagatgcaccaacattatcctatcatggctcctgaagataacagtagagaaaaataggccaaatgaagcaaaaaacttttaaaagttgtaatgtgtgtattttagctgcatatgtgggcaacaaaggaagaaatcatgatcatttttctttagtaattctcacttggccttttaacgatatttaccggataactccatgtacagcattatcctaaaccaagtagctcacattttaaaaacagataagcgaacacaacactagattagaataataattccaatatgattagaataataatattctaatacgtatgtgtgcgcgtgtttggcgaaacaatatgagcacacctgacatttagtacataatgaataaacaaatgttgagaaatagaaaagggaaagaagtacctgatgtctaaaaaaaacttctattaagaagtagtagcttcctagttgaaaaaataagtcagaggagcattgcaaacaatggctaaaagtacagaagtgagaagcagcagaccatgtgcaaataactgtacataggctggggtggcagtagttgaaagatcaaagtatataacatgaagagtgaagaattcagtaataaaaggaatcagattgtagaatgtcttttatattatgtgttatcttgctcaaatatcattcaatgaagcttactgatttctctcacaccttagtggcctagttttaaacgtcagggttcttaacacaaaattaaatacgcctgcccaaatgaatcagattcagtcttctattagtgcccaggccttaggtgatatattccataactctgaagaagaaaccaattttaattttctttgtgttctagcatctatttgcaacattatttaagtggcccatttttttcctgatttgaaatcatctcacatagtgtgatctcatcccaggttcatggttttttttttttttggaagaccttttaaaagcaattcagcctccagggacaattttttttttctttttttctttttttcttttttttgtcatttgcttggggaaaagaagactttttaatgggaatggtgatgggagaaagcgctcccattatacagttttatcttttgaacaataatgtcttactactcaaaattaatataaaaaataaaactgaaatttaataaaaataaatacagataatcctaatatgatgcaaaatagtaacatatggaaaatttaatggaacattaaattccataaacatatggaaaaaataattcaagtaactctgaaatacatcatgttgactataaacctatggaaagtatagcataaaaataaaaactgaaaaaatattgaactttgattagttgatttcccgataatagtcttggtgatgcaattctgaagctactctgagtatattgaaaaaaagtgactaaacgtacatattttgataaataagaatattcactatagaaacagagaaatacaaatatcaaatggcagaagatgagaaacaaaaccttgtaatgctgaatttcatttgaggcaatcagtatgaacacacttacatgtgcactcatatgtgacaatgtgttaagtgcatacgcacagttttccccctaactctatcatcaaaagggccaaagcacaatgaaacaaccaagaggcaataaacactccaaacttagatctttgtttctaaacaaagatcttttatactaattttaattagtataagtcattttatactaataagaagcaaagtttttctgaaaattgcttatttcatactgaggcaaataaaagtacaaggtgagcctgaagcaccttaatgtgccagaaaataaagaaatgctcaaagtctaatggggacatgtgaaaaagacacagaggtcagtttaaaggcgaccccattaacaaaactggaacactctgaatatcaaaaataatcatgaaactaatggaacataacacatttgaacttaaagaaataagccatatatatacataataatgagagagagaaagagaagaggagaagagaagaggggagaagaggagaagagacgagaataggggagaagaggggagaagagaagagaagagaagaggggaggggagaggaggggagaggaggggagaggaggggagaggagagaggaggggagaggaggaggaggagagaggaggaggaggagaggaggagaggaggagagggaaggggaggggaggggagggaaagcgggaaaaagcttccttacaaaaaagaatgccaactgtaaatgtagaacaactatagtcaattatttggcctaacaaatgttagggaacataatataaattttaattttacaaagtttaaaaattcctttacaatggagatatttgatggtcagaatcttaaccaaataatggcacatatatacctactgatgcgatgatgtgggagacatacaacatcaccaatagcatattcttgcttgaaatcttaggtgtaagtttatctcattagaagataggcctttctatactataagatattctgcaggacaacggaccaggacttttcaaataattcaatgttacacaaaaaaattcacatgaggaagacagttgcttcatgaagggtgactaggaagaaataatgcaaatatatacaccttaattggattttagacataaaaacaaaaacaaaacacagaaatgcaaagacaaagcataaaacacagccataaaggacatcttttagataactggggaaatttgtatggcctgtgtataatgatagtaaattaatgttgacttgtgctgtaagtattctcaggctgtgtcagaaaattttatcattctgaaaatatacacattttaatatttattgatgaaatgtcatgacatttatagtgtattttcaaatgatttggcaagagggaagtgtgtggtaagatgttaacaaatggtgagcttggtgagggatatatgagtatatattgtaccattctttcaacttttctagtgtaatttgtctgtttcaaactaaaaacaaatagaacagcaggaaatacaatttgacgagtctcattcatcctaaatcccagataagtgcatccattccttcttctgggcatgaaaattgcagtggggactggcttcctgcttcctgccaacaccagtttctagtctgatggccctcaaaggttttcctaaaattatatattcataaattaaacataagcctctcacacaagaatactttcaatggttctattgccctatgggaaaacttttaagcttagtaaagcatttaagagctttcatttgataatataatgacctagatttgtcattttccctgtaaaatgacagtgtttaaattaaaaaaaaaatgggacacaactgaagtttgaaattaccttgaagttttgagttgaattgattttaacaatattttatttgcttttatagaacctcaacaaatatgttttaacatcattgttatctcagatctatcacttttattttgttctaataaactacaggatacaaagtagaatgccagaccaaaagttttggaacacaacatctatcaagcaagcaacttcaattgttcccccaatatggcaccatttctttattccttccaatcccctaggaagcccaaggacaagtggtcccatatgagtacattattgctgttgttattaataactgttgttactctgaggcttagagagattaactgatgaactctgcctaacagggcttcatataggtgtcgttaggaaagaaccactgaactctaagaccaacattatgtcttctgtcatgtgttaggcaattccttttgatgtctatgcagttttacaatttaaagtagtcatttaatcaaacataactttcatttgtgaagactgtattccagaacatttctccagacatctagaaatcatcacaaaatttatccaagtctctcttctatacattagcttcacaattagcagcaatcagataatctttttcagataatcattttcaccatttcttctacatagaaatgctcccaattctgaaatgtgaaagtctaggtctgactgtaatggctaattttctattgtacatatctatggaagcatattgctgctactcactcataacattccaaaacaaaaacaaagcttatggtcctctcctaaaaattcgccttcttctgtaatttccttataagttaatgatgtacaccaagctcccaagtgggaactcttgatgccttgtaggactttaccctttccttcccaccagcaacaaaaagtagttttagtataggagaaatagcaaaagaacaggagttgatcttaataacattgaatttgcttttacctcaacatataggtttcaatatcattcatatatccagatttctctctttttgttctaataaactacagtatgcaatgtagaggtccatatataggggtcttggcatccatagctacaaattcacattttcactacatgttcaaccaaccgagcacagacccttaatagttttggccctcagttttgtttctcttttctgaaatggagatgtctagccttacctcgagaagttgtaaatagtaaacatgaataatcagtgtcaaatgcttggcactttaatagtgtttggcagcaaatagatgatcctaaagttgtgttgcctaaagcgagatgcatttgagctgcatcttgaaggataagttggttgttgctatgacctcatgaaaggactttattaggcgggggaaatgagaattttactctgaaagaataaatgatgtagacgcaaacaggctaaacttgaagccagaaaaatagagagaagccagattataaggaatttcctatgacaaactaaggagtttggatgctagagaaccaataaatgttcataagtaagagagaaacataatggagctttgtgtgtgtgcatgagtgtgtttgggtcacagtgggagaattaaatagttgttaaattattcctttattttattgaatatattccaagtttaaaacatgatattttgatatatatatttacatagtaaaatgattactatagccaagctaataacatatccatcatctcatatagttaccctttgtgtgtgtatggcaaaattacctaaaacctacgtgccttttttttcaaatttctggtttatgactcaattttattaactataattctcatgcagtacattagatctccagataacctgtttttttaaagaaagacagttgtgtgcagcttataaaaaatacactggattacaaagggcttaaaacaaacactgaaattcaccaggatgcttaaaatttgtcaattatccagctatgacaaaaccaccgccaacaatatactgaatcagcaaagcctggaaatatccccctagagaactagaacaagacaaggattcccagtctcaccaatcatattcaatacagaatggagtgctagctagagcaacaaggcaacagagaaaaataaaaggcatccaaataagaaaataagaactcaaactattattctttgtggatgagatgatcctatgtctagaaaaccataaagactccaccaaacggctcctgggactgataaataacttcagtaaagtttcaggatacaaaatcactgtacaaaaatcaggaacatttttacacatgaataacattcaagctgaaatccaaatcaagaatgcaatttcatttacaatagacacacacacacatacacacacacacacacacatacacacaaaatgcctaggaatacatctaaccaaggaggtgaaagacctctacagggacaactacttcaaaacactgttaaaagaaatcatagatgacacaaaacaaatgaaaaaacatttcatgttcattaattaaaagaataaatattattaaaatggacatactgctcaaagcaatctatagattcaatgttactcttatcaaattaccaatgtcatttttcacagaactagaaaaatgtaatgtagcattcatatggaacaaaaaaagagcctgaatacccaaagcaactctaaccaaaaagaacaaagccagatacatcacatcttctgacttcaaactatactacaatgctacagtaaccaaaacagcatggtacttgtacaaacacagggagatagaccaacggaacagaactcagaaataaagctgcacacctacaaccatctaatcttcaacaaaattgacaaaaataagcaatcaggtaaggaatgtctattcaatcaatgttgctggatcagctggctagccatatgcaaaagaatgaaactggactcctaccttttaccatattcaaaaattaaccaagattgtttaaagatttaaatgtaagacctcaaactataaggatcctagaaaaaagcctagaacaaaccgttctggacatcaaacttgggaaagaatttatgactaagtccttaaaaacaattgcaacaaaaacaaaaattgacaagtcagatctagttaaacaaaagagcttctgcacaacaaaagaaatgatcaaccaagtaaacagacagcctgtcagaatggaagaaaatatctacaaactatgcatctgacaaaagtctagtatccagaagctataaggaatgtaaacagttcaacaagcataaatgaataaccccattaaaaagtgagtgaatgacattaacagacactcctaaaaagaaaacatacaagaggccaacaaacatgaaaaaaattatcatcgctaatcttcagagaaatgcaactcaaaatcacaaagagatgtcatctcataccagttagaactgctattattaaaaagtcaaaaagcaaaagatgctggcaaggatgcagagaaaaggcaattattatatactgtcggtgagaatggaaattagttcagccactgtggaaagcagtttggtgatttctcaaagaactttaaacagagctatcattcgacctagccctcccattactaggtatatatccaaaacaaaaccaatctttctacccaaaagacatatgcacttgaatgttctttgcatcactattcacactagcaaagatatagaatcaatccaggtgcccattaaaattatgttctttgcagcatcatggatgcagctagatgctattatcctaagcaaattaatgcaaacagagaaaatcaaatattgcatgttttcacttacaagtaggagctaaacattgagtacccactgacataacgatggcgataatagaaacagaggactactagagtaggggtgaatgggagaaacagttgaaaaattttctatgtcctctcttctggatctgtccatgcaaagtaatcaattattttagagaccaaattacgttttgcgtttttgacattttcagaaattctttcttttgtgggggttacttattcaatctggcctccctacagggttcagggagaaaatgagaacaggatggcattcacattactgacagaacaccagtcaatgaaacattatctcctggagccattctctaactgctttattatttttgtgctttaatcaatgagaatgtttacctatggggaaaatctttgcataggtagactcactgaggaatctaacaagtctatcagtagaaagctttttggctttaaaaatggattgaacatattgaattttttaaacaaagaactaggaaacatattagagaccaaatttttaataatgtaagtaaatgagaggttgcaatgagaattgtgaaaaaaaagattcccttttactgtatcacttattaggcctcacatgacttaaataatttccccattttatcctacctcctgcattaatattttgctgttcttgcatgttaatgtttatagaaatttctattttggtatgctcatttttttctgttgaaatatttgctgagttaactctggttactttaaacaacatttccaaaaagcatatttacttgcctgccaatgccttccacatagggataaatgcaaaatcctcactaggacaataaagtcacccacaagcttcacctcctgactcaaatgttgtacttacaaatacacatcatggaggtttaggtacctaaaacgtgttctttttaccattgcgtccttgcattgttagttttttttttttccctattatccctctctaatctttgcctggtgaactcattattcaaacaccatctctggctttaagtattatatttgctaactacccacttatctgttggtatagatttagttgattaataaaataatataatccattatgactggaagaaataatccactttactgggttggggaagaggggtcaccagggcttctctcccctttttgaacaaccttgttcagagctaaaggaaaagcagtaaataaatatctactatgtttaaagttcaagaagtcttatcatctttcctcatactactattaataatataaataatttccacagtgtaaagatgtcccttggaaacaactgtttacttgtaagaacaagctctggagtcagaagtcgcaaattggatagtgtagcggttggctttcaaatgtgatgagcagaaacagagctttcatggaaatgcctgagaggtgattgggagagtggcaggaaaatggaggccaaaaggataggtggaggagaagggaggggagcttgggacaacctaacctaatctcagccagagaagtcccgattttatctgttttacatattggctttctgtatgaccgtccttttcttaaaagaaagaaaacaaaaaagctgcttttctgtatgttaattgaaaactactggtataaacattcttactgcccatattagtgttttaaagcattaagaactttattctgcaattaatgaatcagctattggtattcaaaccagtttgagtcaggtgcaggttcctttaattaagctcccagtgtggttcacaaaagacaggtggctacagtttcactgctttgctcaaggatggcatgctgctttcagtttccactgttatctaatgactagaaataaatttttaccaacgatactgaaaaatgaaatggtcacattatatccttcttttacacctttatgaaattcacctaacagaagaaagcattatgtttcccagttaacttaggtctaacctggcgaaatgcaagggttcaagtttgagaattcataaaattcgtagaagttttatgacggtacatggagatcattcctgttttcctgtattctgtccagctaacatgcacacaccctttttattttcattgttagaaataaactaatttccaaaagaaaatatgaaatcaagaaagctattgctctcctattatgtgcaaatattagtttccaaagaaataaagttaattatgaaaacaattcaaaatgcacaataaaaggataagatatggacctaagaaagtaatacaaataaggaagaagagcaattaaaggcaagtgcaaataaagtaatacaagagcagaaatgaagagcaattgtgttcaaaagaggcaacagatgagaaacaaaaaatggtcacttcctaattttacatctggaaagatattactgtgtgccccaactaaacatgaagcccagaatggcttgctttgtttcctctttactgtctagatagaaggttgatgtgcagatacttgattttctgattgtgctctgaagccactcccctagatgaacaagcagtttctgaccactaagagtaggattatgtaataaaagtacagtgcctaaggcatcaaaccctgattttagtccaggtgttgtccagagggagccaactttgtttcaccatgagctcacattcttccaattgtttcacctttattgttgtgctcttctacttttgtgctcccacagctctggatatcttccatcaatagaatcctcacactatactgcacttgcctgttcagtatgtctctttcattactgtaattcttatgaaggcaatacattgttctacttgattcccattacatacccattgtgtgtcgttttgaaatacagtaggtatactaaatatttgttaagtgaacatattttaccataaaacatacaaccatgaaatattatcctagttgaagaaacacttcaagtaattgaccagattaatgattgagactgaggcagtgttccatgggcaatttatgaagtaagagtttagttgttaaaatataccaaatgtaaaaataataacgcatagatttttaaagaaagttaaagcaaaacgtaaggaaatctttgaaatatattattttgaacattattatgaatgcataaaaagtgttatctacaaagatactcattgcaatatttttaaatagcaaaaactttattcaatacccatactatacaataagaatacaatcattagaaacagtattttaggagccaaaaatgatatatacatcaatgtaatcaatatgcaatacttttattttttcaggtggggtcttgctctgttgcccaggctggagtgcagtggcacagtctcagctcactgcaacctctggctcctgggctcaagtgattatcctgcctcaacctcccgagtagctgggactacaggtacatgccaccaagcctggctaatttttttttttttttttgtattttagtagaggtggggtttcaccgtgttagccaggatggtctcgatctcctgacctcgtgatccgcctgcctcagcctcccaaagtgctgggattacaggcgtgagccaccacgcccggccgaatttccttgttatctattagacaccattaagggcaactactctttattatttacattttgtatctgtgtttagaaaaataccaggaatatgttctatgctgtactgttaattgaaaaaaaataggtaaatgaaaatatttctaaacagaacctattaagagatatttgtgagataagtgtgtgtgtgtgtgtgtgtgtgtgtgtgtaacatatgcacagagagggaaataagtcaaaaagagcaagacaataccaatggtattctctgggaaaattttagtttttgttttcactcagaaataccttcttaaatttttgcactaaaatgttaatgataagaataaaaaaaaacagaactagaaataatgtgaaaactattgaaaataatacaagtttctataaagtgagatgctttgacatgtgacaattcattattagaatggcaaaaagaagtgcaagactaagaaattagaaaaaatacttcaaaaagctgtcagggagtcctcccagatattccaaaatattatcctctccttattgcaagaaaacgctctccttctgtcattatttgctgtgagagtagctacccaaaaagctattttgtagcaaaaccagttttattgttatcattgaaaagaatttttgcctcacatgtctgacccaaattccagtgtgattctaattcacaggtttgtcgttaggatcaagggagatactacttgtgagagaaattgtaaatgtataaatgtataaatcaaatgcagttatactccagttttatgagaccatcagtgttgggaaaaaccaagactagaaaccagaaaatgaatttatttagcagagaaaaatcagtctaggaatttttacttgacaatttctttttctcaaatggcagattagagtgtgtgtgtgtgtgtgtatctgtgtgtgacagagagtatatgcattagtttttaaagcaatgaacagaggtctatgtatttcatttctgctatgcaggaaaaactgtgctgaattgaaacctgaaagagagtggttaacattttcagaatcaactccatttccagaacagtctctgcttttacaatgttttactgtaagaactatgaggtaagaacaaagattgaagtaaaagaaaattattctagggttaaatgggatattgacaaattagattttgggagatatgagaagttaaaggggaagaactttcgcataccgggaagctctgggcctccttgcaagtgtgcaggttatatggcctgtctgccactgagcctgctgaactctctattttgtgttggacggtaagagctgatgtgtcctgtgtttgcttttccaatttatcaatctcaacaatggctcatattattcccttgggttgacagttcaatagagaaagagcatagtatggtagacacagtgtgagttttcgttcagagaaatattgtctatttaacagaggagaaacagtagcaacttgcttatcccctctgagtctcagttttctttctataaattgtaaacaacaacgtctatagtgcaaggatgttgtgaggctaaagatattttaagtacaattgttggcacatattaagtgcataataaatgtcatcatagttactaatgactgattctggcatggatgtctgtttgcatgtgtatgtatgtgtgcaatgtgtatttatacattattaaagaaactatgcattacttcacttctcaagcacgggtttcattcagtctatttgcttttgactgctctatattgactgttctggtcactgttttgtttatgatacaaagaagatacttcaggcagaattatctttctgaaatgcagttctgttcctgccactcttctccatataactcatgtcccagccaacttctcaggtgtcagctctcagcaaagtctcgctctcttccaccatgtgcacatacaaacaaacacacacacacacacacacattgctataatgcacaatgttctctgcgttttctttaagctaactcacaccctgtccccatttcctgggatacccagtctctgccacttttctgaaaatctcctatacatctttcaggtttcctcactgaaacgtttttatgacttcctggactctctaatgtgcccatatagctctctgaacttccaactgttactcagtagcattgtatagattgtaatccctgttaattggtatgtctcatacactagcctgaaggctgcacaagagtggggtttttctccctctttcactgtctcattgctggtaaattgtagagtaaatggtattggtatgcattcaatgagtattggttgaatgttctgatgcaaaattcataccccaaaacgtaaagaaaaatttctaccattaacttctcagtaccgcctactacctcttgtaaattccatagtaagttaaaaaggtgaatgcagaaagagagcttttttttttaatccccaggaatgctaatgtggaaagtcacagggtttttgatgatgtcagtatttttatttttctctcaatatgtatgtatagaggaaatcaaacaatgggtatccattttaaaaataaatcagaacaatttattttcagccttgggcaatcatttccatttcttaaatgagaaaaaaagagaaaataaaacaggaacagatgtctatttccatccattatcccataattgtttttatctgtaaaacatcttctaaaaggaatatagagaagacagtaagaaaaataaaaatttaatagttattatatttgagcgtttggataatggaggattttcccctctcttttctaaactttctataatgttaaactatctttaatgcaatgaataaaatgaatagagagtgaagaaagcaatcatgtttctgaattaccttcatttatccttctgcaaagatagtgaaataaaaaccctgatgttctagatcaaatttattgcagcctattacagtaccttgcaatttgtaagactcgtgtttattgtttgcggattgagggttttgaggaaagagaaaggatcaagacacaattatcaacattccactttttaaaaattcatgcattcattgtagtgtatacacatctacacacacttatatgcatacacacacatctatgccagtagattaaaatcccataccatagaattgggcaggtaataggctctcagaataagacctggagaatgactaatttgtttctttaaatttcaacagcctactttatcatgtttttttctttcttaagtcagtatcttcaaagaagcaaaagaaggtacacgaagcagaaatgtaagccaaatatatacactctgatggcctgttaaagtcacataggctgacctcttctaaactataaaaccacatgagcctccaccttcatttgtttcctctgtccttgccataggcactaccacagtgctccatggggcgctgtggccagtcgctatcagaaaagcacatctccttggtatccacaatatcaacattgcctatgttggatacttaattctaatatccatgctgctgaatcatgtaatttatggtgaaaaaaatcaaaatgtcatttaatggagaaagaaaaattgtgaaagaatcacacaattgagtgctttatgatgctaaagatatttcaagcagtcattttcatatgacttttgtaatgtagcaactcgtcttacaatgttttaagagaagtattttacctaaatgtgcatgtcttctgaccattgcatggagaataagcttctgtaaacaccactgaaagaacatattatgttttatgttaacacgttatatttcatgtcagtcttttggttcataaatggtgtagataaaattactgttcaaagaatggttatcaacctgctgttctcctttcattaaaattaggttcatattctggtcatttcttagcagttttattcaatgttaagtccataggttagctaaaatgctgtttcttcccagtggaagagttgggaaagcacaataccagtcatgtggtgccttctacatcaacagtatcaaaactgttccacctaagatggaaatgctgcatatcttaaagaaaattagttaagaattcaaaagcttttcattgacctcatgagccctccaaaaataatacagagatacctgacattttgtagtgttcttctagagagaatgctaaagtgtttttgcttaacatttgtgtgctccctaaggtaagtaaagtgaatgttattattcttatcacatgttgtataaagaaaaacaagaccagagagactaaaggataaacgtttatttaacaatttagtaatataatcaggtctaacatgagagcccagcactgctcaatagaactttctgcagtgatagaaatggtctataaatctaagctgtttgataccagtggctattgagtacttgaaatgtggctggtgcaacagagaaactgcatttttaatttatttaattttaattaattttaatttaagaaaccacatgtggctagtagccactgtagtagacagcacagctctagtcatttcccctgtgttctgtcctgtaatcacctggctgattttgttaccattgttggcatgataaagtaggctgcttgctgttaattgttctaaccttaaagcctggtggtaggcatggtacattgtggaacaggtgctcggatgggtgaatgtagaaaggcttcaatggcaagggctaaggattaaaatttaaaagactgaatgtaaaagacttttagatttatctttccaaaataataaaatacatggggatactttcccatttactaagttcctgaaaaatgatatggacaatttctataatgatttatggcctgtccaacgctttcacgtgttttttttcccccattggcattaatagtggtaacacaaagccaacaagcaagtaattttgtgttgtttgtatacacacacaatcaaaagcaaagataaggtgagtaacttgttcagttacagaaccagaaggagtttactgttatcattcttcaagaataaaaagagctgggacaattcttttcaatctactacataaaatatttcaaacagttcagcttatgttttagagtcatacattaatcactaatgtgtataaacaatgacactaaaagatcttatggtgattattcaggttcaatggtaacagttaatgatgattacgtatgccttactataacctcttgaaaattggtaaattttgcaaaccatgtatgttaactcttgatgaaggcacagataataaaactcatgtaattataaaattaacaaaaaatgtacatttccacagcatacagaaaataatttgccatatttatttctccactctcaacttcttcgttagcttaaaatgctttttttctatctaatttcttcacatttcatctacactctgatcataccttgttccgtccttgtcccaaatgtatcctgaactttcttgcttcttttccattgtgtgtggagttctgttcattcagagtgcccttcccacttgtccacctactaaaccttaacatttttcagcatctagatcaaatgcctcccactacagaaagtcttttctctcatcagaattcatcactccttgttcagtattttcttagcaattctgatcttgatctcacactttgcacaatagatatttatctgaaagccttgttattagttagtagtctgaatgtaccatgagttgaagaccatttgaatctctttaaagttcctataagataggttcttaaataatgctggttacaaattatttttttaaaaattcaattgtgaaacagcatttgtattttgtcttgctaacgtcagatcagcttcacaaaacagcatcagaaactcaaacctctattcaggcattcctgatactattcacaagtgagaatctgaaagtgcaaagcttagagtagcagattggcacagaatcccctcagcttgaaaattttgtcggaataaataatcacctaacactctgccttcacactctttgcacgtaaaagctaaagtgttcagaatgcaaatcccttaacaaaattccaaagtagagcagtcagagaataacattaaaatcttagtgatagacgatatttatcatggtacactgattctaattaagtgaattattttgttgcaagtattttattcacttattcaagaaatatttattaagcatacatcatacgctaggcactctgctaggctagagattgaatacaaatattacattgttcctattctcaagaattcatagtctcctaggaaaggcacagtatgtagtatattaaaaagaaaaactgggcgggcgcggtggctcacgcctgtaaacccagcactttcggcggccgaggcgggcagatcacgaggtcaggaaatcgagaccatcctggctaacacggtgaaaccccgtctctactaaaaatacaaaaaattagccgggcgcggtggcgggggcctgtagtcccagctcctcgagaggctgaggcaggagaaaggcgtgaacccggaaggcggaacttgcagtgagccgagattgcgccactgcagtccggcctgggcgaaagaatgagactccgtcaaaagaaaaaaagaaaaagaaaagcgtcggtacaataacttctattttgttctcagcttgatcaactaatctgagcctatttcttcatctgtaaaatggagacactaaaattacataccttactgggttattgtgagaacttaggaaggtaatgtatgcaaatacatgaagtatttagtccattgtttgtaatttaataaattctcagtaattatcagtaataataattgcagttcaaggtgaaaagtgctatgaacaaggaaaatagaatatactatgcaaatgtgaaaggatgggacctcattctgtcaacgtaagttggagaagccttctcagaggaggattgttgaaagacttgaacgatgagtaggaattttccaggtgacatcactaagaaaggaatggatgcttccgatgaaaaaacacatcctcagaagaatatattcaagagaattgtaagcagcacagtatggctaaagcagaaggcggatggagaagagactaaagaacatgacaaagagatctcataaacattcagaagaggaggactgtggatgtatttccattttaccaaaagcaatgtgggatgaaatacactttagagtgctgaagcattaagtgagaaaacaagctgtaagtttatctcaacagttccaggacatagatgacaagatcttgaacttagttctaaacaacggggatgaagataagaaaaaaatgaggttgtcttgaaatggtgtaatgattggtaatggagattgagacatcactataaaatcacagaagaaagtatgttcctgttttttcaccaacttactataatgaaaatggacatataaatatatttcatttattgctggaaaactaacaggatcatatcagaaagaatgaagataatttctctctattacattgaagaatattgcaggattagttcatgctttaaaatgatcttcccccatagagacaatattttttatttttactttaaataatcttaatatttcattcattttaaaatgtaaatagagtttacaaaaaaagtatccaaatttatcccacaaaagcagaaagggaagattagaaatctctaactgtgcatagtgttctaatttttaaattctaattgtgttttatcctatctcaaattgtagaatctttttaagaactatttttaattttagaaacttatattttttatactaccaaagattgaagttgacaaggtatagaatttttcaacacctaaaattatcaaaataattaacttccaggacaacactttaactcaactacttccccaacctatgccctccagccaccagaaagaagccttcaggagtccctacagcacccacacaggtcctctccagttttccccctcccttcctgatgctgtgaaaaccacagaataaatgtttatcactttcaaaaatattttatatatatatatataatgtatatgaatttttctttttactgcacataatatagtatcctgttcacctctcagataaataaatcataattatcattttctgcttttaaataccctgaaaatataatataaaaattacataaaatcaattttttgaaacataaaaaaattaaaagaattacaaaaacaacttgttcaataaattttgtcttataaaatatctgccaaagaaaatattctaaagagaataaaaatgattgttcctctaaggcttaggcttaaatattcacacatttcaatataaaatataactaaagacatctttcatttagcataaattgttctgatacctattagataaatcagtatttgcagtgaaggtattttaagataaaccattatagtttacaatagcaattctcaaactttctaagtttcataacacctttgcactcctaagaagtactgaatgctccaaatgacttttgtttatgtgggcaatatccactggtatttactatattaaaaactaaaacacaaatttaaatattcattgatcttaaataacctattacatgttaacgcaaatatttttattgaaaattgtatatttccatagaaaatatagaaatatttttagtgtgaagggtggcatttttagtgtgaagggtggcattttttcttactttatttttaaaaagtttgcaaagtgtcagacttcatagaagatagttggatttttatagctatcgcatttaaaatgctgtgataccatgtgtcagaaagcctacagaaaattcgatcatatattcataagagaatgagaaatagagatatatggcattttaatactatataaaaatagttttgacctcacaggacctgtgaaaggattctgaatctccaggtgtctttggatcacatattagtaatttctgctcttcaggaaaatgtcaattggaagtgtaaacaatttaaattttagtaactgaaaatacaaatgttaagatgattgtagcaaatttatagaaaaaataaaaactgtgatgtcatgttgaaataaatatattcataaaaataccagtggctccatcagagacagatatgtctaagaaattaatattatgcaaattttaactaataatccagattttgtcatttttaatgttcagatgctgaacataaaatataaacatattataattaattttatatacattaatatacgtaaagtttctaaataactttatttttatctgcattttagattttaaaatgtcaaattctaaagtaaacatagttctacaggtataaattgataaaaatatactaatcatctgacagttatagctctttttaaagcagttttgagatactctatttcaagaacaaataagagactactaacacccttccttccctgctccacataacagtttcacctcttatttgagagaatgttcagatattgaccttagttgagtcagccagagacacagagctctgggttagaaccactgcctagccaggaagagggaaatgtgataagaggtcagtgtattgctaaaaatcacactcctatctatgtttagatgagatggaataaatcatgaaggcaaacaaagtcttcttgacagaagaaagtatatatacagctagactttggaaagattttcttttcttgttttccatagaacattttaaactcagtttaacatatggtgtttagcaaagtcatcgctgataagatgacatttgagtagacatctggatgaagggaggaagcaagccatgcagactccgggtaaagcatgttctcagcggaggaaactgcacttggaaaggatctgaggcagacttgtgcttagaatgtttgagaaagagcaaggagaccatttggccagagtaagatggatgaatggggcaagtgaaaggcatgcagtcagagaagtagtagggaactgattatgtaggtctatttatatttagaatgaatgaatttgggaatgactggaaggctgtaaaaagaacagagacattatccaataattaacacatattacaattactgtgtgtcaggctctattctaagtactttatataagcttgtgtcatcctcacaaaaaaaaaactatgaagtaggcacataaaggatattgctaaatattaaaagggctttgtgaaattcttcagattgactttctaaaccacctttgggcaaagacaaatatttcctaggaaggaacatccattgctaactaaagttgagtgagtgctggttaatgcttggtgcaacagacctaatatctgatttaaaagaatcacattagatagtcttaagaatagatagtagtagggcaagtgtggaagcaggaagatgagttgggaagcttacaatacccagaaattttaggaaacttggaaaaatgtgtgagatgaacatgtttgagctgatttatcctagattccccatcactgctggtgacctagtagagttagttgcagttgacagaaatggaagtaaaggagaccactaaaataacatcacagatctgaaaccaaatgaccgtaagatattttccttagtataaacagtaagccaaaaatgaattcaggtgaagtcaaccattatttctgattacattatatataaaaaatattctagatgaagcggtttttaacagatattagcactcccatgatattgataagaaaacaagttcagaaagaagcatgtatactgaagaacacatagctaataactggtagagtctggatttcaatccaatggtgttcaactttggggcctaaaataactgctagattatatcactggctctttaatttatagttgctaggggtactgtgaatctctaggtgagaaattcttcaagaatagcctaaataattcaaggaggtttaactggatccaagtggggtaaaaggagaacaccaaaagtaggcaccatatatgaactcactgttttagaatattgttcttagcatctagacaggtgggtaaacaaatgggtgcaatgtacaagcagctcagctgttcccagtgatttgtgttttgtcaaaataactcagccaagttgtcctcagtaaaaatgttacagcattttttttttttttgcttgttttaaaaacactggcgaacccaaagagacacagcagccaagaattgaggctgccatttgcaactgtgccagggtcaaagtcactgtctgtccttgggccattcattcaaatgttttgagacctcatttgtctcacagataaatggaactcttgctacttatccatttttcctttgagatccttcagataatttgcaatttaatgagaagtatgggcaagatattatcaccttctctctgctaattaaattcttcctttctttacttcccaaacttcaacataacattccaagacttacttgactattcatgatcctcttctttttcaattttatcataaatttgtcatctggcattgagcattcccttcattttaatggtgataatccttttatgcatgtggcctgtctacccagagttactaggagatcctagaaggcagaaccaagattacatatatatttccatgtacacccggtgatcagtgaaatgctgtgcaggaaattagaactggctgagaattcgatgatggtaatgatgactgtaatagcagttactgtttatggagcacatactttgtgccagtcacattatataatgtcttattttatccccacaaaaacttgcaaggcatttattataatatgaatttagaatcaaggaaactgagatgcatagataaactgagatgcataagtagtgcataaaaatcagaaagtcagtggcagaggtatgataaaaatccacactgttctaactctcaaatcagtgcagaatggcagaagtgtcatttcagttatatatgtatgtaggatccattcgccatgcactcaccaatacacttatgcatcagtttatccatcagtttaataatttagccatccacccacctttcctccaaatatccactcttccatccacacactcatttgttcttatattcacgtagccattcttcaattcttccattcacttaccttgtcttccattccaccactctcttcatgcattcaactaaccattcactcatacactaaataattcattcatatatctactcatccaattattttctaactcatccatttattccctaacatatctgtatattgaaaccattaccaatctgttgatttattcatttagtcactgattcattcatttattaatttaataattcctgacatctatccattaattctatcacctattcaactgtttattaaaatatatgcatttattaccattattaagtatcttctttgtagcaaacccttactagatacaaggaacactaaaatgagtaagacgtactctaacctacagtatcttacagtctgattcaaataatctagaaaaaaataatgtgaggcaaaggagaaaatatctttgttgtgtggagagaagcagttcaataaaaacttaccatcccagcacggtagttcacgcctgaaatcccagcactttgggaggccaaggctggcagatcacgaggtcaagagatagacaccatcctggccaacatggtgaaacctcgtctctactaaaaatacaaaaattagccaggcatggcggcacacgcctgtagtcccaactactcaggaggctgaggcaggagaattgtttgaacccaggaggcagaggttgcagtgagctgagatcatgccactgcacactccagcctggtgacagaacaaggctctgtctcaaaacaaacaaaaaacaaacaaacaaaaaaaacttaccaaaggaggtgatatacaaatgcaggcttaaaagaaacagagaggtttacaagttggaaaacaaaggaaacatttcagacaatgggaaatggtaaagcagatgcaaatttacattaaataacaggatatatgtggcatactgttggtcattccccaatatttattatgcctttctaatagtaataaaattacgaattaaaagctaggcaaaatagttgcccagaatcaaatttactttttcagcctcactaaccatacagttagttaggtattgccatttatgttagttttgatcactgaatgtgagcagaagtagtgtttgcaacatctgtgttatgtttcaaaaggagaagaagtaataaacttgccatcccttttatcttccttctggctgaaatacagttatgctatttagccatgttggaccatgtagataaagcaacctggtagaggtggcagaattataggatggaaaaattctagaccccatgacattgtgccggtcaacctcttctagctttggcttttactttttttatcttgtttaaaccacttgtaatttcttaatttggatgttttatggtatgtgaccctttattctatacaatggactgtttcacgaaacgaatataaaatacgtggcattctctttgagacagtaagagaggctgtgaagatacagatatcacatcttggaaagctgaaaactctcagtacattatggccaatatttggtaaaacttgtcctaatacttggaaagaaaactccttcctgtgagagtctatgctcaagaggaaaggtttagaaatattcttattcttattttatgttttagtaaaggcccacaagagatgaaggacactaggatggagatttagtttacacagattggagactctacagatcagtgcagggacacactctttatgtgcaatttgtaatctaggttgactgaaaattttataatttggggccttatatattcaaaaagtgaattgattttgtaacttaggttgaaaaataatagtaggcagccctgaaaaagtactttacctggagaatagaatatggcaccaagtgtttttaattaaaaattgttagtgagacattggagccaccacaatagcaaaaatcgaattaaggatgttaccttcccatccaaacatattattttagatgactcaaaagatagccttcattttatttttctgagagtaacagtagaataggcagggcacagagggttttttttttaaagactagactctccagacttaaaactattttaaattctatattttgctcagtagttttgagaactagaacatgcacatttttaaaaagccaggcaaacagcaagttcacaaattttattgagcccatctgagtgctgtggtcacaggacagccaactgtccaccaataaacaaatagacagacacctgcagggagaagtgaaacatagtaattttccaaaattattgactgacaacaaagcatgtatccaagaagttgagaacaaaaagcacaatacatatcaaaagtgctgtaacttggcacatcatattcaagctactgagaaccaaagacagagagaagttcttcaagatagccaaagaatgaggtcaaattatacacagtgaaataagaataggaattatatccattctcagcaatagacttggcctacttttgtatattaaaaaagaattatatcgaattatttaagacttctcagaaactgtgcaaattgaaagataatagaatgacatctttaaagtgctgaaagaaaaactgtgaaaattgcattaaaaagttgctaagttaactcaagtggtcagaaaaagaacaataaaacaacatattgaacaaatacaatatacctagcagatctgtatattataatccaactacatcaataatagcattttctataggtgttataaacacaccaattacaaaattgttagactgaataaaaatctaaggcatatagttatattctatctacaagaaacgtacttgttttattcagttcaggctgcttttacaaataccttagacagggtggcttataaactttagaaatttatttttcacagttctggaggctggaagtataagatcagtttgccagtgtgttgatttctggtgagaggcctcttgcaaggttgcagacttcccattctatcctcacatggaggaaagagggctagctcactctctggccttttcttctaagggcactaattccattcatgaattaggtcatgaactccatgctcatgacctaatttccttctaaaaaccctacctccaaataccattacattgagattaggatttcaacatattaatttgggttgacataaacattcagtccattgtactacattaaatatatagccttatgtatgataaaagtaaaaggatggaaagagatttgacaaacacacaaaccaaacaaaggaaagctggagtagcaatattaataacagacaaggtagaattcagaaccaggtatatatcatcaggagtaaaaaggtacacaatcaggtcatttctctaagaaggtatttttaaaatcttaatttggtatgtagccagcaacatatgtaaatacataaaatctgttggtacataaaggagacatatacaaacacacaattgtagtggatttggaggcatcaacactcctcagtaattcacagaacaaggagacaaaaagtgaggaagcttacagaagtcttcaaaaatattagctactacttgatctaagtgacattttatgcaatagtttactgaagaacagcagaatatgcattgttccctcaagcatacatgaaactttcatcatgacagaacacagaataggaaattcaacagactttaaatttacgaaagtaaaaatcatacaaagtatattagaccgtaacataatttaaatagaaagaaataatagaaatatatctgggaaacctttaagtacttggaaattaaacaacacatttctaagtaacacagaggtcaaagaagtctcaaggtaaaaatattgaactgaatgaaaatggaaataagacatcaaaatttgtaagacacagctaaataaatatttagagagaatgctatagcattaaatgcttatgaaagaataaagaccttaaatcaatactcaagttctagcttaacaaattagagaatgaagagacaaactcaaagcaagcaaatcgaaaaactaggagcataaatcaatgaaattaaaaacagaaaagcagtttaaaaaaaagctgtgtttttggaaaaaataaaactctagtcatactggcaaccaaaaatgagaaaagacataaataccaatatcaggaattgaataagggacatcattacataccttcacagacacaaaaataacaagggaaaattgtgagcaactctatatccacaaatttgacaagtcagatggacattttagtgtggttatactgttcctactctactgttgcgttttgggtatgttataggccactggatcatgaagaaccatagatagacctaataaaggtgagtactcataacctcaagttcatggacttcaatggactttcatgaatgagactttgaagtctcccccctgggtatgagatgaatacgttctctatgtggaaggaagtgtacacaaatgattggctgaccaaggcgcatactatggcagataattctggttttcctttaatatcaagtgttttctcctctcatggaataaacatgaagcataatctttagcagtgtgtatggccctccggaataaagactgcattttccaccatctttcaaagctagctgtggccatgcagctaggccaagagaaatgcaaaatgtatgtgtggaattcaatgtcatacaccctatcgggcatagtacatctaataaaatttgagaccaatctaagtgtttcaatcagatgatattttatagaagacatttttacacagtgacagacaatccaagaagccaagcataatgaattccttaatagccacaatttaccaaactcactaaagaagatatatgtgtgtgtgtgtgtgtgtatatatgtgtgtgtatgtatatatatatatacacatatatatatatatatatatatatatataaaatcttctgaagagtatttcatctattaaagattaaaaacaaaatgatgcccctaccacttatagggatagagggatatctcagtccattgtatgttgctgtaacagaaaaccacggataaattataatgaacagaaatttatttcttatactttggcacctgggaagtctgaagctatggggcctacatctagcaagtcgttcttgccatgtaatcctacagctgaaattcaagagtgcatgcatgagagagcaagcaataaaggggctcagctaattctttataaggacactactcctgcaataacggcattaatccattcatgagggcaaagtcctagtgttctaataatcttttaaaggtcctacctatcaacactctttagggattaaatttcaacatgagtttcagagggcatattcaagtcatagcaacagataatatgatgagtccaaaagctaaagctccctgctgatggatgcatgttgagaattgagtgatgagagtatgggccatttgtctgaggctagaggcacagagaaaaggcagcttctatggaagatgcacccaagacagaccaagaggaaggaaatacctaacctaccaaggtcatccattggatgatacaacagaaaaggaaaaagtgaagactacacctaagagcaaaaatagagtgaccatcaaatttacaggtgagtcatgtttaggccttccccttcctttgaattcgaatttggatgtgatgtctattgatagtggagcaacagaattgagagatttaggactgctaaaaatttaatgaagaattttatgtgaaaaagcccaattcaggcttatacaaaaagaaatacatgtcatattaaaatcattgttaattttgaatgtccaatacagtagtcaatctgtatcttaattaaaattaatacagtatgttacaattagatctggtcagctggaagaatatgaaagatggagttacaaaagagagaaggcttaaacaggcaggaatatattgtataatttcatttacgtgaaatgtacagaataggcaaatctagagagacagaaagtagaatagtggtttccaggaactaggggtagttactgctaaagggttcaaggactgagcatggtggttcatgcttgtaatcccgactgtttgggaggccaacttaggaggattacttgaagctggaagcttgagaccagcctgggaaacaaagagagacttcatctctaccaaaaataaaaataaaaaacttagctgggtgtggtgacttgcacctgtagtcccagctacttaggaagatcgcttgaggccaggagtttggggctgcagtgaaccataaatgtaccactgtactgcagcctgggagacagagtaagtccctgtctctaaaaaataaaaaataacacaaagtgttcaagatttttttagggtgataacaatgttctaatattagacagtataagtaatttcaaactttgaaaataccctaaaaagccactgaattgtatacttaaaaaataaaaaccaaactaaaaaataagtatgtaagagtcagataatcaaagggtttagatgatatgacaagaaatctttaattatttctcttggctgtggatagccaggatcgggttttttagatgtagtaacaataagattagattttttaaaagaaaacttcagcatcagtgtggaaggtgtattatagacagcaaaggacaatcctgaaagtacgacaattatttagcatagacaggaggaaataagggcctgaacaagagcaatagcaatgaatacagaatggaagtaatgaacaacaggtgaggagaaaactaagtggataatataagaatgcatttcagtcatttaacttttgttcccatcaattgtgcattctaagagatgacctaaaacacctatgctttaaaaaattttcatattttttctgtcactgattatatatatatgtatatatttacttgctggaaaaataagatgcaagtatccaagcatgtgagaaacactacccaatgcttggggacagtatttttataccccaaactaaaccttctgcaggtagttttaggtaccaaattaccctctaaattaagatctaactgcttcttgcggaatgcatcaaatctaatttccccatcaaaagaacatctttatgtcagtgatttctttactgaaaccaatcagtgatctcttggaactcctattaagaaaatgctcctgggtactaacaaaatagagtatagcaaatgagctgaaattacttttaactttatcaaatatgtgatataaaggtgttaatgtttattaacatggcttcatgttaatagctccatcaaggatcagatgtttatagcagtaagaattctgtatgattattttacatcttttgctttagacatgagaccatcattaacagggaagaaataaactgatgtcaaaaagaaagaatatgtatatactttgcattttccattaaaatgctaaatttcgtgcacagaaagaaattcagcatgacatatatagctttatatttccatgactgtcttcatacattttgagttatagtcatatcaagaaacttgacttcccttaaacacaatatccactgcctcatttgccgtacttttatacatgatgttatctctaatgggaacataatcttatttcctgcttctttaattaatacttattttttccaatactcaagtaggtattacctcctgtgggaaacgtttcttgattttcttccgtatctaacatgtattaagtgaccttattcagtgtacatataatatactatgcataactattcaacaggtataatattataaagataatattagtttaagatgttgtgtgtgtttgtgtaacttgaataagcttctgtaacaaatagatcataggaggtatagtggcttcaagataaatggatgcttttttctcacctacctaatagttcaacgtgggtggctctgcttcacatagcataacttacgaagctctgcttcttccatcctatggcccctgcttcccctagattttcactgaaatctgcatccatcaggcaagagtgaagaggtagtgaaggagatatagcttcttcttaaacgtctttgtctggaaatggcacatatcacttctacttgcattccagtggttaaaacatcatcatttggcctcaagtagctaaaaaggaagctgaaatggagccttactctgtacataggaagaagaaacattgatttatcttggacagctagcagcaacattaaactgaaagtaattaaactactacattagtcaagctttgggtaggcatgcccagtggggacagagaacagcatgtcagggcccactttgggccaacgcattggtatgatgagtgtcacatatctggaatcaacagttctaactgataaatttgtcttcctttttctctttccctttttgaaagttcagctttcaggtgttgtacacaatatgtaggcagtgggaagtgggcagtgggcagtggtatgtaggggcccagctatgagccagcatattaatacagggaaatgaaattttggggttgtgctttctaaatgtccttttcttcacccttctttctgccctcttttaccttcttcctttccctacttctccccttcctttgtgtgagcttttagccagtacacccaatatggatgtgagtcaaggacactgctttctgctgtcatggtgaggagtttgttaacaacggcaggactgaataaattaggaaattcatttagggtagtggaaaacatatttctcattgttgaaaatgggacttatgaatatggaaaggagatagttttggaatgcaagtagaagcaccagtgtgcacaatgatcaaatatgatagagctccagttaaaattaaaatataaaaacatatagatatacacatatgtgcatattatttgtatacatagatttgcttttttaaatttaactgtttttaacttttattttaggttcaccggcacatgtgcgggtttgacatataggtaaattgtgtgctgtgggagtttggtgtacagattatttcatcgctcagatgatgagcatagaagctaatagttttttgatcttcaccctcctcccactctccactctcaagtaggccccagtgacttttttccccttctttgcatccatatgtacttaatatttagcccccacttataagtgagaacatgtggcatttagttttctattcctgtgttagtccacttaggataatggcatccagttccacccatgttgctgtgaagggcacgatcattttatattttatggttgcatagtattccatggtgcatatgtaccactttttttaaaatccagtttattgttaatgggcatttaggttgattccatatctttttcactgtgaatagtgcataaatagattttttttatctgactctctttagaggacatacatgtaattacaccgcagttatgaggagcacatatagtgtcctattatttgtttctagatactagggagccagagcttcctggggaagagtacctgactccagggctgaggcagggaaaatacaagatgatctggtaacatcctgttgtgccagaggtactctaggggcatgtgcaaaagacataagaaccagttgaaggagcttccactagtcaagtctgggacaaattcaaataagtgataattgacacggcaggagcatcgccatcttggacaagcactgccatcttaaagttccccttgatcaaaaactgcctaaatccaaagggcatcagcctaatggctaaggttagcatgaccataaaccataaatgacatctccgaccagaaacattcgaaccgtaatataaacctctccccaaccagagacatgccagccctgagataacctcccttccaaccagagacattccaaccctgacataaaacttctcccccacacagaaacatttcaagtctgtaataagttccctcaccctaaaaccaatacatactcttagtctataagagagagcactcctgactgaaattggccagaagcccctctcaggtttattctccaaaataaacctgtctttgactgttgagccactttttgtgtttcttttctctttaactcttaacaataataatgaccagttataatattttgagtaaaataagaatttatgagattttactaacataaatggatacatatataaattgggggtggtgctggaattggaagggaattcttccaggccaactaattaatctacaaagaattatggaattaggagattaccacttgataatcatcagtgaaaactcattcaggcagaattcatcaatgaatgccaaatctggtgtgtaaaagactgatgaaaaatggagtattcacatagtctcaaagtaactttccatcaatgcataatgattatttattgataacatacttattaactttctagtgtagaaatctcacaggcaccattaattaaataataaatgttaccatcatcaataatgaaacaaaatcagcatgtataccttctgatatacacactgcaaagagctcagcatcacttctgtggtattcttgccagaaacatacaaatcttaaatataacaaacattacaaatggagtcacattctacacagtaactaggctaatttttaaaaatgttaggaccattaaagacaaagaaaaaataaggaactattccagattgaaaggtattaaagagatatgacaatgaataaaaccactgattatggattggctagtgggcctaaaaagggtatatctgggataattaggaaaatgtaagtggggtctgtggaccagaaaataatattgcatcaatacttatttcctgattttgatggaaacattgtggctatgtggcaaaatgttcttgtgcataggaaatatatattgtagaattaagaggtatggtaggaagaataatagcccctaaaggtatcaggttctgaaacctacacctgtttaagtgttgtcatataacaaataaggttctttgcagatgtgagtaagttaatgattttgagactgggagattatcttggattgttcaggtgggccctaaaataccaccacaagtgctcttatcagagagaggcaaggcgatacttaatccagacagaagaggaaaagaaagtgttaagatggaggcagaaattgggttaatatggaggcaagccaagaaacattgataaccaacattagttgaaagaagcaaggaacagatctctctctggaggagacccccatcctgccaataccctgatttcaatccaatgaggctaattttggatttctggtctccagaaccatgaaagaataaatttctgttgtttaaatccaccaagtttgttgtaatttgttaatgcagccacaggaaactaatacaaggagtaatggggtatcataactgaaacttactcttaacatttttgaaacaagagaaatgttaacaaggaaatctgggtgaaagttatacaacaggtccctatattttttcaatttctatgtaaattttaaattaccgaataatgcttttaagaatttaaaaattagaagattaagtaaaggttaaaagctattgcctggataacatgaaatgggaggaagatcaacactttctagagggattcagacattcaatattctactattttatcctctcaaaatgttggcctttatcctaaagctatttatttcctagttctaaagtggctatagtatctacagatatcatatttgttttcaagatcagaaagagaatagagaaagatgataaaggttcatgccagttgaacctgtgtcttttttatcaagaaagcagatgttgttttaggtatctccagaaaatatttgtttaaatcttggtagccagaactatacccaactgtgagggaagctgtgaaggtgggcatttgccttcccagcttctggagtagatatgaaaatggagaaaaagattgaaaaacatctgttgagttggctaacaaacagtgttatctccctggcaatagagatagatagatagatagatagatagatagatagatagatagatagataatctgtatttagagagcctagcacaatgctttaaatatatgttcaataaatgcttataatattaattggtgtatgtatgaatgaatcataaatggatgaattaaagaatcttatattccaagtttatattagccatgtgaataaatgtcagctttattagagcatagtccccaatatagaatcatttcagaataccttaacaccctaggccatcatttgtgtttcagtttgtaagttttacattctatcatgattttttgtcttagattttcttttgtgtgcccaattttatggtattacattaaaaccgtatcaacttttagcatgaattgttacaaaaatctcttatctctcatctctttaatgtcttctctctcaccccattaaatgaggtaagtaagtaggaacatactagaaagaaaaataggaaagacaaaacttggtaaataattaggtgtaagaagtgattcataagaagtagtcaatcaatattctgaagaccttgtcttagataattgcagtggatgggaatatcaaacacagaaagataattgagaagacttatcatgtaaaactgatgagtgctgttttagacataaggagtctgatgtgtcaatgggacatacttgtgcagataaatatgtatttgagaattagacgtttaggacttaaattaagagaagttagaacaagagatataagtttggtattcttctgcaggtaggtgctagttaaagcttgtgaatagataaaatttctcaaatatatcatataaagtataaagaaagaggactatgaataaaatcttgacgtttcacaaaccgtgatggcagccaattccagcactgggagaaacaatctggtatagaggaagggagtgagaagacatcatttctttttctgatacaaattcaatatgcaatttacattaatgcttctcaaactgtagtgtgaacaaaaattatcttgaagtcttgttaaaacacagattttcaggtcctatttccagatattctaattcaaggggtttgaaaggatgccagggagtttgaatttctaacaaactctcacatcatgctgatgcctcccacctaggaccacccttcattatatctcaaagctctaaattaaaccttcttactcacagtgtggcccatgggccagaaacattggcatcacctgggagcttgatggaaatgtaaaatcctaggctccaacccagatctactgactcagaaactgccttttaacattatccccagttgactcatatgggcatgaatgtttgtgaagcactgccatctaaatgtattatataacatgttgtttcatttctgttaaaatgacaatgttggtctcattttgattccaacatactatgaggtaaaaaattaggctttgaagccaaacattggtaagtcaattgtgcctccactaaccttagtttccccatgtataaaatggagatcataatagtgtcctcccttggttataacaagaatgaaataatgttatgaatataatgtgcctagcttccatttgaacagagagctatggtctcacgttggttttacactttcacatgaatattcaggttgcagctagcacatggctgcttgtgaaattgcttatttgttatgttggttccacctatttgattagttaatttgataaatttaatgatgctttaagtgaaatgattccagttaatgattattgattttaacctcaagaagaggaaaataaaattgattcctaggtaattacaacttaaaatacatagagtgtgtgcagatactgactgattaaatataatgaatatttaaaaactgatataaaattgtgaccaagttggagagaatcggattgtggttgtgacagtaattaaaacaaaaattgagacctggctggagtgtacttcggtctcgtgaatcttgcgaatctaccatttcctctcctttcttcaatgtcactttttttatttctcaaatagaactatggtagcctgaatcttatcttccaaaggttttgtttctttatccaataaatagatataatatatctaatacatggggttgttgtaagaaaatttaaaaatccaagtgctgaacacagggcttggcaaaaaaaaaaaatgaattaataattgctgttattatgtaaattttacccataatagatttgaggaggaggttgatgatgctgagtttttcaacactgtattctttaggattagtagcactctattatatacagaagcaacactcaataattgtttgctgaattgagcatccagagtaagtttttatattgtggtagttgcaattaagcagtaaatctgacacacacacaaattgttttttcagagataaaaatggaagttcttttatgctgctagtgaagacttaacttcctccaactcttttctataaatacaaaaaaaaaatacttagatatgctattttttcctgtatacttagcatattccccttaaataatactgttggaaagagaaaaaatgaataatgtcatccctagtaaactagtcaatattgagggagaaactctcagtttaattttctaatagatcatataaaactctatttctcatgtggggagatttagagtctagcaagattttattctcaaataatagattcatttgaagagattaaaacaagtctttgtcaaaatgaaggaacatttttaaatgaatttgagaaattcatcccaggtgatttaacataaaatatttttgtttctatttttattttatattatattattttattttattttatttttttgagatggagtctcgctctgtcacccaggctggactgcagtggcacgatctcagctcactgcaagctccgattcccaagttcactccattctcctgcttcagcctcctgagcagctgggaccacaggcgcccgccaccacacccagctaatttttgtatttttagtagagacggggtttcacagtgctagccaggatggtctcgatctcctgaccttgtgatccgcccacctcggcctcccaaagtgctgggattacaggcgtgagccaaagtctttaaaaaactgagttcattaacaaaaataaagttccattcggaacgcagaaatttaaatttccaaagtattatctacttgctatcagctatgaaggtcttaaatatttgaagtggtgtcatatacaagaatttgagactagctcaaaataagtgaccacagcaggtaagaagcacatttctgcaagtgaaagattaagattttaattcaagatttcatattttgttgccctggatattcaaggagaagccacttgctatagagggaaagacagatgcaacatgcatagaattacctcaaaattctgtgctgcttatgacaattgacatgaatgttatttggcatcacaatgccctggtaaatataggtagagagaacaattactttctcttgcacatcaacacacctcccttgtcaacacatacaaactcatagtaatcttgcacaaaattgttttattaccctttcattcagcatttctgcttatacatccttaagtatatcatctactttattgggtatcatatagaaaactgcgcattttcatttgtagtagatcagtttctgctccacttgaagccaaccttcctcacaattagcctgctctaaaatacaagataaataagtcctaggtatttactgtacaaatatagtgcctgtagttaatgttgtattgtacatttaaacacttgcaaagagggtagatcttatgttaattgttctgtcacaaaaagtaataataataaacaagaaagctggaagaaacttttgcaaatgatggatatatttatggcattggttgtgctgatggtttcatgggtgtatatttacctccaaactcatcaagttgtatccattaattatgtacagcaggggtgtctactcttttggcttccctgggccacactggaagaagaattgtcttggaccacacatcaaatacagtaacattaacaacagcagatgagcttaaaaaaaaaaaaaaaaaaaaaaaaaaaaaaaaaaaaaaaaaacctcataatgtcttaagaaagtttatgaatttgtgttggggagcatttaaagccatcctgggctgcagtcgcatgtggcttacaaggataagggttggacaagcttgatgtacagtattttgtatgtcaagaaattaaattttaaaaatgttgaaaatataaaatgttgatgttggagagaaaaaaaaaagcagctaatattttgagcaccttgcatgtgccagtaaccatagaaaaagctttctgttacgtcatagaatcctcccattctctattaggtatctattatctccattttgctaatgaggtaactgatgctcagagtagggaacttgtcaaagacacacattcagtgagtggaagagccgagattgaacgcaggattcctaacttcaatttgtatttctttaagattgcactctttactgtgtgagaaaagacataaatactatagagtgtatcaaaatccttcatacacctcctaccgtctttaaaacagacctagttttaagaaaaattcatttcacaaagagccataatttttcatcttcttgttcagcaatgcagtttcattcctgatgctgctattaactcttaaataatctaaacctaatgaataatgggaaagtcacaggcaggtgaaaggagaattggggccttggaattctcctgtgatgagtaattagtttatcctgagaaaaaccagtcttttaaaacaacagtagcctctcaagtcatggagggtctaactagtctcactatcatgatttcataacgccgggagggtttattgaacttttgattccaaaatgtaaacaaaatgattttttgaaacactggaaccaaatatttcctggaataagaaaatgcacatttattctctaacttacatattaatacatatatcaagtgacaaatgttctgtgagtctgacataaatttccaagtcattacgttacaggtattacaaaaatattaatcctttctaggagactatcttatttgtgtcaagactctttagagatgtctgattattgctgatctgttttgtgagtataccatgccatttgctttttttcagggcccatcttactatttgtagaaaagccttcagctttgcccaaagttgtcttttgcctcatctgtttaatattctggttctgactttctctgtgcttaggtctgatgcttctgtgaattcctgtctgtggctctcctgtgctgcagtagagagaggagtactttatactcctttctttgtggaaaaaaaaaatcacttcctaataggggcttgagccgaaatcaatgagtaactgagcagacatgtgagacagacattaacattttttttttaaacactgttgctgttgagtcacggtctttctaattcccagattcttattgaagacctcacattggcctaaccagggcaaaaagcttggaaatctaaggcattttattgcatgggctatttacccaataaaggactatacaattttaaatgttggaggtaaagaaatgtgggagattctgaagatatgatcattgggagataaatagagtcttagtgtgcggaggttggattttgcagacttctatccacagactaattcttcagtgcatatttttagaattgcctcctagttttataattgaaaaaacacagctgaaaattttggaaatattaatcagaaatacaatatctctattacctactcaattaaaatggctaaaaataagcattcaaattttggtaaatgtgttctgagtagttaacaaaaaataaattatatctaggcaatgtttgttaatgaaattaagagagtcctaagtgaatgtggtttctgaacattaagcaggagagagaactattgatgtcctcaacctaatcactacctcatgttggtgaaatatctaaaatctaagaaagagctaagaaatgcactcctaaaaagttagtttaattaaataaaagtgttcttattttttctagtagtttttccattataaaaatgatataacctggccgggtgcggtggctcacaactgtaatcccaacactttgggaggcagaggtgggtggatcaccaggtcaggagatctagaccatcctggctaacatggtgagcccccgtctctactaaaaaacacaaaaagttagtcgggcgtggtggcaggtgcctgtagtcccagctacttgggaggctgatgcaggagaatggcatgaacccgggaggcagagcttgcagtgagccgaaatctcaccactgcactccagcctgggcaacacagtgagactctgtctcaaaaaaaataaataaataaaaataaaaggatataacctgacctgtagtagttcagttaatagtatcataccaattgtttggacaaatggtgatgtaaaatatcattaaggaaaactgaggtaaggatatatagaaattatctgtactatttctacaacttttcttaaaactaaaatagtccctaatcagaaaaaaaaaatgagttttttaaaaaaatctatggttaggaactattttttgcctatattctcttctcaaagataaagatgttaatctaggcatacaaggtactctgtgatctctgcctcttcaacctcatttcatcaatgctttctttcatttggcttcatcaatatatgcacgtgtttgttctatgccatacactttgttaatattttagataggccactgcattcaaacattatatgaacctttttacccaaatattaaacatgaggaaactgaagctcagagacattaggtaatttatctagtgttacatatattcaatgaaacatcaatatgtacaagtctgtgacttccaaacctagactcaaaactgtccagattaaaataataataatgaatcagtataaagttaaatttttaaatggcaaaaatttcacatggaagcttaatctagttaattgtgatctttatgctatttacagacaaaacattggaatggattaccaaaggattgctctccaaactatgagtcaaggagagacagtcattcgttctggctgatttagacatttattagtcagaaatagtatacacaaaaaaaattatttctctaccccccaccttgccataaacaactgggttcttagtttcagattataaaattgaaatacctaattgatgtttaagtgaaaagaacacagaatcaggagtcattgaactgaagttcgtatctcagctctgccctcaaattctggttaccttctatagccctcactttcttcatctgaagaattagaataagtccttatatcacagacagctataagggttaaattagatcaggcaaataaattgcctacaggagaaattggcatctaggaggctgaattaactttgaacctgagctgtatcttaatattgatcagccatgttagttttttcttcccttttgtattcctacaatgcaagataacttgaattttctatcctcaatttattatgatgtattgctccaacatgtaaaaaaccttagggaaagcaaagtgacatttcaaaatcctgctgttggtattgggtaaccaatatttttgcaagtcaaatagattccaattttttgtttctatcaaaattgaaggaaaattcaacagatgatcagctggtcactaaaattattttctcatgttcatcatgtgatttttggaaaatagaaagaattaaaaacattcaatgtcactgcaatagaatttcttctagcctacttgttcatttatgtgaacagtatttcatagcccttacatttataatacaatctaaaaaatacaaataagtgatatataaacctttagcttacataagtctcaattctaataggaagtaataattatctatggatccatgaatcatttggaaaaagaactccacccatcttataaaaatttgtcattgccaaattattttatctgtaataattcttttaatttgtaatatagttataatgttttgatcaatttaatactaaattatttatgagaataatactgttcaggtttttaaaatacagggaaatagacacacacatatatacatgcacctgtacacacaatttatctattttttgttttatacacacacaataaatctttaaaagtatatcttaaattataattaaattttgtgaaagaaatgtaatgaaaatacaaattatagaggaatattaatttttaactgttaaaatcagtacatttgtactgatttccatcttatatagaagttggccgggtgcagtggctcatgcctttaatcccagcattttgggaggccgaagcgagtggatctcctgaggtcagaagtttgagaccagcctgaccaacatggagaaaccccgtctctactaaaagtacaaaattagctgggcatgatggcacacgcctgtaatctcagctactcaggaagctgaagctggagaattgcttgaacctgggaggcggaggttgcagtgagctgagatcacgccactgcactccagcctgggcaacgagagcgaaactccgtcacacacacaaacacaaaatttagctaatctttacaggcatgatatagcctcctttttcaatgtttctttggtcaggtattcaaattcacattttttaagtgtatgctataacaataacagacaaatctggactactgacataaatctgttggattatatcattacaattttttcttcctcatagcaattctcttactactttacattcacacacaaataaaactctattgtctccttagttgtttctcaaatttatcttaattggcacctaaagagttcatgtgcatagtaactacagttatgcaccacctattgccagaatgttttggtcaacaagaaatcatatatgcaaaggtgatcccataagattataatgaagccgaaacattcgtattgcctagtgatgtcatagttattataatgtcatagtgcacctcatcactggtgtttgtggtgatgctggtgtacaaacctcctgtgctgccagtctcacaaaagtcttttttataatatctcataaaatctaacacatacagttacatacagtacctaacactcattaatgacaataaatcactatgttactaatttatgtacttctgataatatactttatactttttatcattattttagaatatactccttctgcttgtgaaaaaagttacctgtaaaacagccccaggcaatctatcaggacgtattccagaataaggcatttttaccataggaggtaatgcccccatgcacattattgcccctaaagattttacagtgagaaaagtggaagacagtgatatttacaggtcctgattctttgtagaccgaagctaatgtgtgtgtttctatctcagtttttaacaaaaagttaaaaaataaaaacttttaaaaatattaaaaagcatatagaaaaggaatataaagaaaataattgtgcacagctcttcaatatgtttgtgtttaaagctgttattatgataataaaaaacttaaagtttataaagtaaaaaagttacagtaagtttattattgtaaaaaggtgtcttaataaatttagtatggcttaagtttactgtgtttataaagtccacagtagtacagagtaatgtcctaggtcttcacattcacttgccactcaccaactcaccagagtaacttctaatctttcaagcttcattcatggtaaatgacctatacgggtgtaccattttttatcttttatattgtatttttactgtaccttttctatgtttatatatgtaaacacttatcattttgttacaattgcctatagttttcactacagtaataggctgtacagatttgtagcgtaggagcaataggccataccacatagcacaagtgtagcgtaggctatcccatctaggtttatgtaagtacactctatgatgttcacaggatgaaactgcctaatgttgcatttttcagaaagtatttccactgttaagtgacatatgactataaatgtatattatgcagctaattagcaatatctttattatcttaactctgagaattaccttcctaaatttaaataaagattataaaattagaataaatgatattcactttaaacttgtaagacctatatatttttaatcaaaaagggttaaaagtttatgtaacattcaaacggtttattaaagctataggagaaagaaaggtatttatttgaattacagcactgctggggaaacagagagacagcacttggatgttttcattttccagggcatcatatactaaagaatcattccatctaatttcttcaaatctcaagaacacacacctggcaaatcatgaaaataaattttatgttgttatcaatgatatttttaaatgccattttaataatttgactcactttttttctaatcacagtattatgtgtatcatcaatctggtactcaattttactccattccacttaatcatttattaagtcctttgatacaggtacagtctaagaaataaatacacaagagccataaatcccactctaaaggaataaagcctgccattccactctcacacccagttctcttaatctcaccatgttttttaagatttggttgcagtatcatcatttctctggaaaaactattttcatacccacaatcctaaaggttagatgccataactcatgctcctacatatataaccaattttgtttatttatttttccccagactctggcaaattttaggtacataataaaaatcctttgaatgatttcattttagtcacaattaagagaatggaaaaaattataggtgattcttctgagtataaactaagagtcaagctattagagaagcattccctaaagcaatcaagataactaaaggcacaatttattgtctgtggatcacagttgagcttaccccatgagtcctcgtatactgatctcatgaaaactcatgtatgcttcggactatgttttaataaacaacactttctgacataaaaaaaattattaattaaaatgaagtcctaatcataccaagaacaccaaatgtttcacttttccatattaagtttaaattcagcagttttcaaacatggccaaggatgcctttggtgtccccaagacactttcagaagatttgcaatgtcagtattattatcatagcaacactaaagcattttttgtccttttctactgtatggatgcttgcagatgcaagtatgcacatcaatctatgtcaaatagggttagctaacaaaataatacaagtgaaaatcagggtaagttatcaaaacataactgctagtgtgtctaaaatgcaaaattacaatatcaatcatttatatattgctgatagtagtataaaatagtatgtccaactctggaaaacattttggcagtttcttaacaataataaataataaataaacattccaccactatacaacccaccaattgcaatcctgggcatttatcctaaaaaatgaaaaattatatttacatataaatgtgtacacaaatgattatggcaggcttattacagatatccttaaatggatgaacgtttaaatgaccatggtacatccatctcatggagtactattaggtaacaaaaaagaacaacctattgatactaatatatacaacaactaatataatctctagagagttatgctaagtgaaaaagccaaaggtcatatattgtatggttcaatttatataacattcttgaaatgacaatactatagagatggagaacagattggtggttgacaaggttcagaaaaaagagaaaatggaggaagtggtgtggctataaaaggataacatgaggtttcctagtggtgatggaacacttctctttcttaactgtattaatgtcaatatcctggtggtgattttatactataattttgcatttgtatattttctttggaaagaagtctttgggaaaaaatgtttattcaactcttttgctcatttttatttgggttacttgttttttgctactaagttgtatgggtcccttacacatttttggtattaaacccttcctagatatgtggtttgcaaatatcctcttccaagccataggttgcctttttattttgttgcttgtttcctttgctgtacagaaattttggtttaatatagtcagatgagtttatttttgcttttttttttttttttttttgcactcttggtatcatatcctcccccaaaaatcactgggaagaccaatttcaagaatctttccttctagttttcctatagaagttttatgttttcacatctcacatttaagtctttaatccacttctagttaatttttgtatgtaagacaagagtccaggcctggcatggtggctcatgcctgtaatcccatcactttgggaggctgaggtgggtggatcaagaggtcagatcaagatcatcctatcgggggaaggagccaagatggccgaataggaacagctccggtctacagctcccagcgtgagcaaggcagaagacgggtgatttctgcatttccatctgaggtaccgggttcatctcactagggagtgccagacagtgggcgcaggtcagtgggtgcgcgcaccgtgcacaagccgaagcagggtgaggcattgcctcactcgggaagtgcaaggggtcagggatttccctttcctagtcaaagaaaggggtgacccacggcacctggaaaatcgggtcactcccacccaaatactgcgcttttccgacgggcttaaaaaacggcacaccacgagattatatcccccagctggctcggagggtcctacgcccacggagtctcactgattgctagcacagcagtctgagatcaaactgcaaggcggcagcgaggttgggggaggggcgcccgccattgcccaggcttgcttaggtaaacaaagcagccaggaagctcgaactgggtggagcccaccacagctcaaggaggcctgcctgcctctgtaggctccacctctgggggcagggcacagacaaacaaaaagacagcagtaacctctgcagacttaaatgtccttgtctgacagctttgaagagagcagtggttctcccagcacgcagctggagatctgagaatgggcagactgcctcctcaagtggatccctgacccctgacccccgagcagcctaactgggaggcaccccccagcaggggcacactgacacctcacacggcagggtactccaacagacctgcagctgagggtcctgtctgttagaaggaaaactaacaaacagaaaggacatgcacaccaaaaacccatctgtacatcaccatcatcaaagaccaaaagtagataaaaccacaaagatggggaaaaaacagaacagaaaaactggaaactctaaaaagcagagggcctctcctcctccaaaggaatgcagttcctcaccagcaacggaacaaagctggacggagaacgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgcgaagaatgcagaagcctcagtagccgatgcaatcaactggaagaaagggtaccagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgacggggagaatggaaccaagttggaaaacactctgcaggatattatccaggagaacttccccaatctaacaaggcaggccaacattcagactcaggaaatacagagaacgccacaaagatactcctcgagaagagcaactccaagacacataactgtcagattcaccaaagttgaaatgaaggaaaaaatgttaagggcagccagagagaaaggtcgggttaccctcaaagggaagcccatcagactaacagcggatctctcggcagaaaccctacaagccagaagagagtggaggccaatactcaacattcttaaagaaaagaattttcaaccaagaatttcatatccagccaaactaagcttcataagtgaaggagaaataaaatcctttacagacaagcaaatgctgagagactttgtcaccaccaggcctgccctaaaagagctcctgaaggaagtgctaaacatggaaaggaacaaccggtaccagccgctgcaaaatcatgccaaaatgtaaagaccatcgagactaggaagaaactgcatcaactaatgagcaaaataaccagctaacatcataatgacaggatcaaattcacacataacaatattaactttaaatgtaaatggactaaatgctccaattaaaagacacagactgacaaattggatgaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgatgaaacagactttaaaccaacaaagatcaaaagagacaaagaaggccattacataatggtaaagggatcaattcaacaagaagagctaactatcctaaatatatatgcacccaatacagtagcacccagattcataaatcaagtcctgagtgacctacaaagagacttagactaccacacattaataatgggagactttaacaccccactgtcaacattagacagatcaacaagacagaaagtcaacaaggatacccaggaattgaactcagctctgcaccaagcggacctaatagacatctacagaactctccatcccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgctttgagggaaatttatagcactaaatgcccacaagagaaagcaggaaagatccaaaattgacaccctaacatcacaattaaaagaactagaaaagcaagagcaaacacattcaaaagctagcagaaggcaagaaataattaaaatcagagcagaactgaaggaagtagagacacaaaaaactcttcaaaaaattaatgaatccaggagctggttttttgaaaggatcaacaaaattgatagactgctagcaagactaataaagaaaaaaagagagaagaatcaaatagatgcaataaaaaatgataaaggggatatcaccaccgatcccacagaaatacaaactaccatcagagaatactacaaacacctctatgcaaataaactcgaaaatctagaagaaatggataaattcctcgacccatacactttcccaagactaaaccaggaagaagttgaatctctgaatagaccaataacaggatctgaaattgtggcaataatcaatagcttaccaaccaaaaagagtccaggaccagatggattcacagctgaattctaccagaggtacaaggaggaactggtaccattccttctgaaattattccaatcaatagaaaaagagggaatcctccctaactcattttatgaggccagcatcattctgataccaaagcctggcagagacacaaccaaaaaagagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatacgcaaatcaataaacgtaatccagcatataaacagagccaaagacaaaaaccacatgattatctcaatagatgcagaaaaggcctttgacaaaattcaacaacccttcatgctaaaaactctcaataaattaggtattgatgggacatatttcaaaataataagagctatctatgacaaacccacagccaatatcgtactgaatgggcaaaaactggaagcattccctttgaaaactggcacaagacagagatgccctctctcaccactcctattcaacatagtgttggaaattctggccagggcaattaggcaggagaaggaaataaagggtattcaattaggaaaagaggaagtctgattgtccctctttgcagacgacatgattgtgtatctagacaaccccattgtctcagcccaaaatctccttaagctgataagcaacttcagcaaagtctcaggatacaaaatcaatgtacaaaaatcacaagcattcttatacaccaacaacagacaaacagagagtcaaatcatgagtgaactcccattcacaattgcttcaaaggaataaaatacctaggaatccaacttacaagggatgtgaaggacctcttcaaggagaactacaaaccactgctcaaggaaataaaagaggatacaaacaaatggaataacattccatgctcatgggtaggaagaatcaatatcgtgaaaacggccatactgcccaaggtaatttatagattcaatgccatccccatcaagctaccaatgcctttcttcacagaattggaaaaaactactttaaagttcatatggaaccaaaaaagagcctgcatcaccaactcaatcctaagccaaaagaacaaagctggaggcatcacactacctgacttcaaactatactacaaggctacagtaaccaaaacagcatggtactggtaccaaaacagaaatatagatcaatggaacagaacagagccctcagaaataacgccgcatatctacaactatgtgatctttgacaaacctgacaaaaacaagaaatggggaaaggattccctatttaataaatggtgctgggaaaactggctagccatatgtagaaagctgaaactagatcccttccttacaccttatacaaaaatcaattcaagatggattaaagacttaaacgttagacctaaaaccataaaaaccctagaagaaaacccaggcagtaccattcaggacataggcatgggcaaggacttcatgtctaaaacaccaaaagcaatggcaacaaaagacaaaattgacaaatgggatctaattaaactaaagagcttctgtacagcaaaagaaactaccatcagagtgaacaggcaacctacagaatgggagaaaatttttgcaacctactcatctgacaaagggctaataatatccagaacctacaatgaactcaaacaaatttacaagaaagaaacaaacaactccatcaaaaagtgggtgaaggatatgaacagacacttctcaaaagaagacatttatgcagccaaaaaacacatgaaaaatttctcatcatcactggccatcagagaaatgtaaatgaaaaccacaatgagataccatctcataccagttagaatggtgatcattaaaaagtcaggaaacagcaggtgctggagaggatgtggaaaaataggaacacttttacactgttggtgggactgtaaactagttcaaccattgtggaagtcagtgtggtgactcctcagggatctagaactagaaattccatttgacccagccaacccattactgggtatatacccgaaggattataaatcatgctgctataaagacacatgcacatgtatgtttattgtggcactattcacaatagcaaagacttggaaccaacccaaatgtccaacagtgatagactagattaagaaaatgtgtcacatatacaccatggaatactatgcagccataaaaaatgatgagttcatgtcctttgtagggacatggatgaagctggaaaccatcattctcagcaaactatcgcaaggacaaaaaaccaagcaccacgtgttctcactcataggtgtggattgaacaatgagaacacttggacatagcaaggggaacatcacacaccggggcctgtcgtggggtgggggaggggggagggatagcagtagaagatataccgaatgtaaatgacgagttaatgggtgtagcacaccaacatggcacatgtatacatatgtaacaaacctgcacgttgtgcacatgtaccctagaacttaaagtataataaataaaataaataaaataataaaaaaataaaaaataaataaaaaaaaagatcatcctatctaacatagtgaaacccacctctactgaaaatacaaaaaaattagctgggcatcctggcgggcgcctgtagtcctagctcctccgtaggctaaggcagaagaagggcgtgagtccaggaggcagagcttgcagtgagccgagattgtgccactgcactccagcctggaggacagagtgagactctgtctcaaaaaaaaaaaaaaaaaagacaagtgtccagtttcattcttttatatatggatatccatttttcccagtggcagttattgaggagacttttcttccatcattgtgtgttcttggtacccttattaaagattagttgaccatatatgtgtgtttaactctgggctctctattttgtgctattagtaaatacgtctgttttgaactgagtaccatactttctaaattatagtagctttgtaatatagtttgaaatcaaggaatgtgatgcctccagctttgatctttctcaaaattgctttggctattcagagtcttttttggttctcaaagacaaactgtttctgtgtaaaggtaatgtaatattatatatagaaaaccctaaagaccccactgaaaagatatgagaactataaatgaattcagtaaattttttttctggttttatttctggtgtttttagtttgtttgttttttgagacagggtctcactctgttgtccaggctggagtgcagtgatgtaatcatggctcgctgtagccctgagatgcagtgatgaagtgatcctctcaccttagcctcctgagtacgtggaatgacaggcttgagccaccatacccaactagttgttttgactttttgtagttacctccatatgttgcccaggctggtctcaagctcctaggctcaagcaactctctcgctttggcctccgaaagtactgggattactgatacaaagcactgtaccaacctcagtaaagttttataatataaaagcaatatacaaaaatcagcagcattcagttactaacaatgaaccatcccccccaaaaaaaataagaatataatcttatttaaaatagaataaactataaaaagaattaaatgcttgggaatatatttaaccaaggaggtagaagatacatacaaggaaaacaatgagacactgatgaaagatatttaaaaaagacacaaataaattaacagatatcctgagttcatggattagaagaattaatattgttaaaatgttaatattactcaaagcaatctacacattaaatgcaatccctatcaaaattccaatagcatttttcacaaaaagagagaaagtatttttaagtacctggtagggtgcctgacacaaaaacccattattattatttatcactttaactgattatatatatatatatatatatatatatatatatatatatattacaattgctgcaaagtattgatatgacaataatatagacattgtgaatcctctgagagaatcttggagacagcagagttagccatggtcattctttgaaagccactgaattaaagcattacagaaaaaaaaaaaaaaaaacagtaaaacactttgttggtgttcctgggatgatttggatttaactcagattaagattttaatttactttatatcagaaagttctttttgttttgttttgtttttttacaaaatcattgtctcaagtatgtatgaggttccataagatcaagatccaaggactggtgggggttgaagttctattgatatctatagagcttccctgttactgtacattatggttttagttatcttaattgttttagggaatgcttcacctatagcttgcttcttagtttatcctcataacatttacctatgctttcattccttcccataaccataactaaaatgaaattatttaaagaatgtttattacttacctataaattgccaaaccctggagataaagaaatgagcaaaatggtctagctgtagagctcctaaactttgagaattgtgagcatgagcctggttagaaaaattcccagaacaatgatgatactgaaactaagctttaaaaatcatagagtaatttgaggagagaataggagacagttattatagcatccacatgtaacaagatatgaaataagagatccagcaagaattggttgtacagagcaaaagtgaacatatgagttaaaataaggccagtgaccaggcacggtggagcatgcctgtaatcccagcacttcgggaggccaagggaggtggatcacaaggtcaggagatcaagactatcctggccaacatgatgaaaccccatctctactaaaatacaaaaaattagccgggcgtgtttgcaggcacctgtagtcccagctactagggaggccgaggcagaagaatcacttgaacccgggaggtagaggttgcaatgagctgagatcatgccactgcactccagcctggcaacaagagcgagactccatctcaaaaaaaaaaaaaaaaaaaaaaaaaaggccagtgaagtacatggtataaggtactgaagtggtgtgcaccaatgttgtagaatatattcttgggcaaggacaattaaagattctctggacttgacaactatgatggctgctgcaatctgtaggatgtaaatcatttgacattttctaaatatcagttctcatttctaatgatatgattgaaaaatggtatataggttgtatcagacatgtgaagggtacccagcaaaactcaaatcttgaaattccaaataaaatatctacaaatgtataagaagaatgattacatattggggctctgggcatggaaagaggaagaaccatatggctgctttcctcacctgaatccttcatccaaagactttccagaaattgacatctccctcagaaatggtcatcaaaaccataaccaaagaaagaaaaaagaaaagaaaaaaaaaagaaaaacctcacagagaaacaagagtatatagctgctagtcaaagtaaatgtatgcttgtatgagatcttacagcttcacgttttttaggacagttttaattatcacccaacgtattagtttcacagttcaactcagcatgataaaccctgtgggataattttactacaaaatggcctattttccatacacacaatttgattacagctgtgtctttatctctgaaatccatgagaaatatgttcttcctttggagaagaacaatactgataaacttccaaaggacatctctgagcacttctgaagagaagaaatggtatttggtgtacttgggcttcataagccatgcaacacaaatcaagttataacaattctgacactatctatggctgcaactaattacttgtcaaatttgaatgatgatacatcaggtcattatactacagaatgataaaaaagaggacaacccaatcctaaagttatatgcaaccaacaacaaatcttctagtaatgtgaagcaaaagctgatacaatttaaaagaaaaagggacaaaaccacattttagtggggtacttccatgccacgctctcaaaaattgacagaactagacataaaatcagtaaggatatagacaaacatatctagtaaaacatctaattggcatttatagaacattccatccaagagaagaatacgttcttctttttcacgtgcctttggaacatacactaagatagaaaacaaaccacaacaaacttgaaagacttgaaatcatgcagaatgtgttgtttgaccacaatggaatcaaaacataatcagtaacagaaagataccaagaaaatctcaaacacataaatattaaacaatacactgctaaataatctacatgctaaaaaggaagtatcaagatagaacttttttaaatcattgaactaagttgacaatataacaaaatttgtggaacacagctaacacagtgctgagaaatgaatagcattaaatgattttattagaaaagaagaaaatctctggatgggtgcagtggctcacacctgtaatcccagcagtttgggaggctgaggcaggtagatcacctgaggtcaggagttcaagaccagcctggccaacatggagaaaccccagctctactaaaaatacaaaaaaattagctgggctttgtggcaggtgcctgtaatcccagctacttgggaggctgaggcaggagaatcacttgaacccaagaggcggaggttgcactgagccaagattgcgccactgtactccagcctgggcaacaagagtgaaactctgtctcaaaattaaaaaaaaaaaaaaaaagaatgaaagaagagaaaaatcttaaatcagtagcatgactttccacctcaaaagaaagagcaaaataaatgcaaagcaaacagaaagaaaataataaatataataacaaaaattaataaacttgaaaataaaaaatagagaaaatcagttacttcatttaaaaaaatcagtaaaattgacaatcctctaagaagactgaaaaaaatgagacagagagagagaggacatgaattcatgaattaccaccatcatgactgaaatgtgcaacatcaatacagagccttcaaatattaaaggaatagtaaggggatactacaaatagcgctacaaacacatacttgaaaactttgaggaaattaatcaattccatgaaatgcatagacaatcacaatttactcaaatacttaaatataaatagataacttcaacatcctataactattaataacattgactttataatgtaaactcaaaaaagtcatctccaggccaggatgatttccctggagaaatttatcaagcattaaggaagagttcaaatatattttatacattctctttcagaaaagagaagagtagggagtacttctcaatatgctttatgaatatagtacattcatgataccaaaaccaaagaaagtattccctggtatgaaaactaataacaaaaaaaaatgagagggggcaggagaagaaaaatatgagaggcggagagagaagaaaaatagtaaagagagagagaggagaagcgagcagtaaagaaggaaggaaggaaggaagagggggagggagggagaaactaccttgcaaatataaccacaaaagtttttaacaaaatattattaggtagaattcagcagtacataaaaacgaattcagcagtttatacaccatgaccaagtggtgtttattccagggatgcgaggttggagtgatatttgaaaatcaatcaatgtaatataccatatgacatgatcatatcaatgaacgcagagataccatttgataaaaatcaacataaattcattgatttaaaaaacccaactctcaggaatataggaatagagagaaattactcagcttgatgcttgataaagagcatctccaaaaaaccagcagtaaatgttatacttcatgttgaaagaccaaatgctttagtctaagattaggaacaaggcaaggctgaccaatcttcccattattcaaaatagcactagatgttctagccagtgcaacaggcaatataagtaaataagaggtaaaactaagattagagatgaagcaataaaactgtttccattaggagatggcatggcagtctaaatagataatcccaaggaatctacaaaaatactcctaaaactgacaagtgagttcagcaaagcttcagtattcatgataaacataaaaatcaaatgtatttttatatactagcaatgagcatatggacattgaaaataaaaaattaccatttacaatcactaaaaaatggtgtataaatctacaaagtatacaggctttttctatatatagacaagattattctaaaatgcatatggaaaggtaaaggaactagaatgccgcatgtctacaactatccgatctttgacaaacctgacaaaaacaagaaatggggaaaggattccctatttaataaatggtgctgggaaaactggctagccatatgtagaaagctgaaactggatcccttccttacaccttatacaaaaatcaattcaagacggattaaagacttacatgttagacctaaaaccatcaaaaccctagaagaaaacctaggcaatatcattcaggacataggcatgggcaaagacttcatgtctaaaacaccaaaagcaatggcaacaaaagacaaaattgacaaatggaatctaattaaactaaagagcttctgcacagcaaaagaaactaccatcagagtgaacaggcaacctacagaatgggagaaaatttttgcaacctactcatcttacaaagggctaacaatatccagaacctacaatgaactcaaacaaatttacaagaaagaaacaactccatcaaaaagtgggtgaaggatatgaacagacacttctcaaaagaagacatttatgcagccaaaaaacacatgaaaaatttctcatcatcactggccatcagagaaatgtaaatgaaaaccacaatgagataccatctcataccagttagaatggtgatcattaaaaagtcaggaaacagcaggtgctggagaggatgtggaaaaataggaacacttttacactgttggtgggactgtaaactagttcaaccattgtggaagtcagtgtggcgactcctcagggatctagaactagaaattccatttgacccagccatcccattactgggtatatacccgaaggatcataaatcatgctgctataaagacacatgcacatgtatgtttattgtggcactattcacaatagcaaagacttggaaccaacccaaatgtccaacaatgatagactagattaagaaaatgtgtcacatatacaccatggaatactatgcagccataaaaaatgatgagttcatgtcctttgtagggacatggatgaagctggaaaccatcattctcagcaaactatcgcaaggacaaaaaaccaaacactgcatgttctcattcacaggtgggaattgaacaatgagaacacatggacacaggaaggggaacatcacacactggggcctgttgtggggtgaggggaagggggagggatagcattaggagagatacctaatgctaaatgaggagttaatgggtgcagcacaccaacatggcacatgtatacatatgtaacaaacctgcatgttgtgcacacgtaccctaaaacttaaagtataacaataattaaaaaacggaactagactagctaaacaattttgaaaaggaaaaataagtcagtctccctggtttcaagttttattatataattacaatagtccacaatatgttatactggcagaggaacagacacaggtcaatggaatggaacaaaaaactcagaaacaaaaccacataaatatgcccaactgatttttgacaaaggtattaaaacaattcaattcatagcctttttaataagtgatattggagtaagtcatcatcagtgggcaaagaaaaaagaaacgaatctcaatctaaacctcataattcaagctggatcatggacttaaatgtacaacttgaaattattttaaaattttaggaaaaaatagaacaaagttttcatgactttggactaggcaaagagcacttaaatttgacaccaaatacaagattaataaaaggaaaaaaattgtaaatagagcttcaacaaaattaaaaactgctctgtacaagaccctaaaagaattaaagaaaatcaacaaaaaataagctacagactgggagaagatatttgcaaaccacgtattgaacaaaggattactatctagaatatagaaagacttaaaactcaatgtttaaaaagaatgctcattagtatatgggcaaagtcctggtcagacatttcactgaagggaatatactgatgaaaaaaaagcacataaaaaaattccaacattattggccaccagggaaatgcaaattaaaaccacagtgagatagcactatacccttagcaggatggctaaaatgagaacataaataaataaataaataaaaccaccaccagtcatttatacattattcatgaaaatgtaaaataacctgctaggttattttacataactccaggagacaatgttaaggtttcttggtggaaaaaaaaattgccaaactacattttccactatcatacaatacagcaatcactctcctgggcatttatcctagagaaatgaaaacttctgcttgcacacacaaaaagtgctagaatgttcacagcagaattatttgtcataatcaaaaaccagaatcagatcaggcatccttcaattggtcaatgtttaaacttcagtggatggtatatccatatcaggggacagagatattgatacagccaacaacctatataaatcaccagagaataatgctaagtgaaaaagccaaacccggaaagtcatatttgtatagttccatttatagaacattcttgaagtgacaaatttataggaatggagaacaggttagtggttgtcaggggtcagggacgtagtgggtagggaagtgaatgctctaaaaagtaaacatgaaggatctttgtggtggtggagctgctctgttcttgactgtattagtgtcactacactggctataatttgtacatagttttgtaaaaggttaccatttgaggaaaaactggtaaagagtatttgagacctctctatatatttctcacaattgcatgtgagtctacaattatctcaaaataaagggtttactataaaagggtcctaacatcagcaacctggcttattaaaaatgtcatccgaagactgtcatatcacattaatcataattatgtcaacaaaaacaaggtacatatattttaaacagactgtcatttttaaaacaaaaatactaaatcttatttgttcttaatgctctaactgaagcgtaatttttacttatactaaaacaaaaagcacctacatttcttatatgtgagctattttctccccctagagagctggaaatatggttgataacaacattttaaaaggcatgtggaaggacataaagtgaatgcctggagctcatattgtcttctaagattcttggattgaacatatttctattttaagtttaactatttttggcatgttttccaaacagtatctaggctaagaaaaatgtaacatgccaaagtaatggtaattaataattccagaggattatgctttaaataaagtcataacaaagagctaacatgcttttattaaaatgtgtaagttatttgcatcaaggaaagagctagtggatatatttagcaaaccggatatgcactgattttgttattcaagaacattagataaagtgcacagaagaatcctgtttgggagctctggcttcctaaaaaaaactcaaaaataagaggctgccaaagctaataactagatttgttgcccctgattcccacataaagacaagcctcttttgtaatgaatcctgataggttatccccttggcaacctgtcattcaagttcattagttcatttattcatctactaaatatgttatctgcaacaagggcaacttttactttgcatgggtcacttactactaaagcacagaaccagtagagatgagtgtttaataatctattgcaggacattttaccactgattatattctcctgtattttcacttgtgtattttaacataaatcagagaacctcatccttccgttcaaaaccctccaaaggcttccatttttatgaaggatgccacactattcccactgctcagaatgcttcccccccagagagccacctagggagcaccttcatctctttcagatcattgctctaaagtcctcttctcagtaaggctcacccagagaaccttatctaatattcaatttagcctatcttgctctaacacattttagggttcatttacttttcttagtgtccatctttacatttcctttataggattttttttgtgttcttgttcactgcactatcccaaaaatttttctcatgacaagaacagaatatatgctcaacaaaaacatgttaaatggaagaacttacgtttttcttggtttgctatgctttctacaaacacttgcttactatttataatgtaccaggcataattctagcagtggaatcaactacatgctacacaacccttgctctcacaggtctcactgtggaggaaaatattgcagttggggtgagaggaaggtattaaaaccggacggataaccgcagtacaatatgggatatagtgccgggcttcttgaaaaaccccgggatataaaaacaaacaaaacacagcacagtccttgaaactcttatccttaggaatctaattacctaatgagggaatgccatttaaaagagagagcagggtgaggggggaagataaataaacagaaaaacttttaaaagcaatgtaatatagcatgcattgagatgaatgcaaaaaatggggattcttaaagcatggaaaaaggactagctagatggcctggagaactctaagaataacaatgaaccaagtcttaaaagattaatggcaaatttttaaaggtgctttttaaattataaaactaggatgagttttaaaggaaatctgctaagaccccgtctttgaacatttaaacaacttattattattattttggagagtgggagagtaaattgatgaataaaatgtagttgtggtattggccagaagtaaattgaagctatataaggtttgtgataataaatttaagtaaagccagtcagtagtgttttgtgtttgatccagccctgttgagtggcccaggcacaggtgtaaattaggcagacaggtagaattagccaaagctggagttgctccagtcaagtatggtggcaggtacatgtacaagggaatatagagatatcccaataagtgattctaaagctgaactggaaatataagctgaataaggtcggagtgaaggcttaagaaggataatgaacattgaagggtaggcaagatcaatagtgagttgtagatccttttgagatcaaagaattattggagttcagggtgttgaagaggtataattcaaaataaatcaaatagcagaggtcttcgcaaattaataggtactaaatgctatgttttcaaatgaatacttaacaactttctcttaaatgcaagaggctggaccaaatgatctattatcctctatgataaattataagagagatgtctaaggtaggtttttcatttcattcaagtttaaattgtttgctgtatgattttattgggggtagattattaaacacaaataatattttaaaagtctctaatattgacatttatatgctggaatttaaatgacattgaacttctcaaattattatagatttgattatctctgtcaaaaatctcttatacttggatcaaagagctttccttctttaaaatactttcttactaagcaggattggggaccactggtgagtacaaagtttgggcacattatataaggaaagcttatggaatttgagaatgcttaacctgaaacaaaaagaaaaaatttagcagtcctaagatgttgaaagtgggcatgcacaaggtaagatctaaatagttccgaatttaggctctggaatcatttagatctacatttgaaatgtagctttgtgacttgggcaagttacttatcttactaaaaattattttcctctttctgaagcatttctgaggaagtcatttgcaaggttggtgagaaagggaatttgattacatgaacttaaatctacaattatttaatcccatatgcaaatagatgaaatatttatgtttttgagactagaagcctgtcttctatttaaagacactgtccttcaaacagagctcttcttcgttcctcagtctaatcaagaactctaaaaccaggaaaaacagcatatgggttacatgcaattgaaaactcaatgattccacctccaaaactggaatacattttggcagaccagactgcctctaggcttaggacattactgacttctctgactatgggatttcacagctgggagcaggaccaacttagcaaaactcttacatagatgaaatctatctttggatttatgctgacaagtaagattctgcaactggtttttaaaatattttactaaattttatgtgtttaaatgtaagtatgaaagaaagaaatttgaagttgtcagagcttgttgaaagactccttatttaagcagaagttgacaaatttattacattgtgtaataaaagcaggctatacatttcatatcgggaaggaattggaaagagcagaaataacaggagtcaggaagaaccacttgcttgtattagtttggcttggcttggagaaaatatccaatttgtcaagctagggtcaggaaagtcaaggtgtaattttccgtctaacaatggatagttataaagggccaaacaaaggtaacagtaatgggaatggatatattataatctacatcgaatatctctggattcagaatgcctttaatgttgaattctggagtatgttaccttagataagttactcggtttttcctcagctataatatatctatttttagagattctgcgagtattaaatatggcaaattagtaagtatttatatctgtgcctggcatttaggaggtgatcagtaaggtattaccagtaatgtaacggtggatgccttcagtgatcattggccagaaatgttgtacgaaggatacagggaatgtttgagggcttgatttaaatggttatcacaagcattcatttaatttaaattttgttgctcacctaccatattgttgtcattttgctaggtattggaactatacaaataaaagccctattccttgtatttaagagtgcagtctagtagagaaagaataaaacaacaggataacaaaatgtgctatgaaagcacaaaggacagatattagcaaagaccggaagcataaaggggcagtcgttgaaaaaggcgtccaggggtttgaaacaatggaagcgtatttcaagttgagaaaaaagcaaatgaaaagttataacatgtaaaaagcacagtgttgcagaatacggaaagagaacagtatagcagaaagaggacgtaatttataattaaagaacctggtttccgtggcctggctatgccatatactgccacaggactaagcaaattgatacaacttatctaagtttcaaagtactgatctgaaaagtgagattcataatatctaccctgccatagttgtgaggcttaaatgagataagttatgcatttacttcagaaaagtatttctttttatacccactatttccaaatgagctgacagtcttcctttcttttggactctagtcattaactctaactctctccctgcttccacctggacccctgctcctaacccattctccaccatccaggctgaagaacctaaatgcacaccagatcaagtcacatccccacttaaaagcccccaatgacttcccattgctcctaaaaccaaattattaatgatgggctaacagatcattcatgatttgtcccctgactgtctcactaaagtcattttcacgccttgctttcctcactctctgtgcaccagccactttggccttctttgagtttacacatatccatgccccttcctgctatttgtattttgcatattacctttaccttgtccttgtcctcctctttctcccactttgcctatataatttcaaatcttttttgttttgttttgttttgctttgttttgttttgttttgagacagattctctctgtcacccaggctggagtgcagtggcgcaatctcggctcactgcaagctccgcctcccgggttcacgccgttctcctgcccaagcctcctgagtagctgggactacaggcgcccgccaccacacccggctaattttttgtatttttagtagagacggggtttcaccatgttagccaggatggtctccatctcctgacctcgtgatctgcccgtcttggcctcccaaagtgctgggattacaggcgtgagccacggcgcccggcccaaatcatttttaaaatcttgcatcaagtgtgcctatcccacccttatttattaggccacatgcccctatcataggatctcccaggacttgcttcctttactttttagcacacaacaaagacaaaattttgcatttgttaagtgataatttgcatccttccaaccagaccatgaccccaggagagtagtgaatatttgctttttcttgtactataacaccactgttcttttcatgtcagcatatctctctgctaagtttagtgccaagtatatagtatgtgttcaggggcatcttttgagtggaggaatagatgaaacttcaaatccagtgattggtcacattattaataatcaatcaacaagagtgattttcattactgccattatcattctgctgctattttatgtttagggtttttataaatagagcatagatgcaagacaagaagggagaaaagtgatgctgggggaagtacaaagagactagataggtaataaaggtttatttgttttataccttgttaggtcatacgggttttatccaagtgtataagaggaagaattaaaggggcttaagcagaagggcatgatgaatagctcaatgtttaagaacctctggtagcagaatgcaaaattaattacaactatgaagtgaaggcagggagggcagttagaagactcttatgaaatcaaggtgagaagtaaaagaaagtactgaatgaagactgtgaatcctcagtttctgtagttttctaatcttcctgtgtttaatgctgtgtcattaataatttcacatgattggtgaaagtggcaacctttcattccttgtttaatcactcacaatattaatgtatctataatataacttcaaataaagaaacacagtcctggataatacttaaaatttgaattccaaacttcaataccattgtatgtactcagaaagaaactatctttgttgtaagaggagaaatatgtaatacaattatatgttttttttctgagtcttgatttaaaaggaaactgtgaaaaaacagtatggcataaagatgaaaaaagtctctttggaccaaaatttcttctttgaaaacctatgctggaaagaattcgtatgcagtgctgacatgtaaattcaaggatatataatgtttactacttaaaccatttactttactaaccaaaataaaagacatggttagctggattatcaagcaaatattcaaaataaaattaaatttaagtatgctcagatctctatcataaatcataaatttcctctggtgttatttctctccattatatgtaaatagacaaggactattcctgcaaaattgttttaccacacagtctgtatttatgcatctaaaatgttattcttcatggctatgtttctatagacatcaaggttatctaaatttgattttgataatagtatatatatccaaaactatgataagtgatggttcactagttgttagtacttttgttataattgaactcaaagaacacaatcatgttgttactggtttcatcgtaaggttaagttctccagtataaaatttcattactaggcacttatgtgggagaaaatagtttggtctactctactgtctttatatactctgctatttctaattcaaactcatgaaaaaaatgtttcttcacattacactacaaatacgattaccatccataagtaatgatttacagtaaaaggcaatcaagaaaaatcatgtttagaagatagaaggaacaataaatatgcataagtttttgaagaatattcttgcattttcatttgcctctgttattcctttagtttgtttcttaattaagggcattttagcataattttaaaaacataactgacaagtgataactttttacttacaactaattaggagcctaatttacctttagccctattgttttacacacctcataaaagataacatcaatgtctgatccctcttacgcatctcttccttctttgtccctctacctaaaaataaaaataaaaaaccttaagatgtataagataagcaaaggttttataagttaattttaagtgtataaatgaataaatttgttaacacaaaggtaagttgacatattagcataccaagatgtaatgtcactaaattgtaaatcaagtaattacacagagtttattcatacctcttttccttctttggtattccttaaccttttcaagtttaatgagctaatttcaattttgaaaaaaggaattgaaaattagataattacatccagctttattttaaccactaattgacctaagtttcttagcagaccattgagaaaattaaagctcagagaaacagaggaatttacccaagattatcaagttaacagatgagaaaactaggactcacatattggccattatattcattaagtaatataataaagtatgtatgaaattgtgcagaatacaaaaagtgtttaagatctaaaagcaatgatctctaagccataaaataaaaacacaaaatcaggccgggcgcggtggctcacgcctgtaatcccagcactttgggaggccgaggcgggcggatcacgaggtcaggagatcgagaccatcctggctaacacggtgaaaccccgtctctactaaaaaaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaaacacacacaaaatcaaaatgtttacaattgtaataaatatatttaaattgaaacatcaattagctacaaactccacatatgtatatacacacatattatatataatatagttatatattatatgtatacatgtatattaacatatatatatgtacacatgtatatggccatatacattacaaaggattgaggcaaatattgagcaaatgattattaaatgtaaattttcaaagtcttaagatcatggcctattatacacgattatatgcaataaaagcatgcccacagaatactctcccttaaagttagagtgtgaatatatgacgtaaccatgatttgcattgagatcttttggattccaaagtctaagattttatcatgacactaccctataaacatggcccacagaaactgtgtaacttggtcaaatcttacagcaaattcagagctagagaatgtgtaaaatatacataacccctgcttcccaataaaccctatgagtataagctatttgagaaggaatttaaatgcccaaggatcacagaattatgaaggtatcatgtggccacctagattagggtccttagcctagaattcatgcaactgtaagggatttagggtggcacagaattgttaaaatgatatatagctgtattttgtgaaaatttcatgtttatgccaattaaaattatagacaacatgttattcttaaagggagttataattgttaaaagtttaaaaattattgatataaacaactttttagatgactaagtggaaacacagagagccaaagtgactgtggagaaccatacaactggataatgggagaatagttattagaacgtaggtttcttccttcctttccctcctcaactgaccatgtcatggtgccatatgtattaagccacaccatgagcttgcaaaagcaaagctaatatctgcagaggatggcacatgattatgagaaaatgagaagccttagtggtctgaggcatcctgatggactctaggtaacttactcctttgctttccaaaagagtaataagaaaagctatatttaatttaatgtggttccatttgtagagagaaataatatctgcttctttattaacttatggtgcaaggataactcaggccattttctaaggaaactcaatgagttagaatctgctaacctcagtaaacaaaacctcagttagctgtaattaatgttcatagtgcatctgcttaattttcctaatgcactagcccttttttctttcgttttcttttttttcttttaaaacttctgtaattcttcatgagctttactttcagtaacttatggggaggtttcttaatcttattttaacatggtattgcaatattaatttgaatttttttgatggtggagggattttaagaaacaattttaaaacaaataggtctattcatcaaaatgttcaggctaaaacagttgtgaatatcgtgggaataacttataagggagacgacatcttcattattagttcagtggtgtctagttgaaaatgtctatattacagagaagttggcaggagctgctaaagaatgcttcagcttgtccacaagtaagaattaatcctaactgattactgaaaaccagagctttgcacaaaattgccttttcattcatagtggcatctcaacactgattacgtgaaatctgcaatgtactttcaaagaaactgagatgatatacttgataaggcataaaaattgatctctgccaccaccaccaaccatgaagcagcctacagcatcttgaccattaaatgaattgattattaggggccagacagtctgctaaatacattgcatacattattttatgtaaccttcatgggattgctattatatagatgcaattactcttaatctatctacattatagcaatgttatttcatagatgttttcatagatgaataaatttgcatttaaggagaattaaaaatttgatcgtttcacagaatgattaagggaagaaattctggatttgacctcaaattaccttgattccaaagctagttccattaactatcaagttacatcctttcccattctgatagcaataatgcataggctaatggatacattttttataatgatcaaaaaattacaatgaaagaaaaaaagggtgggaaaaagagagaatggagggagtgagtgaagaatggaagagacaaaagaagaaacaaataatttagaagcagaaaatcgacaatcagaggagaagacattgaagataaaaataaacagcaaagtaagagtagactttttgttgccatggagatttcggaaatgaaggtaaaatgtatctgcatataatacttgcaaataaagatctgtaggggtagcaggaattcctcatgccaatgaagtaggtgcccagcaggaggaagctgactcgcactccttacatcagagcatcctggcctaatccagcgaattctgacatcaagctcccgtgagcagagtctgaaccatttaacctagcatggtgagagagtctatttggtcatctttattgttgcaaataggggtattttttgggaaaatgtatgatgcgtaaaaaatataattaccttatgactctacattgaatgcatacattattctctctttaggatcaaatccactaagagaatcaagaactgctgcacagaaacctttgatagccaatgtcctaatacgaagaagaagtaaatgaacagaaggagacatagacttaaagctctcgcaaaattgaacaatatttcaaggccctacattgaccaaacattaacgttaaaagagcctcaccatgtcagcattccagccagcccaaatcgtcaaagagcaagaaagcaatgctaaagaacaatgtgaaggaatcattacataccgtttgaatagtttcctaaattcactcagtgctctatctattattagctatagcacagagaacttgtttcctattacagatggtagagaatttctagtttgcataaaatcaacatcctctaaagttctgaaaaaacatatgtttgcagacgcttacccaaagatagcaacggaacattcattattcattagctgtttcatttcaaattttttatgatctatttgccatatttcactgaatctaagatcttgcagacaaagttgataggtactccctttgtaatacagttaagatcagactttaagatagcacgtcgtgttgctacatgtaagagttctgtaagtctaatgcgatagatgacaaatattggaagctaagcatatgtgttatttttctgcatttgtcaattactattttagaggaaatatttaggctttccttgctcatgttcctgacttggtccacagagaacaaatgtccacaaataatcttgtctttatgagaatattagaaagaaacaaataacttctttttcattttatagctttaaaagcacaagaagagggagggtactacttcattctccatgtatggcttgaatcaagctggtttacggatctctgcattgcacattaggagcatcatatattggtcagaatcctgatggtgaagtcaacaatacaaattcaggcgtcaagcctcactctcacacctgacaattctgtgtattttgaagcactccgaaatctttatgagggcagacttgccccatactactatcagggaagaattatcttgcttctcagtgcaaaaatagttgtaaactgtcaaagctatttatcttctcatgtcaactccctgctcattattagaggttcagggaaatgtcatttctactgagaaatggtttttacaacccaaatccaaatccaatgctacctcttctgtgatcccttaacaattttaatcttattttagcacttatcacagcctaccagatagttattaaaattatttgagcatgcaccttgctcattgactagaagtgaatccctagtggttagagattaggtaacacttattcatgtagcctcccacttcttacaaagtacattacgtttgaaaagtatggaaagacttgaatctttaaggcttatattttttattctagttcagaagagacagtgtgcccaacatcagtaagtcaggtattctggagatatttgctacatagtcacaagtatatccattatcatatgcacacatacatatacacaaacatacatatatatgtttgtgcatgtgtcaaatacacacacaaacacataatcacaaatacaacactacaggtatcttcccttttcttttcacaattgttgctagtaactccacctctatttcttaatagaaatttagactacttaaggaaagaaaattgtagagatcatagagatctaccaagaccattagtatcacagcacatggtacagaaaacagaatttgtgttactactcaacagtgccggctcatcataaaagcacaaagacaatttgctgagctgagctgagcttggtttcaatgctattacttcaattcattttcccctaaagatagggctgttttttttgcctctttcaattgaactaatgtacatagagagtagaaaaatggttaccagaggctgggaagggaagtgggggctctgggaagtggaggcacagatgattaatgggtacaaaaacaaaatagaaagaatgaataagacctactatttgatagcacaacagggtgactatagtcaagaataacttaattgtatatttttaaataacttaaaaatgcaattggattgtttgtaactcaaaggataaatgtttgatggaatggataccccattttccaggatgtgcttattttatattgcatgcgtgtatcaaaacatctcatgtaacccataaatatatatacctactctgtacccacaaaaagtcttaaaaataattttttaaaaattttaaaagctttgcttcaattagtcttgaatgcttggttctggcaccgcctacttcttgtgggcatagtgcccactgtacgtgttcaagtgagctgcactcatccatctttcactagggctgattcatagggcggccagaaccctatttagaaccatagcttgctgcttacataaatcaatgaaatcatatgaaacacaatataacatggtttcattgaaagagcacaggtgtcaaaaggatgtgagtttacatattacataacttaatatttatttgaacttggactcgtcacttagcctggttgaacttcaaatcctttattggtgaaatgagcatccactcataaaatttcataagcctatttcaaaggattgctaccttatataattttataaactatgaattctcatacaaaagtcagtgataccagatcacacaatttaaaatttataggcagacacttcactacttttgcttcccttcactgtgaagtaacacatgctatcaccttggtggcactcgcagggtatctgttggctggctgttttattgggcttcttcctgccactcaagtgatcatgactgagaagaaatcaatgggtgtctgttggcagtgtttttaaagacatattccttaggtaatacaggtagtcactcataaaaaaaactttttttctggatattagtctgccctcgtggatatctcagggcctcatacttcatcaggcaatggccagttcatttttttaatccaaagctacacagagtgaaacactttattctgtgtgtgttttaaaagcccaggtagcactaaataccattttccaggaagtgtgccaagtactttggaggatgtacattgaacttttcattagaaaagcttcccaaatggataagagttatctgacagaaaatagtttcatatctcattatacctttgagtgtgattacacaaaccagcttggaagactaccaggcagcacctggctgttctcaccttgactctaccattagctaacaatgtgagttagggggcatgtcatttaacctcatcgcttttgttttctctcctgatctagaaggcatgatatatttgccacttgaggtcctccctgtttctaaaagtgatcaaatgtggtttttagtagagcagattgcagatattgaaacaatcaaaacccagttggaaggaaagagaagatatcagtgatctacagggaaaaaaacactagattcaaaaatttattttagtgctgagctttctagtgttaaggtaaaactaactaaacacatgtaaattatatctatatataaatatgttataaatatatagaaccattatatatgttatgtattatacatatatttatttatatataccataaaacatatttgtgcttatctataacacataacatatataatatatattcatctttcatatttattatatatacattatacatatatgtacatgttatgtgcatgggaataatggtttttcatatagacagatattttcataaaatttgtttcaaaagtaatttttatgctgacatgtctttatataaggactttgaataacaatattcttgttgtctttaataatagtcttatagaaagaaattaatattacatttccaatattttgtggtggtagtatttgctaaccaatgcataatcctttatatacactgtctgttgttatttaagtgtccctgaaaagtaattgttatctcctgtttgagaaaggatgaaattagcatttagagaagtcgagtgattttcttattgtcaattagcaagtataacagtaagccattatgatgtggctgtttctacacatctgggtgtactttagtgggcatgcttcttttgtgaggccaagtcaataaagaccatgttggctcctgaaatttagtatatgcatactaaggtctacctctagtgggataggataaaacagtcaggaagatattttcctaaagtaaatactgtttccactcagtttttcattgcaaactggataatagccatctgcagacaaaatttttgatgggagtacatgatgagagtactttaagttgtttgtagaaagaaaagctatacattttaactaccaaatacaggtagcaaggctagcactatcattaacaccaagaagctttcttcatattctctcatttatgactacacagaggtagatataagaataaatttgatgagctctcaagcccttccaaactttaacattctgtcaccatagaataaactatatataaactaagcaaacgtttgactccactaaaaatatgaaattcatcagtgcatccttgttctggtatgaccctcagaccaccaaggtttaactaatggacttctgagtattaccttggctctagtctgtagcaatgctcaatgaatagaagataagtagactcttctgttaatactagtttatgccctacaaaataaactttattgagaatgtcattcttgagacagattcattcaacaaaattaaaaaacaaacaaggcatagcataatgtacagaaattgaaagctggccttcagcacacctcctccttccaccagctactgtgttttacttctctccacagatgtaatgaaaatgcctcttaccatttatccaataaatacctactctgctctcagtacttgatacctatgacttaatccttccaacaacctttcaagagaagaatgataactcccacttacaaaaaaggaagcagaagctgaatggccaaggtaacagagctactaatggcagacccaggatttcagtccaagtgtatctgattccaagcttgaaccctttaacacaatatgcttcttctcacaagtactatatcagatgcactgttgcttcctgttatttgttgagtacccaccatagagtttctattccagaaggaaaataagagatttagaagaaaatctacagaatgtttggttttcagttcctacagagaaagggtcataagtgacccaagcatttagataaaagtctaggtcaatatgcccatcactagcactttgtttttacttcttaccacctctttctccagtacctccctcctactctttcagttatatatccactgcttggcacatgataggccctttaaataaaattacttaaactatctgcctcaatttcctcatctataaaataggataatttaaatttcaggtttgttgcatggatgaaattagtacaatacagcatctgacacaatatatggcacataattatctaataaagggtagttattgttgtcattgccattacacatttgttgaatgatttagtgaatgaagctcacatgcagggcacatgtagtgtctataggccaaatagttgtgcttaacaccaaggagtatctgtgtaccaaatccaacccccagaatagagccttgcccctcagaaacaagccacttgtcagtaattatgtcatcagtgatgcaataatatgtgaaatgtactgtggcgagatccctcagtcattgttcttttcaacatcatatcagtacaaaggcagctgatgtcacttgctgggcttaatatttctgccccttcagttactaattcattaaaaaatgcatttatttgttctaacattgatttattcaatatttttaaaaatttattctactatgtcttggacatttatctatctatctatcccaaatgctatgagaggcactgggatacggaaattaaagacctgtccttgaagaacatttagttctgtgaaaaaatggtcatacaatgcaataaggactagagaggagggctgatacaaaccatggtgatgggggatagtgggaagttatgggattataggattacataaaaggttaggcttcctaaaagagcacccagaattttgaaggataaataagaaaaataatattttaaaataaacttttcatttcagaatagttgtagatttatagaaccactgtaaatattgcacagaaagtccctatatactgcatacccacattttcctgctaacatcttgctttaatatggttcatttgtcacaaagactaaactaatattgatacattattattaactaaagcctatagttagttcagacttccttagtgtcttcctagtatccttttgcttatctgagatcacatccaggttaccacactagatttagttgtcctgcctccttaggctcctcaaaacggtgactgattgtcatgtttttattgttttagatcaccttgacagttttgaggagcacgaatcgggtattttgtagaatgtccttccattgggatttgtctgatgtttttctctcagattacattggggttgtatgttttggggaggaagatcacagaagaaagtgccattcttatttacatcatattgagggtatgtgctgtcatcatacccttatcattgtttatgttacacttgatcacctggtattagtgtttgtcagctttttccaccattccatactatctaggctttgtatagaaaaatgtcatatcaagaacaaaccctttcagctgggcatggtggctcacacctgtaatcccagtactttgagagcctaaggcaggtggatcacctgaggtcaggagttcaagaccagcctgaccaatgtgatgaaaccccatcactactaaaaatacaaaaaaaaaaaaaaattagctggtcgtggtggtgggtgcctgtaatcccagctacccaggaggttgaggcacgagaatcacttgagccccggaggtggagactgcaatgagccgagaatacactgccactgcattccagcctgggcaacagagcaaaactctgtcaaacaacaacaacaacaaacatacccttttatctccaatacttcccaaatttcggagtggaaggattatttctgatgccagaacctgtagaaaagtttctgctataaaacaggaagacaaatcagacacctttggtttaatcattcatatgattcaatgaaagaggctgtactgcctgagagatgtgacatggctctggaggcccctcttattatgattttcttcatacacacaaagagctgttttatgggctgcagctgcagcaaccattaggaagtacctcataatctcaacagtgcaaaatctgggcagggacagggtgagttcagccatgcatggtttatgcaaggtcagggaggtaagccaaagcattaccaattgttaattctcactattccaggggctgaatataccttatctaatttaatttaacccacataattaccatgtgagttaagcatttctggtcctatttatagtgtacaagtgaaagtctcagataacacaaaatagtaagtgcagaattggaatttaagcccaggtgtttggacttccaatctcatgtttatagcatcaaaagacattttaggcaacaatccaacattaataatatgtcacatccattttccaccacagattgttcagagcatgctcccttacaggaaacattcttaagctaagtcatcatctttcctgtaatgggagaaatagtagaagtccatactaagaatgtggaccacagtagaatttagtgatagactgttggaattgctaaagatcagtgggtgctgacagtcagagaattaaaactataacactgttagaggagtaaaaacaagccaaattatggccatgatggtcctcattcaattacactagtaggtagtccacttaaaaaactccatataatctggtctacatgtcctagacacagaaccggaggaaccatcgattccagcttcatgcctatctggtttttgatgaattaatgatccattatccctgtgagaccattcattacatattattctatgttaaaaataatgtgtgacatacatttatgcaatatatactatgtgccaagcatgatccttagggctgtattaatcattatctcatttaattctcaaatatccttccatgtaatcacaatgaatcttatttggcaggaaaaagaaaaaactggcttagtgagattagtgctttctaatggtggcagaattagggctcaaatccaggatattctgtttaccaaggctatttcctttccaataccctgtgagagtctccatgaagaacgataaataatacatttgaccacagtcccctcatttcaccatctaaattccaggtcatagttatctttacacaacttcattagtgaatactgaatggatttgttattacaacagtctgatactcaatattttgaagctaatgaaaaaaagaacagaagggattcagtggatatttggagtcctagaaaaaagaaaaagctttatgaagttcctcagaagtcctctgcttccctcaatgtaataaacagaaagcaaaatgtgcaggaagaaataaaaaagaaaatatcactaacaaggtcactccatcacctgcacaagcctctttaaaatcagcccacagccaaggttcctgctgtcagctcactggactggcaactcattggataactgcttccttaatcctatctttctgcttccttgattctcaaggaagtttccaaaagctggggctgtatataccagaattattgggagaacaggtggtatgtaaggttgcagtattcatttcaactcaagaaaatgattaactgcacagctcagcacaatttggagaagttttcaagtgcaggcagtcagtactaaaaaactgcagctcaaattcccgtgatcccttgaaaaaactggagacagatatgttaaaaggggaaaaatcatgtgaagatgaacggtagagctaagaaatgcaatttttagaattggaaagaattgagctttaaactctagactctatattttttgggcatgtcacttaagttgtcagagtctcagtttgtctatgatggggttataacgtcttcctcacaatgttactcactctttaagtcattcattcattcagaagtatttttttccatagatattatgtaccaggctgcccctgacatttgggatacaactgttaatatattagacaaagtctgtctcatggatttgggaaaggggcagacaataaacaagagaatgagttaaaccacatgagaatttgagatgataacaaacgttcttaacaaaacaaaacagagttttgtgatagatcatatcctgggaggggctggtgaaatatttttccccagcatatcacatggggcctggtttatagcagttattccatttacattttaactaaacacatgcctggactctagtaagtgctcatttcatgcattttctttctatgcttgtgaaagctggtttttgtagcctaaaggagccaatattcactatacacactaaccgtaacttcaactattttgatattatagaacttttactccatattcatcatataccaactacttaaatatgaatatgatccaccacaaggtagaagttatgcaagattaaaaataaaagaataggctgggcgcggtggctcacgtctgtaatcccagcactttgggaggccaaggggggcaggtcacaaggtcaggagctcgagaccagcctggccaatatggtgaaactccgtccctactaaaaatacaaaaaaaaaaaaaaaaatagacagacgttgtggcacatgcctgtaatcccagctactcaggaggcagaggtaggagaattgcttaaacctgggaggcggggattgcagtgagccgagatcgtgccactgcactctagcctgtgtgacagagggagactccatctcaaagagatagacagacagacagagagacagatagatggataaagagtattttactcttttttactttccttactagtctggcctgggaggtaaaatgtgctcaaatagaactgcaataaacgacagtgcattataaggtcctttagtataaaatgttttctgtgtcaagaagtggatcacttgtcatggggctagaggagggttcaagcaggaaatgggttttgaactaggtcttagatttaaaaatgaaaatgtaggagcaaatgctttgtaggaaatctgtttaaaatgtctcatccccagagtttctgattcacaaaatcagggatgggtcccaagaatgtgtatttctgacacgttcccaggtaattttcatgcacgtttccagctatgtttttttccaaacagtgatgtattatacttggaaagttactgtatcactgcaccctcctgtactattatggggcatgaatgaagtatatgcaaagagtgtgtgtgtgtgtgtgtgtgtgtgcgcgcgcgtgcacatgtgcgttcattgtgtgggtacatggaaaatatcagaataatgatgaagaatctttcatacaccatcaggggggtaattgttatccctttcttttgtctctgctttccatcttacacaacatgacccccaaacactcttcttctgctctcttctccatacttcccagacgcatcctacctattataatgttaaatcaatggagtattgctatcaagttgagattaaaaactgctggggtccttagaacctctgtagtctcagagtaatacagagtagatcacaaatctagtcccagacataccagggtctttccttgtccagccatgcgtgttcatcatttccttagtattttaccttacagtgggtcagttaagaaattttaaggccaggggctgtggctcacgcctgtaatcccagcactttgggaggctgaggcaggtggatcacgaggtcaggagttcaataccagcctggccaacatagcgaaaccccgtctctactaaaaataaattaaaaaaaaatattcaggcatagtggcacatgtctgcagtcccaggtacttgggaggctgaggcaggagaattgcttgaacccaggaggcggaggttgcagtgagccaagatcacaccactgcactccagcttgggcaacagagtgagacttcatctctaaataaataaataaataaataaataaataaataaataaataaataaaaataaattttaaaataatgatcttaatattaaagttgtccatcagaggccaggcacagtggctcatgcctgtaatcccagcactttgagagatggatcacctgaagtcaggaattcaagaccagcgtggccaacgtggtaaaaccccgtctgtactaaaaatacaaaaattagttgggcgtggtggtccacatctataatcccagttactcgggaggctgaggcaggacaatcatttgaacctgggaggcagaggtcgcaatgagttgatatctccacggcactccagcttggaggacagagtgagactctatcttaataaataaataataaagttattcatcagataccaagtatcttttttaatcccaaagatactcattgaaagattacataaatacaggttcagacagctagccctgccgggccagagatactgaggagactatgcctaatgatccctcaactgcaccatcactaaattatctgcagcctcctttaatttcagactcttatatcaggatcttcatagcaaaaataattctgatcatctaccaaattaatgaagaagtttattttggcattaaattcatttttaatttgcttcaaataatgtaagttttcaattgaggtagagtttattaaacataaaatactggcagggatgtttatgtatatcttatcacctctttagctcaaagatctcaagatcaaaataacagaaaatatttgtattctattataatatattatgaccaaaaatatcgggaaaacaaatattttctactttgtccaactttcaatgacatattttcaattcttatgtgtattactggaaaaaacaaatctaataccttggccaataagcttgaagtatgaatcaagctttgaaatataatattggaccttcacagtctgctaacaaattatctacaccttggcccagaattgcttcatagtagactctctaaataaccataactgactgttaaacaagtgaatatctcaaaggacaggtaatcaaatgagctctacaccactaacagacaatttttccactaaaaaagatttatttatatcttcttaatgtctgcctcaagccacaaatctatacaatgttagttagcaggagaagctgaaaattaggtgtggtaagaatgaaatctagaaagtcatcttcacgttatactggcttcattttttcttctgtatcttgtaatgtgaggatgtgggagtactggcataaggaaaaaaatgttatgaaccatccttttctagtccgaagagaaaacctccatttgtgtctctaactaccaggaagcaaccttaactctgttcaagagatatcactagactggatctgccctggtggctgacaataaattgtaagctcagtggctcagatggacagcaaacatgtttggaagttgctaaggatggcaacaagagacaacatggaaaggtaaagataggtcatattgatgaagacttcagtgagagtgaaaatatgagaaaggttaatgcagacataaggagagtagagtcaatatactctacactctttaattataaaggagcatgcaataataggaactacgcaataacctggaagtgatctatgcttacaaaatgcatcagatggaattgaaaacatgttcatgatatatcattattgttttttaaattaagtcacaaaggaaggtgcaaaaatcaatctcaatttttgttcaaatatgatttaataaaatataaagatagagagggaaggaggaaaagaaatggatggtgaaaatttatgctggcaaggttgcatagaaaaaagaatacattgctggtagggatataaatttgtttagctgctatgcaaaacagtttggtgatttctcaaagtacttaaaacagtactaccattcaacccagcaatcctgttactggttatacaaccaaaggaatataaattgttttaacataaagatacattcatgcatatgttcctcacagcactattcacaatagcaaagacatagaatcaacttagatgctcatcaactgtggagtagatttaaaaaatgcggtacatatacgcagtgaaatactacacagccataaaaaaagcaaaatcatgctctttttggcaacacacattttctaagcaaattaactcaagaatagaaaaataccacatgttctcacttgtaaggatgagctaaatattgaaagcaaatggacacaaagaagggaacaatagaccctggggactacttgagggtggagggtaggaggagggagagaataaaaatctactcactgggtactatgcacattacacaggtgacaaaataatctgtacaccaagcacccacaacacacaatttacccatgtaacaaacctgcacatgtaccccctgaacctaaagtaaaacttaaggggaaaaaatttagagaaaaattagaaaatttaatgtgaaactgccaatagtagttgactccatgagtagaattgagggtcagggtttcatatagacactttatacttctttagcatctgcatttggaacactgaatatagatagcatggtgtaatagaaagagtctttggagtgagaaacatctaaaataaaattttgtctcaagtttactgtgactttgtaatattacttattttctctgtaccttagtttccttggttcctataaaagacaattatatctgcattgtaagacaatgtgaaaataaaatgagattctatatatgaaaatactaacacatgagagtcattcagtatatgcaatctactattatttctcatattctaagccctgctggaaggaaggaaaaggaatacattaatcactctttctttacctttaaatggaatacttttaagaaaagagaactccatagggcaacagggaaagtcaccctggaaaattaatcttatgactagttatttctgtcttctcacagtatttcacaacctattgaagtcatatgttttaagtaacccatgtgacgaagtggaggtgttgaagtaaggaatggtcaaatgattgcacatgggacagaagaaaaagggcttcatcccatcttctcaagagacagagacaagttttcctttccaggtgtttgccttctcttttatattggatgcttgctcactggccacccccacaaagctgtaccacattttctttcttttttcttttctttttttttttgagatggactctccctctgttgccaggctggagtgcagtggcgcaatctcggctcactgcaacctccgcctcctgggttcaaacgattctctggcctcagcctcccaagtaactgggactacaggtgcatgccaccacatccaacaaatttttgtatttttggtagcgacagggtttcaccatgttgcacagggtggtctcaatctcttgacctcgtgatccacactcctcagactcccaaagtgctgggattatagacgtgagccactgcacctggccggcattttcttactcactcaaatatttttcaaagcctgaaggaattagttactaagttacagtgccaaacaggctactgaaacaaggaagactaggaagtttggtttattagatgaaaatagtttatgacaaagcttctgattttcacacttttacattaagtaaaaaatcctaaccctggggttgcagtactgaccaagctctcataaattagtcaccctggtctagtctacaaaataagaccgtgacatctaaatcctgaaaggaaacacttccatattatttagcatttctgttttcattaggacatgtgaacgtatttaaattcaacattgaataaatataattcagtatgtatttatttgacctccatgtactcaaaactatggcaactgctatgaacaatgtcaaagaaatttaatatcactgctatggtctgaatatcctctccaaaacacatgttgaaatttgcccttgtggtggtgttaacaggtgggactttgggaggtgatggggccatcagggctctcccatcatttgtagaattaatgccattttaaaaaaatgaattaggcccccatttgccctcttttccttggatcttctgccatgtgagatgaagtatttcttcctccaggaggacaacacagcattcaaggcactatcttagaatcatcaaatctgccagcgtcttgatactggaccttccagccaacagaattgtgagccaatacatttccgtttataaataatccagtctgtggtagtctggtatggcagcacaaaacaaactaagacaaacccttactacaagaagcccacatcctcattaattataactaacatccacgcagcacttatcccaatttttattacctgtttttttaacaatttaagtatcaaattttggcagacatggtggctcctgcctgtaatgccaacactttgggaggccaaggtaggaggatcacttgtgtccaggagtttgaggccagcctttgcaatatagtgagactatgtgtctacaaaaaatgaaaataaaaaattagccaggagtggtggtgtgcacctgtagttctagatcagggactgagaaagaggctgagacaggaagatcacttgagcctgagaggtcgaggctgctgtgagccatgatcatgcaactgtactcagcctgagtgacagaataagaccttgtcagaaagacaaaaacaaatccaaaacacatttgaagtactataatttttagccatatatcacatgacgaaagtgtttggtaacccttaataaacacacaatgtaatgatcttaaaaaggaaagatgcctcagtacatctctaaaagaattggttgatttcattttgttagtaatagaaaattaaattaaccttttctgttttttaattatactttaagttctggagtacatgtgcagaacatgaaggtttgttacataggtatacacacacgtgccatggtggtttgctgcacccgtcaacccgtcatctacattaggtatttttcctaatgctatcccttccccagtcccccacccccctacgtaccctccctgttctccttcccatgtccatgtgttctcattgatcaactcccacttatgagtgagaacatgcattgcttggttttctgttcttgtgttagtttgctgagaatgatggtttccagcatcatccatgtccctgcaaaggacgtgaactcatcttttttatgcctgcatagtattccatggtttatatgtgccacattttccttatccagtctatcattgatgggcatttttctaaccaaaacattacagaatttgtaacacaaataagcttaacatgttaatgagaaaaggaaaactacaagttatctggtagaaacactgttaaaaaattttttggattattctgtcagtataatatttgaaggaatcattcaatataataggaaataagctgtgataattagtgacataacaaagtcagataaattaactcaaccatacttagtgagaaggttgatagaaaacttaagtctccttaatactagtgctttgttcttcagattctggtataatttgatagcaggacatatacatacatatagcatatatttcaataaatctatagaatgcttttctagttttctatcaccagcactctgaacattaacattacacatgttaaaatttaagcgttgagtttattgaggctttcttcaagttttcttaacaccagaatgctgtatacttgattattccagatgcatccctaatgagattttacaggagtcattgtggttgtgcatgaaaaggatgaggcctactgaaactttttatttcctaaatgccttatattaaaaagtccttacatctcttattcaagatttcctactaaattgtttacaaaacttccttgctgaataatcacggtaaggtggttagctgggtagtagacactaaggaatgctgggtttccagggaaacagtgccacgggaagcaacaaaagagacaaccaaagctgtagatgtcatattacacaacattttattttttactactgttatattgttatactttgttattcttgctttttccttctttctgggagacattgtctctctttaagaactctaaaattgacaccaataacaacacacaaagcatgacattagtataaaatctattaaccagaattcatcttttttcaaaataatacaatgacaacgggtgcaattatgaaacgtatttttttgatcagctgaccctaatgtacttcctaaatgataaaacttggatatttgacttcttccctaattcttccagtaaaattctttttcaataaaagtgtcttcagaatgattggcctttataagagagcccaaatgctttttttcttatacaatatattgtgtctctttggctttatcagtggttacagagctttgtggtaatctcaaaatatcaacaccatccatcctggggaagtattttctccagcaaaaggagaaaaagcaagacagaaacaatcataaggccatgtgaggttgactttctccgggagcactttgataaatacgttcttttatttaatgtctttgtgccttcatttcctcatctggtaaatggtaattaaaagtacttaactcatagcattattgtaaggactaaataaaatagaaccacaatggctggaacatattaagcagttagtattagctatgacaataaaagtaatcatatatttaaagaataactctttaaaaatatataaaaacaaagtccttaagatgggttgtttgatgttctcaagttagtataaaattgagaatcttaggaacagatgatctgattcaaaattctatgatcttatgccctattatacttaagaacactgaattattggtaaaatattctaatactatggacaaacaccctatagtttacatgcgtatttgactaactagtccatggtggaagtaaaactaaacatgattctaaatataaatgtgtctaggaggggaaaatttatccaattagatgatttaaagaattattggaagagttgaaataaaaattacttgtagagttaagagtagaacttatgaagaaagattaaaggatgatttaccttagagttgaggtctaacaaaagtttagtaaaaatcttactctggatatatggacacattatatatttaaaacttcaaaattatattttgtaggacaaaaactttatttcaagaacaacttaaagtgggatatccatgggaagggataggcacaatgttttctttcttaagccagtagtaagatgagtgtttttatactaactaaactttttatgccagcaattatttatttaaaacacttacaatattgctattataagtaataaatcttaaaaactattaatatattttcaagttgtacaagaatttaatctttttgattatttttgtttttgttgttattaagttaattagattttttaaatacagagataaatatcacatatttatgttcctttatgtgctttttggaattgtgaaaaataaaaaagactctgagggctcccaaactggcaatgttgtggagaaaagacaggatattataatgccacgaataacaatgtccataaaaagtatgaataacaagagaaaatgtgctccttacaatgctcagtaaaatgaaaaaatgcaaacaaaaacatccaatattatgtatatagctgcttttttaaattgtgcataagataattagaaatgatgataaaatgttaaaaggttttatttctgttgcaatattagtgattaaaaaatttttcttctcttatttcttttctaaatgttaaataatacctagctattaaatcacttttatatttggaaatcatgtatcttttaaaatatattatttgcatcctccttattttcacttaatacatatagtttaagttgttctcagacaccagaatattaggagaataattcaaaatgcaaagaaaggactcgagaagttacagttgaaaccatggctaggccaaaacaaaaataagaaaaatagtattaacagatagcatttattgactgcctattatatactacacatcataaatattgcatacatatttttaaaaatactattaatttaatttgcataaatattttatgtttgtttaccattattttcattttctgtgacttggtttaaataaattaatgaatgcaatgtgctcagaaaactgcctggacacctgataaatttcatgtaattgttttctagcagtagcagcatcaatcattttacaattgatgaagttgagatttacaaaggttaaataagttgttcaaattctagtttatttaaccatagagtctagatctatgtccttaaacacagtgataaaaacagtaaactaaaaaaagcatataatatatatacatacatatttcaattataatagaacatacatttgttgtgagaatgagtgccttaaaataaatattatctgaatattaagcatattttcccaacagtaccctggcaccaggagcctcgttctgtgcaagcactcctactcaccagctctgtgaccttagacaagttgtttaaatttcctagacctgagtttcttttctaaaaatgaggaggttaaaaaagaacaaatactagcaggaactaacatttttgaacccttattgtgtgccaagtattacgctaaattaatgatcacaactgtcctatgagccaacaatattgataatcatcccttttttgaaatgtggtaatttaggcatagggaacttgcctcatttccacagcaaatagtgatggaccagcaaataagataacacctggtatttaaactcaagtgtatctgaattcaatgtctgcactctttcttgatgactactcagagctcccactgttagaaatctcagatctgtcccttccagatctgaaacttaatgaatattgttaattactgatggagcataaatatgtgaaaaaggagtttaacttcttcccccagccaatcaatatctcactatttttgctgttataaagacaccattaatgaagtctttgattagcacctaatttccaaagtactgtactcaatattttgtaagaaaacttaaaagcctagtccaagtgcatagatcttggcacatagtgagtgttcatttaataattaatttatcaggcagtcttacacttacaaagtgcattaactgattattcaattgaccatcataacaaaacattagtacagaaagtgcaggtacagccatctgtcatcttgcaaatgaggatctgtgtatttataaaggttaagtgagctgcccaaggtcatcccaaagtggaaaataaaatatggtttccagagcaattccaagattaatactctttccactgaccttgaaaccaaattgtttttattttataaaagtatcagaaacaaagttttacatattcaagctgaattacttcagcattaatttctgctctttcttaggaatggttaaaatttatttcatttgcctatgattagaaattgtgtacaatctacaaaactccactcatgtccactttagtatttcacatataaaatgttgaatttttaaatttttcttttttgtgtttctaaaggacatttttttatccagctaatggctcaagtgttatactctcttcagcctcttcaaatttttaaattgtatgcattaattttccatgtattgatagattgaaggtaaaagcaaaagtatgtaacaggttttgaagctaggagaaaaatttccagccaaacatactcaaattactaatctctaaagtcacaaataatgcagtctcctttaaaaaaaggtacattccaaatacgtgaaagcaattcaatccaaacatcaattatattgattattcaaaagaagagaaaaagtaaaaagctaagactcagaaaaaaacaggaataaaaataagattgagaatttcaaaaaagagacagatatcaagaaatatttgagattatgaatcaattcagtcaaagatgttaaatttataccaagaaaaatgtagcatggttaaaatataaaaagtgtttatttaagtctttccagagttccacacagataattagataattattatgaggtcgaatagtcctaaaaataaattgtttcactgttaaataagccagagaatatcttaattacttattatggattttataggttattgtttaaagttgtatgctatatctgtcagtgtggaagatttaaaatctcactcttttataaaaaaagatattaatggtgtgcaactcagacttcgtatctcaaagggaacagtactgatgatcttcatactgaatcagagccattcaatagcataaacaaaaaggaattacttactacaccatctacggtgctctaaatgatataaaataacattatattaaacaaaaacacgacacaattttttttacttcaaccaaagctatccatacatattctattcatctcttgccatatagataactttgtgagtttctgcttacatatgaacatattctttctatgaggggaaatgttctatttttatgcagccatggctttgtatatatctgagaaaactcatgtgctagcaagtgcttccagttcacttttttcacagtatctaccacagagctgagtacagagtatctacccaataaatatttgtagactaatgaataaaataatttatttgtggtagtatcacatggacctcaagctctatttggtgtgctttcatggactatatatttgcattgaaatgcaaatatctgtatttcattgaaaattatattttgtccaaaaatttctctcaaaacacaagttttaggttatttttataagttcaaaatcttgtcaaattaaagtactaccaagccctcaaatccttttttttttttttttgggagggaatgtattaggtataagaggctttgctgttatcaattttatataaatacaaagtcgtataatattgcaagcttgatttttagcatatgtattttaataaaacctatagttttaacataatatataatggaatctatagttatttacatgtttttgtatcctctgagcaaaaaattaatatcagttattctcatccaaattataagaaatgaatgaatgtattgagaattgaaaacagtagaattcaattttattacaaataatataaccagagagtataatatttctgtcttcatgtatttcctgttttatgaaatcatttccataaaaacatattgtcaacatcatttgtagcttttattatactttaagttctagagtacatgtgcactaattccataaaagtgaaattaaactgacatgtacttcagtatgtcttacttaacttttatattttttcagcttctcaaaggataaaatgctatcatatgtaattcagtaatatatttttcattaacaaaaatggcactctaactttattagggaaagtcaaggattgaaatcctaacccaaatctagtgaaggtcaaatatatgacagttgaaaagagggtatataaccaagcaatatgaagacagtttctgaagaaatcattaaaaatacaaataattatatttttattgttcttgaggaaaggaatgcagaaatatcttttcattctatttttattctatctacttttcattgcagctatgaatgagactactgactttcaggtagtattaataatatattaataacagcacgaaaatccaccttgatatcactttatagaataaaggaactttgacaatttctgaaaataaacacttcataaataagttatatattcattgttataattggaactacaacaatctggcagagcatttaatttagttttcaaactaatgcagcaattaaatgtaatctgcctatttcctagggtccatgttattttttttggttttaaactcaggcccatggcatatctcaatgtactacaacttgtttctaataacgaagtttctagttggagaagtaaaggcacataagcatgtccaatttgaaatttacaaagaagttatctatctactgcttgtacctatttttttcactataaaatttgcttatgcttgttgaaaatgtaaaaaagaattcaaaagtacttgaagtatagcgttaagtttccatctttaatcccctctagtttcatctcctacacccactcacatcaaagataaccatgttcacagctctggaactgtccaggccttgctcatcttaccacagcataatgcctctcaacatatatcaccaattggaggaggaaagcgtggggtgtatttgtacttatgccaaagcaataagcaccctacctttttcgtgcaattgcaaacttatcttctaaagtgaaaattagtaagagtctaaaattcactacatatattggtaactttcctgaccaattctccactccattatgttgtcaattataactgggcaatgatgaattgaaacatcatttatggtttttttcttcaaggccaagataaggcaagacaggttcttggcaggaaaatttagaagatacttactgaatgttttctgtgtgccaagcttgatactaagtgctttatatttagttttcaaaacaatcttatagggcaggtatttttatctcaatttgataatgaggaaattaaatgtacttgtccaaagtccctcaactggcaagactattaatcagtatttgtactcaaatttgccccaaagtccctcaactagcaagactattaatcagtatttgtactcaaatttgcctgggttcatcctactacttaaatgagaattatttcaaagcgtcaaaaaacagattccaaagatatttttgcaacaaactgtgaatttaagttattgcactgtaggttacttatttcattaaactacttttataatacttttaaaagcacactctcatatattatcatactatattttacccatagtatttggtccaagcttctcattctcaaaagaagtctaaattttagacttgagtatatatcaaatgaaattattcatataatttttgggacactcagagaatagtggaagactgccactttatatatttaaacttgtggcttattacacgtagtgcacatgtggtgcactatgacttgtttatatagccaaaaagttatcttgtaaatggcacaaatgccttatattttatgtgcttgtacctgtatgtctctgtgtatgtgtgggggggagttagaaatgttaatttgttaaatgtaaatgtttaatgtcaaaataataatatttttggcatttatttcttagtgtactacattgggatattaaaaattaaaatgctcccagcctgtctttatcattgataaaaactaggactagaaactcgcctgacctccttgtctagtatccactccattgtcctatcctgatgcgtataccatttaccaaaattataccaattatttacataattggtataattgttcaatgagtaacctacagtgcaataacttaaattcacagtttgttgcaaatatatccttggaatctgatttttcaccctttgaaataattctcatttaagtagtaggatgaacccaggcaaatttgagtacaaatactgattaatagtcttgctagttgagggactttggacaagtaaatttaatttccttattatcaaattgagataaaaatacctgccctaaaagacagttgttcaatgcttctatcatttcctaccatgggtgccttgaaatttttgctcgttttaaatgagacctaaaacccatcactccagaaaatataaattaaatgacattgtcacagaataataaattcatgtgtatcggttacatttctctagaaaagtatttaggaataacatgaaaaagagaagtagagtaagtcacttttaaacttttaattttttagcttcaagacacagaagaaatatattttaaatggtaacccacaggctatttatggctatgtgtaactaaggtgaaatttacaaaatacctaacctatgatgtaatacatgttgatatttatattttactctagtctattttaatgtattctctattaaattctgatttcaaccctctaaattggttttacaaataacttatgagttatccactatttgaaaaaaaagaaaaacaccgactagataatctctttctttagaatctcattgtgtgtgtgtgtgtgtgtgtgtgtgtgaaaatcaatgtgtaaatgtaacattgggctgaaatcacattacaaagtcccctaaaataaatgtatttgactattacacctcttgccaaaacatctcctcaattcaacatttgaatgtttgataaatctttctggagtatttgcaaatgtgccaaaatgagatttcataacccacaaccctgatgaattccaaagaattgcctttcatatataaggctacattatttaacaatatatcctccagctcttaaaaaattctgtaccatattgcttcctgctattattggcatctgaaggacagagtgtggagcctgtgatggagatgtaaatagaaataaccaagcacagtctgtgcttttcatcagactcacaaagaggtcttctgtgaggtcaacttgttaccacaggcctcctccttaatttgttttcttttcactataattaacccattccatgggaacaaggaaaggtgctgctttcaaagctagataaaaagacacaaaaatatgctcaaaagatactctcagtggagaaacaagtagggttttttgtttcccagggaaggaaaaagaaccaggtgatgtccatcctacttttccttggagccacacctactccaatgtaaaggaatgagatttagatttgtttcaaaggagttggctttggatctaaatccttgctctgccactaactttagctgcagaaaaaaatcactctttacttgtccattctactaaaatggttaccttatcagactgtgttatgaaataaacaaactaaccaaatttaaaatatagtatatatggtcaggcgcggtggctcacgtctgtgatcccagcactttggaagtccaaggcaggcagatcatgaggtcaggagatcaagaacaccctgactaacatggtgaaaccccctctctactaaaaatacaaaaaattagctgggcacggtggcacgcacctgtaatcccagctactcgggagactcaggcaggagagttgcttgaacctgggaggcggaggttgcagtgagccgagatcgcgccactgcactccagcctgggcgacaaactgagactccgtttcaaaataaaaaaaaaatatatatatatatataaagtgattatgtttcaactcacaaagtagtaagatcccaatggcaactgattgtcaacattgggaattatcagaagaacaaatagtccaacatcgttctttcctcaactgaggtttaagtccattttccagagtcctccaagtgattgtccattgcaggtttgtgcacaaggagttacagagaactaactcactatctcctaagagtggcaattcctttattgaacagttctgctaataaacaaaaaaaaaattttttaaattaaaccatactttgttactcttgtattttagtaattagctgtctctgtcaactgctggccagagtgaacctagctcttttccacctgaatttacaaatatctaaataaacaaaatatgtaaatatatcagatacctaaaggtagcagtcagggccctgctgtgtcttgtcttctctctactaaatttattctgaggatatgatttcaaattgcataaccatttgggctactctcctttgaacaggccctgcttggttgcatttgatattggtcttgccctgtcacccaggctgagtgcagtggtgcaaacttcgctcacttcagcctcaacctcttgtcctcaagtgatcctctgccacagtctcccaaggagctgggtgcacaccaccatgtctagctaatttttctttttctttctttttttttactttttgtagagatagagccttattatgttgcccaccctatgtccaacatttaatgtagcccagctgtagtctgcagaagtttgagcatagcaagtcacagaaacttagtcttgaaagaaatctgtacgaacattctttgtagtgcctgtttgtataaaaaaaaaagatgcaaggagttgaagtgactttcttggagtcacagagtaaaatccttagttctcatgtcagttatcttacttttagcacagttagtaattttaacttatttttccaactccaagatagcattaatgtaatcatcatattttatctattcactatcaaattaacaggataatgaccagacttacagaagagcctgcaaaaacaaaaacaaaacaaaacaaaaacgcttccagataaaaagagatgaggaaaaatgataaataagaaagaaagacaatgtcggttgtcgtagctcacacctgtaattccagcacttcaggaggccaaggcaggtgggagtttgagaccagcctgagaaacacaataaggcctcatctctacaaaaaattaaaaaataaaaattattcacacgtggtcacatgtgcttgtagtcccagatacttgggaggctgaaccaggaggatcgtttgagaccaagaggttgagactgcagtgatctatgaccatgccactcttcttcagcctgggcaatagagagagaccctgtctcaaagaataaaaaagagagagagaaagggagagagacaaagaaaagggaaggaggataggaaggtaagaagttataaaggaaggtaggaaggaaagagaaggaggatggaagaaaaggaggagggaaggaagaaaaaaaattctcaagatactccctctagagttttgaggatctctattcttgctttctcttacatgcttgcttagtttatgttgggcagaatttactgtgcataatttgcttttcattctgtgttttatgtgtttcaagctgtacactggaacataaacatctcacagcatgccctctcattccccagcattccttatgcagaagcaacttcaacagaagtggctgaacactataaacctagaagctaaaaggttttaatgacatctggaataagagtgaccaagggaaaacatgcatgtgtgcagctgccatccataagatgggtaaatactgaatacctgataggctacatcctaagagatgatcttcacatttaggtaagcatctgattatttagaactgtggaagtgtccacaattgcacatcaccagagatatttctgcattatgggggagcagtgcagtgaaatccgctgaaaacaaaattccttttaactcagcttagtcatcctggacatggagtatttgtgggagttttctagtattttcagcaattgatgacagcaatggtgcctaagagagaggaaggtgggaagctatcccaggcattagtctcttataggtgagccagagtctaagccagaaattgtatcattagaaatgaatctgaatatagaagaaacactgcccaaaccacatgtggatatgtcagcaagctctatatttttctctgaaagaggcaataataactctcttagaaattatttactgagtccatagactgttccttctggaagggaagaggagggaatgcccctctaaacgctctttccagagctatctgtatttttttcactgctagcaatgaagtttctgacagtgatatatgaatatgaaaaactgtttctttacaattagagttgcccactgtgtttcccagattacggatccagatccaacttactaaagaattcccctaaaagtttctgcatcttctaaattgtatatattgttaagtcagtggtaaccaatataattatacaatcaatccataatttcaaagatttctggggatctcatgttttcagaatttttgtggagcaaaggaaaatctttcagagtttccgcaaaccttcgatacgacccaggaaaaggagcacttcatctaatttacagatcaagagcaaattgatcatgctatttctcaaggctaatttttatttttattttttgagacagttttgcttttgtcacccaggctggagtgcaatggcatgatcttggctcactgcaacctccacctcccaggttcaagcaattctcctgtgaaggctaatttttagatgaattatttcatttgtggtcccttctactatttcagatagttattaacactttcagccaattgtttagaaatattggtgccactgagataaagggagagtgaataaaacaatgcaatggagaggtagaaaaatggcaaaaaggaacctgactaataatctccagcaatgttttggaaaccaagttctggacagaaatcttgagttccaagacacaactctgcaactaattatctgacaagcaaggtagagttatgtgacctttctattttagtttccttaaccgtaaaatacagaagattaaatgctggcctgagacacagtgttaacattctatggaatgaatagtaatttatgtgtctttattattaccatgatcatcccaaaatttgttttaactctcagcactgttcaattcctggagaaacaaaataaagtccttttaaaaattattcagtagcttccacagtaccatttattatttttccaaggtaaattgtcttgtgtaatgataattagtagaaatgctgagatgggaaaagtgtactcccagtttttagaagtcaaacaagcatatagactatgaatcatactgaagttccttcaatcaaagctggattgttatcacatttttaagtaaataactgatgggaagtcatattataacctgaaattgcaatctctaggttaacctgaagaccatatcttcaataatgtatgctaccagtacaatttattggtacatttttctccccagaacatcactgatttgttttttgctgtaacaaattaacattcctgtcattagacagaaataataaattcaagaaccagtgaaaacagaaaatgaagtgtagcgtgaacaggattttacaattaatcaagggagtcattttgacacctcatttttataaagaagcaaaactaaaaacttacaagtgcctgctatttatccacatactatatagtcataaatggtgagctacgtacttcactaacacaaattcctctattcagcaaatagtctttgagcacatattatatgatgggcactctaataggccctgtggatatgctgtagattttcaactaaagtcaggaaaactagtgaagtgtgaaatcttgtcaatcacccaggaagtacaatataaaatttttttttgtataaaacacaatacaataattacttttcttaatgaagttgaactagatcaaggtaaagaatataataatgaaatatattcaagcgcttaactatttgaaacattcagactttaagggaactatcacatctctagccacagaagtataggcaaagcattttaaatattctttcttgcccacagcatatattctgttttatttcatattcgaatttcaagaatattaatgcatgttatttttttttttttgcttttgaagtttaagcaatagtatctgatttgggagaagggaagttagagactaaagtgagagggatgagtatgtttatactggactccatcctgaaggcattttttattgctaacaataatagtcagctgggtaatgttgagggtttcagctgggctcaattatgtgattgcaattagctgtgggttggaaaggcaattttgttgatctgcattgcacgctctcacatgtttgaggtcaactggtctaagatgcactcatttggaaaacctgggtgctctcatacttcacagggtgacaatagggttccaacacaaactaggaagaaagttctcacgtcaaccaagtgctattggtcaaagtgtcagaaggccagtgctacatgaaagtaaaagggaattatcaagtcaaaagcaaatgatgtgaatacagaagcaccattagtagacgtcatcaatgcaatctgccacactgctaaatgggcaagcaccatcaatcctgtgtcatcgtgggcacatgtatcaaggtttgcaaaagtactaaggcaaaggaccctttacatttccttagtgcagagagagttcttactccattaaaagaagtgattttacttttcttctgagtcattgcatattcctttcctctgcccagttgaagagctagtttgatctgctctttaaaaaatgctttcttttttcttcttcttctgttttatactataaatctctttgcctagaagttccaggcataatttctgtgtaatagaacaagccacagtaaatacccagtcacacagcctactaaagccataaatcacaggaaatagcaagtgtaagagattaacatcgaagctgaaacccagttttccttgtacactcctctggaattctgtgatgacatacactttcttgaaggaacatcttgtggtacccgtgacacagtacggttaggtttaagtataaaacacataggcaattaggagaaaaaatgttttttgaaaataggaccacatcttttcacagaccttaatggttcatgtgaaagcatttggaaatttccatactcttcaagaaagagaatattgatggaacaaaggagaataattataagaatatgaagataaattatcaagtactgggattaattctcctaatgctagagaaaatcacctcaacccagtgagaggaagagactggatgataactgacactatcatttcatggaagatcccaccaagactttctgaaaaaccaagtggggaggaaaaaaaaaaaaaagcatgaccttagagagttcccacagtacccaacaaagctgtatcctgtttgactctcacttttctgatcctggaggtgagtttcaccttgtgaaaattcctaccatgccattcttgtactgataaatcataagacttaacactacataacctcgttattcacatacttgcttgggatcaaagcaagataaatatttcttgacacaaccacataaacagtaagcaaacgagtatttcttccaacctttgaatgtccaattccaaggtttgttctctcctgaatcctggtggtacaacctaaatattttgcctgaatttggcattgcaatttctattgtcttttgttttcccacaaatagaatgttttcatgtaattgttatatttcagtaggtaaattatgtatttaatatagagcttaaagtgtatgtatataaaaattatgcataaaatattccacctcatttcttaacttagatttcttctcagaagcagcaactcttagtagttttgctcttctctgagaacaattctatgaagatccaatcaaattgtttgcataaaaaccccttttagaaaaaataaaatgttatatatacagaaatgccccttgttttattcacctaagatgatcttggaaattataatcattacctagtagaatgtctcacttattttaatagctaaatgataatgcattgtttgaatacatcataacttattttattaggttattagattgttattggggtaaatttaggataaaacaacagtttaaactagtaaaagccaaaggtcatgactaagagtttcacttggggcacaattgaattagcacttgccacaccgtgaccaagcactgatcttctgaagctagaagggagtccctaataaaatgcatgatttatttgatgcaaaccaaaacatacctttacaattggccttttcaagcacatttttactttctcacctagtcatattttcttatgcttttcactgaaagccatccctgctaattttcaccaattgtcagtattcttcttgttaaatttcaattgtcaaattccatttccttctgtaagattcccaccatgacccccataaccacagaggaggaggtgatttttttctccatcaatttcctttagagtcagatttgtaacattgtgtcattttgaattatgattatgtaagtatttgtgcatgcctcatctcctttgccagattgcaatcccactgaagtctgtgatatagaaaacaaagggctatcattcacaggacggtcagagagccttgcatatgtatttgtgcataatatgtgttgcataaatatattcctaacctctgaagtggggttagtaacttaattccacattttaccagaccgaaatatttggactatattgatatgttaatgcagaattttaagaatctcaacaaatacaataattcgatgatttataaaaagtattttgtatcttcttcagtattctatagtgtttaatatacacatttttttttttctagaagaagagctgcataacaagcgagtctgcccatttgggtcacaacctctgtaggtcaaaacaaattttttccaaacagccatggtcaagaactaatgatttttaaaacaccataaaaaacaaagggctacttattattaactattataaaacatcagtcagatttttctttcctcactattcttggagcacaaagaagcaataaattttaaaacaaacatgttgaattatttaaaattatacttctcaaatatgttctatacaaggataaaattaatttattcttatctccattttggatttgaccatgaattcttctgaaaaaatagctgtaagaccaaactttttggtaattctctataacaacacacctaggttagaactggctactaccttcaatcctatgtgtatttatgtgtaccttgctttaactattagaaacaataggcacctagaacaatcgcgaaatgacaaaaatatgaggtgttcaatgaagatatagagacttgaaaacctctagtaatgaatataaaaaatcattagagtagaagtataatatagcatcagtatagcagaagtaaataatgtaattcacaatgaaaacaaaattatatttcaccaaatattggccacatacacccttctgtagtttaagtctttgtctctctagatatatgccatccagtctgttcttatagtactggtataactcggacaattcaaaatatccaaaataattaggaatagtttactcttcccaaacctgaaattgtaactgttgagtgcataataatatatactcgatgtatgcaaaggaaacttaccttctgtgtgcacggctgatacataggtccagttgtacctcttcactatgtccaccatggcccttgcctgctgagcatctgaaggcacaaccctcatgaaatatttgaacagagtcttgtcactcagatccatgctggttgctgagtaagcaatctgaggtatgttgaaaagctggagcaaattctggacctgaatggctacagaactggagccaggcccaatgacccctactatgggcttcttggagcggaaggaagaggaggagccatccacacagcgtaccaagccttcttcctcttctgaagaaatgagggaatctcttatgaactcaatgctctgctctagggccacagccgaatgccagcaggagtcccttatctcacagcccagtgtgatgttgggcaagagtgtggggtctgaattgatcctttccagggtatgcagcatggcctccactctctgaatgccatactgttcacggaccgccccacacttcctctcatgaactttgtccacagtaggctggtgatgaacagaaaagagagctccaataatgatgtcacccggcatgtgagccaccaccctcctctcactggactgtgcactcccacggacatcttctttcaaaagtaagactgacaggatcaacagaaggaccattttaggaaaggagttcaagccaataaagatagcatggtggggaaaattcaggagggttctgatagctacgaacaagcgatgtcctacgttgagtcgcaaatcaagaaattagccagcaattcagatgtattttctaaaggaccattttgtccccatgtaccatttagttagatgatccatgtggtcatgatcttctaaac

SEQ ID NO: 2307 - DNA, 162922 bp, Homo sapiens
attctgtaacttttttttttatttttttcaatttttccttcttttttttttttaagcactagtctgtgctttgcgaacagaatcaagacattaacaaagatcagcttctctgaagaaaagcatttctatagaacaaagacagctacatgtttcgctgccattacacagctccaaagcaggaaaagaaaatatttacaaaatacaaggttttttttttccattttttgtttttgttttttttttcaatgctaaaagggttattcagaattttcaaccttataaatagaagaagcactttatgcatagggatatggtgcattattgtatttttttttaaagaaacaatgacaaaccctttaacttgcaaacagaaaaaaaaatcactaatgttgaaaattgtgaaaaaaccccaaccattaagcagttgtctactatttttatacgattacaaaatggccaaaaaaaaagagtcttctcccccctccccctttttggtgatgtgatcatacaggagacaggcacaaggttaacagagaagggtgaagggggaacaatgggaaccacagctaggaccagacaatgttccacaggcaaggggagcgtgaaagaccaagagtggaactaacaccgacagggatctggatgtgaaggaaacatggcaaagtgaatcagagggaaaaaaaaaaaaaatcacacagggagatggctgctcacttcccacaacccccagtttgcaggggagtgggaatagaggttaagtagtcctaaccctaccttcaaagatcaggataggtggtaaaaatattccaagtggaaggacgggttgtgggtgtgtacatggcatgggagagcagacagggaagggtaccaaggggcatgaggaggggaacctgagcagccacagccaggttactgcagtgaaagagtcaaaacagagaagaccaaatgcagatgaaacaaaaaatcagtctcttaagttctgggtgagaaaggaaaggtgttctgccagctgagcactcggggagagcagctggcagttatggcagagaggctctggtggggatgttccagcacgaaaaaccaaggggacccagccaggagggccacagcagagccaagccacagatgggaggggagggggtaagagtccagagcaccctgccccattccaccctagctcaagaaggccatgctaaactgtagcccgccaggctgttctgccctgcccacaggtgtgagggagggggtggtcatctaagatcagtaagtccagtgattcaacagtgcagaggatgtgccaggaccaggccagcagggtctcatcctgaacttctgtttgccaacgggaggaagtgctcaggtgtgtgacaagaaaacatggaaacaaaaacaaaacaaaaattaaaacaagaaaaaaaaataccaaagtaggatctaaattccttaagttcactaaaaactgtgaaaatttccggcatatgatgtttgaatatcaaacgcagagatttctgaagctttaatgccaatagttagtgagtctgtttagatggctgtctcccgctcatctgtgagtcgggcgctgagctgtggctgctgccaccagatgccgactcttgagggggacaatgggaggcgaggtgggcgctgcctctgtctcccggccagtcttgctgcctgaggtgcgtcgagtgcagcgggctgctcgctcctgtgcatccagctggtcctcacactccgcctggggactgtgcgccagggggaaggtccgccgctcccagggctggacagactgtaggcagacaagttgctctttgaggacccagtcccagccagcctgcttcctgctccaaggccctgccacaaaccttgtggcctggagcctaggaccagtctatctagtgttcctgcgacagtctgggaacacccctcctagggtatacccagacaactgtattgatcatttagcagtgatcaatacagttccactgaacgttgaggagatcaatttaagtgcagccctttgtcccttcaaaagggggaggggatggctaggtccctcttcagcagatgctgccccttcctggttccatcccccaaccatgccaaccccacccaaaggctgcgtcccttacctgttcatccagccccagctctggtgtggaacaacgggtatcctcactggctaagtgtcgcggagtgtcccgagccacaggggtgaggggtgctgagtgcagttccgggctaatggggctcctaggggactgaccatgggagtattctgacaaagagtggctactgctgacatcaggggaggcaggctggggggtggaggggttggcactgcccagctggggggttgtccggccgtctgatgacctgtaggacctgcacaccaaggaatgcaaatctgagtgcctgggaaatgtttacttatgggggtagagggcatgaaaaaagcatccccactggaggagttgaggcaaacaaacaccaacagattttccttaggatccagcaactcccatttcttcccactattctctggaggggtaggtatacaacatttaccatcccaagaaaaaagcatggctgaacaatgccaggtgagtccatagcaaagtgcctagtgaattcaggaggttagggagattcgtgtagactttgaaaactgtagtcaaagaaaaaaaagtaaaagtaagagctcccaaaactttctacttgagaatcccgagggtttctgccactgttaacaataaatggagacagggtagtgatggacgttaagggggggcagtttcttcaagtggcatcacaaagccactgtccaaaggaaggttaacttgtagcgaggccttccaagctccccgggttgaatcaccatgaccccccaactgtcttccaaatgccacagatcatgggaattcagaattacatagtgacttctcagcaaggatctagcacttggctccttatatctccactagttccatgtatctccactagttccaacaaacaccaaggaaattctgagctatttgccactgccagtagatgagtatgatgagcaaccaagaggcagtagcaattccatggactcaagtagggcccaaactccctgtccaccctctctccacaggccctggggacccaagcctgccccatcacctgctgccccgccgctggggtggcacactcgtggtccacagccaccgtgccctctccatctcctcacatttggcatgcagggcggcgaaggctgcgtcggataggtcctcaatctgcaatagagcagcttcatcgatcccctcttttctccaggagttaagaaccagtcccaccccattctaggttcttcccggtcacgacaggaatacaaggagcttgcacttcacacccacaagtcttcaggccatttagggtgtgtgcactcatatgtatgtgtgcatgtgtacacacgtgttcttctaacagaagaaccaggccattacctcttcattctcctcatcaggactccccttcagagactgaagatcaacctcccgccagctgcaaaaccaagaacagacaatcatgagatggcaagcaggctaaaactgggggcagggtcaaagtgtccatgcaaggatgagaatcctgcacctgtgggtgacactgctctctgccgggtaggctctgccctatcacagctcagtctccctaccctgtcaaggcctgtgaaattggccacctactcaaatgcccaagaaggccagaaatgagagaagcggcctagggtaaggctgaggctgagagactgtgacaaacacaagaaaagaaacctgtttaaagaggaccaccactgttcaggaccagctgattgctcccatatggaaatgcatacccagggttgcctaatcttctgtttggcaacaaaagctggaaacaaagatttttatgtgaaatcctgctttgatgttgacaacaaattcagtattttaaaacatactgtatgtgttgacaaaaccggtctctagaccagtaagtgaatggcctaccaggctgtgactgctggttcgtttggtgtattcctataatggaatgagagagaactatatacagaaataatttcgttcttatcagataagaatttctcttaatgagaagacagaaccaaagactagggcccaactcttggtcagaagagaagagggaaaaagggcaatagcaggaagaatggggagaggagccaactattctgagcttctacctgggcgtaaggatttccttgtattgcagtttctctacgcgagttgttgcagcaacagacattgggatgacaatgttgttaatatcaaatgagctctctccccttctcctccttactggctgctgctgtaagataaaaattaagtttaaaaggaaggtacaattttacagacatcaaatcattcatctaagagttaaagcaggatcaccaataaccaagcatctgggtccttgggttgaagctgagtaatgaccatagcagctgctcccacctaggagtcagtctccaacagcaaaaaacctcacggagaaataccaggtggtcatgaggagttagtcccattcataagtcccactggtcaccctcttccttcaagggctcatgcgtaaatttcataggggtgggtacctgggatcttaactgttggggttcctactctatatacacctctattaacctcctctccttttacaatctttatttccttcctttatccccgtttatgacttaagactcatagtggcccctcccctaaaagcaatgcttgaaagcttatgctgaaagaggcccaaaggataggcccatctcaatacatcatctaaccttggttgtcatgaatgcacctccttctcaaagatctgaactcttcagctaaatctgcacccaccatctgcccagtctttatgtgatttcccctcttttgatgattcttggggaaagagctgagagctttctagctgtatcaaaggagatgaatggagggaaactaaagaggagaacctgactatacctcacattcctggtgaaaggaaatttgcttctataggaaatagttgagaagaccaaactcttggaaaaataagacttccaaggatcgaatatcagaggcagaggtaagcatctacagtagctgggagactagggaactaaatggcttagtctcttggatggaggaagaagtctactagctgctgctgcccagatagttaataccctatcctgaaacagagactagcaactgagctgtgagaggccagaaggaaacagtggcataacaaacacgctgccatggcaacaaaacagctggaaaacacctaagaggctgcatttatacctaaaccaccaagtgtggtcagtccacagggaaggggttggaggagtaagaagtcccctataactaacccctctatcctctgttcctggacggtgagataccctttattcatcctatcatcttaggacattctcagagaatgttaaaagtcagcacttcctgggccagagtttcagtcactgtcatttataacttcagatgaccacaatgcccttttcacttcaatttctttctctatcaaatcagatgactgccattgacctcagaaatttaggatatctggttaaccaaaatggttaaacagacttttggggatcttgcctgagttctgtagctgaggattagtgatctcatacccagagacctctgccactgccagatctgtgctgaaattatacatcccactacaagaaatgcatcttaagaaagcctcaagagagacagccttcccagtatcttggtcaagaataaatgtgaaactgctggcagaaacaggtatacactttccctgaaacttcttgggcttgttgttagtaccttcgagaaaaagatactggagcaggttgtgggatggttcaacgggctcttatctcatcctctgcctagacacaccccctattatgttagctactcattaggtctaaattaactactatctcctatttagagccagagatagagagcaggtgatgagaataaaactggttcccaaacttggttgtatatcagaagcaacattaaggagtattttttaaaaaaaaaaaaaaggttctaggactcccccccgctcttttataaaatcagaattttgtttgtttgtttgtttaagagatgaggtctcactatgttgtccaggctggactcaatctcctgggctgaagagatcttcctgagtagctggagctacaggcatgcaatatcacagccagcaacaaatcagatctttagaagtgtctggttggttggttttgttttttaaagctgctgaggtgattctgatgcagctactggcttttgggaagcactgacaaaaacactcgctctcctccctacctttctccagtgtcctctggcttctttacttgatttcaaggagagctggccctttgtatccatgggttcaaccaattgtggattgaaaatatttgggggaaaaaaattgtgtctgtactgaaaaggtacagatttttcttttcattattctctaaacaatacagcatactatttttatagcatttacattgcattaggtattatcagtaatctggagatgatttaaagtatatgggatttaaagcatacacataggttatatgcaaatactatgctattttatattagggacatgagcaacaatagcttttgctatctatgggaggtcctggaaccaatccccactgcagatactgcagatactgagagcctgctgttatctggcctatcttctttctttttttttttttgagacgaagtcttgctgcgacgcccaggcttgagtgcaatggcttgatctccgctcactggaacctccgcttcccagttcaagtgattctcctgcctcagagtagctggaactataggcacatgccaccacgcccagttaatttttgtatttttagtagggatagggtttcaccttattggccaggatggtctcgaactcctgacctcaagtgatccacccgcctcagccgcctccccaagtgctgggattataggtgagcgccactgtgcctggcctatcttcttttacataaatccagagtctttgaaaaaacttggcaatgagagagcctcaggggttagcatagtgctatacacaaaatttttactcaataaatggtaaaaatttcaagtgatccaggcctaagttaacattctccagacacagaaatattgaagtgctcaccaagtcctgaatctctgagttcagattttctatcagaattagtttagactcttttttataaatactttggttatctgaaaccctttgctgctggataactgagtatgtgagggacactacacacctatttagataaaatttgtgggttacgggggtaaagaaagtcgaagagcaaagagaccatttggaaaagattgatttgtaacagcaaagagagaacaatgtgaattcctacctgatcacaggagcctagtgagtccattttatgagcttggaagtttcctgatctaggctctgaaggaacttcctaagttgcctctgcaataccctcacccaggcttagcctgtgtagtgtaatggtaaaagagctggctctacagtcaggctgcctgagtttgaatcataattataaccctcacaagttgccttgacagttttcatgcatataaaatgaaatccacagtaccaacctacatctcaaaaggcattataacatgtaacacatgtaaatcactgatcactggtatgtagtaagtgttcaataaacattacagttgcagacttttacatttaccattacattacattgtaattattatacaaaaaggaccctttgagtaggtccatagcagctacaggtatgtatgttccaagagggcacacttgaggaattaaaatattagaatgaaattaaaggaaatgtgtctggaatagctgtgcaaactgcttccagatggagtgtggtatcgtaaaatctggtgtgtgcatgccaaatgtcctgccatgggggcctgctggatctgtaattctgctctgtatacctaaaaagcatggactctgccttctcccttcccttctcttctggtaccctcacgcctagtgtttattcttagtacttcacctccactcacccagagagtaaaaccaaggaaatcaaacactgcttccaacgcccatgggaatctcccctctacccacccctcctctcttgttcacttcttgggccaacaggattagggccacggaactgttgagtcctgtgtgaaacttagtccaacagatcttgaatagtcacagatcaccttaagagtttgtccctgcatcaagctttctatggatggctcagcataaatccatctctgctatgaaaaacaactcaagaaaaacaacagaaggtcaagtaccatgactttgacttaaaaatggtacagacatacatacatatgtcatgatgagctgagatcctataaatgccctgggctttataacccaccctcacactgtcctctggagccacttgagtgagctgtgacctgcagagggggtgtccggccaaccccacacaggtacttaccgatgtgctggctgtaacctgtgagctagagctggcgggtgcaggggaatctgaggaggtggagagctgtcgcaccaagggactgtgtggaggatggtgggtggctgccaagtagctcgaactgctcatgtctgtgtgatgcttcaacactgcagaagtcaacagaaaagagagaaatacatggctatcttaaccagcgttacttctaacacaagcttggaatggcagcaatacatactaaaggcaaaaatgttttctatgcctagaggataaaaaggtgaagcacactagctgtgggaagtaggggcagggcagaggttgctgtagcagttaagaagtgacctccatttagaagcagtagcgtccctctactctgctttcctagaaagtgaaggacaaagctgggggtaattaagagaagcctaggctgccccagaaagccctgagcaggtgcagttgcaggtagaggtgccatgggcctggccctaccttcacttctctcagatgaatggtctcgcaatctcattttgctgtggtttgggtcatgcacgggtggtggtgggttgagcaagcgctctgcttttggcgctgtcactcgctccaccatgggcacggcccccacatcgtctaagtgctgcctgtgggtcctgtcaggccgggtttggtgatgggacagctctgaagaggggaacagaaaaagagctgtgaaatatgtcctctcaaatattttcttattcgagttccaagctctcgagttctctctaggccaacgccgtatacccagggcagcaggacagtccttcaggactgaagtttctagtaatttgcacaatggctaggataggcacagggagcccagaaccagagaaacatgtcaccaggatacagaagacacctgcccgtagatgaactcaatgccatgccattgctggctgttcactgagcattttgggtcttgctccaagatccatggtgtctagaatagctcccgaagtccatctgagagcatccaagacaagcagaagcagtcactgtgagctgaattttttatcggtcaactgcctctcccaaccccaacatgcatgcaaactacaaatttgagaatataaaaggaatgaaaagtcactgatactctgggggacttcccggctccctgacacttactggctgttgttaggaaggagctgaccaatttgtgcctgtccttacgagctgaatctggcagactgcccggcatgggtgctctgtgcttaagcgataactttttgggaggtttgattttgtcaaaaggcttgttctgccactgagatttcagcatgctctggaaatgcaggcttgtgggaacatctgcaagaaacataaaatgctacaggttagtccaaacacctggcctctctagtgttcaagacctacactccatcctcctttaatttgcccagtggcctgacacttggcagggcaagtgctgtcatatggaagatctgtttacgtgaacattactgaaggtcattcttctatttgcaagcaggtcactttagctttttactttcaagtcccaaagggaaacaaaacaagacacctttttggtttggttgatggagtttttgttcttgtatccttgtttgttgaatttactggtttgaaaacatcctgtttctattctagagatttaaaaacatatttaagcctacttcttttctatcaatataaagttaatcaggatgcaattattcaacaatattcattatctatgttatcaggcactgtactgagtactacatactctctccaaataagaactacataccattctctctttccttcctctgtggctccgccaattcccatcatgagattatcggggatttttagctgactggttaatgttcaatatcacaaatcaacatcttttggactgaattttttatgctgtttcttatctttccattttcttagatttttcccaagaatatatccttgagcaattcctttagaaaaggaatttctagatttaaaccattttcctctcaaacatttaaagctattcaattcttccgtgtattctaatatccagtgctatatttaagagggaatcggattctttcttacttgtaggtggtctggtttttgccttttaagcttctgcaaaaaacaacaacaaacttgtggtattacactgactctacagatcaatttggggacaacttccatgtgttccaccaccaatactgaatctttcaatcgactgacgtggtatctctctctccatctatttacgtttgtcttgattttctcttgacagcgtttagttattgttgacataccggtcttaaatacaatttgttaagtttattcctaagaattagtgttttctgatgggcagaagttggaagagtttgcagggttcagaagaagacaggaagatgagggaaagtctggaacttcttagagatttgttaaatggttttgaccaaaatactgatagaaatacgggcagtgaaggccaggctgacaaaagtctcagatggaaatgattaaagatagtaccttttaaaatttcaacttcagttcttcattactagtatatagaagtacaataaactgctatataatgaccttgtagcctgtgaaactacttcgttatagactttttcttgtttattcagtaggattttctatagacataagtacatcatctacaaatggagactgttttaccttttctttccaatctgtattccttttttacttcttgcctattactctgactggaacctctggtgctgatgtacaacttttagattttccttttcatgttttcaatattctgacatttcaccaccatggatagcggtgtgagtctgttttcaagcttctgcaaagctttccagggatattcaaatctaaaagccagcacatttttcctcacctcccagttcctcctgggaatcggtaaccacttggggcatgctcagaagttcccgccagagtccctatccactgcttcagaatagaatgaaacaccactacttcaaggaagaaggctctggtggggtgagaggacaggaaaggaaaatctaacctagctattccaaaatgagtccaaatttatcacccagacaaatgcccaggtcctatcactactccttctgccctttaattctgggtcaaaaacctcctgtaatcagttcccacctcacagcaacttactcctggcatgtgctttgggctatctttctatttatttcttcacagttatcttgtctttatccatctttcaaaaataattacaaattccagtcactgatagcatgtcttctagaactattagaaatttattttgtgtgtgtgtgtgtgtgtgtgtgtgtgtgtgtgtatatttttttttttttgagacggagtcttgctgtcgcccaggctggagtgcagtggtaccatctcggctcactgcaagctccgcttcccgggttcatgccattctcctgcctcagcctcctgagtaggtgggactacaggcacccgccacctcgcccggctagttttctgtattttcagtagagacggggtttcactgtgttagccaggatggtctcgatctcgacctcgtgatccacctgcctcggcctcccaaagtgctgggattacaggcgtgagccactgcacccggcctgtttaatatattttctaaaagcttatggggttttgggtcccatagagcacagaggatatgctcaatctgaactgaggataagaaggcagggaagagacgtctaaattaacattactgaacccattattatctgccaggcactgtgtgtttatcatcatgcgtgtgccacttaatctttgtaacagttccatgaggcaaacacaattatgcttattttaaagatagggaacaggtgcagaaaggtacattaactatgtccaaggttacatagtttaatgagtaacaaccaactttcaaactcaagattatacaaccctaaagcccatactcttagacaatataccttgaggctactcactgatccagaggatggagaggattctgtagtaaagtcaattatttctcaaattactcccaagaaatagacagtacaaaatattttccaagccagttctgcagagtaaaagaaatttagccactcctgcctatggtatagatgatgaatttcatgacactgaatgttatgccttcgaggactgaatgttaggccttccaggactggaataaaaatctgagttggggaaaaaaaaaaaaaaaaaaagctaacattctcagggatgatttttcccagtgggtaagcaccctcagctccatgattgctgggctttatgacagtgaaacaaattaggaaaactattaaagttttaatgaaaacataacatttgctacctgtccaagtgtaaaaacacagtctctgaggacagtgctgtcttctcaaacatttttcataatcactcttttccacacttaaaaactcagctataccaaatcctaggaaataaagcattgtctagaagcattcggccctgtaaaacaatctgaaagctgggctgagctggaatgtataaaagaggctcaagaaaggagacgaggtcacttctgcccatcccacaatacccctttgtcagcagaagagttactcccacttggcaaaggctgtgtatgttttgtatatatatgtaatggaactccaaaaaacatagattttattttttccttttattttcccccatcgttctcccaaatctgaaaatgaagccaggaaaaaaaaaagggacagggatatgagagacctggttatagtgaaaacagcaatgactagaaacaagtaggcctggattcaggtcctggttctatctcgagtagaaggagaaagcaagaacaaatcattcagctgggctttagttccacctgtgaaatgaggcagtggggctagatcagggctggcaacattctagcattcattctctaaccctcctgttgtactggaggtacaaacacagctgtctttcctgttgtactggagacctcagattcttcccaaacaatacattaaataactccagacagttactgtcaattcatttgaataggcacaagaaaggacatctatttgttactgctagattatatgactgctatgagtctctcaactctaaaatgtttagtcaatgactcttcaactggaactccactcctaaacccttcccctcaactaaatgctcttaagtgcaagttggcacattgtagaacccaagtcatggaacactaccttgtactctccagttgacgtattaagcggaatcaagagcgattcctctttaaacccagtataaacagtttaaggaactccagctgctagactttgttagaagtttgctgtgttgccttttaattgcttccatgttaagagtgaacaggaacccagttatatcccccagtcagtaaaaaaaaaaaaaaaagatatcttaggaattgctggttgagttcatatactaactagtaagtgataatacctaggttctgtgaagagttaaaaatctaaaatagactggatacgggacctgaaagtaagcaaaaaaagggatatgaaatggaagagaacacaccagagatccattcagctagaggtctcctacattccatacccacataggtaaactgctattttcagagaagagggtgctgatccttatcaggtaaataacaggaaaataagacgaattactaatgtcatccttaagttactgtttcctcaaacaaaatgaaagatgaatgagaagaccctgacttcaggatgactagggtctgacattccacgattcacctggctgtctggctccttactttccaccattttctcaggcgcactttttccgggtgttttgtaatgctcacttcttcctcctgctgggaagttgctgtagcctcatgtgcagggtttggcaagctctctcaaaataccacagatcttcatggccagcaggtggtgctcttattaagccccttttataaagttaacaagcttttctccaaggttatatatcctctacatttccaactaaggattaactggatttgattacttgaggtgataaaacaaagcccccttcctgctggaatactaacaggttattataccctagtctctccaccttccacagccaggcgtagagttggctataacacagtccctcaatttctatcacccacacacacttaatgagaggggctgaggtacagtcaaggtgcgaggcacaactccaggatgaaaagcagcagttggttgttattctaacaaactacacaaactggttaggaaacagcactaaaactacttaaaaaaatatctgtcctatggggccagaaaacagctaagtatcacattcaaacaattttctgcctttatgtctggtataaatgtaactatatggaatcaatgaatcaaaatcatttttaaccttgttatgaaaaaaaaaaaagttggaaatcctgccactttaaaacatcttctagagaagaggttgtaagggtggcccagtagtaaaatctaccacacaaatgtttgacctacacagtcgtatgccaagctgctagccttcactgttatttactgctatacaatgatgtacagggaatcccaagacttcagggggtgtgttatttacacgggatattatgtgaatggtgccctttggagttggctatctctgcacccatgggaatcttctgatttccaaatggactgcattctgaatgtggcagttgtttgggtcaaagcaaaattattccaacaggaataatattagacatggtaatcaggtcttcaggtcaaccaactgaggtgtaattaatctacaggcaaatacagtagttaatagagcctacatgtaaaaatatatatatatctccacagtctcataaggagaatttaatgaccaactttttcgtccaaaccccagggccatagctagaagctcttcgtgtgtgtgtgagacatagacagaaaaacaaataggattagatgcaggaaaataaaaaccataaagaccagaaaagggggagtgttccctatctttctttccattccccctcattgctgcctgtagttgctctgaatgatggtgtgggaggtgtaaggtatgcggcagggcagcattcatgtcagatctatagtgtcctgcagtcagcaggacagaaaatgttcaagggaaatggaacctcttagtagagatgctgaatgatggaacaggagctgagagacacacagtctgggtatatctgagggtgggggaggttatttgcaactgtatgtggtaatgctgttgacaaagaaatgactgttctgtttagcaggtgatatccaatgagtgtgcttaagtgtccgggcttcctgtccttcttcaagtatgagactatacaattcaacacagtaattcagagagtaacccaacaaacattcctaagtcttcctagtggcgctgtctgtagccagaatcccaaaaagggtaaaaatctgactcctcttaataatctgtctggaaaggaacttgaaatatagtaaaaggaaggacaggcatcagataatctgggtctgaactgtgaaggcattcaaacccattagccatttagttttagataagccacaaccttaccaagcctgttccttgagcactaacactgaagtaacaccttacaaaatttctgggccgggcatggtggctcatgcctataatcccagcactttaggaagccaagatgggtagatcgcttgggcccaagagtttgagaccagcatgggcaacacggggaaacctcttctctactaaaaatgcaaaaaattagccaggcatggtggtgtgcacctgtagtcccagctacccactgaagtgggagaatcacctgatcctgggaggccgatgctgcaatgagccaaaaaccacaccactgcattctagcctgagtgacagagtgagactctgtcaaaaaaaaaaaaaaaaaaaaaaaaaaaaaaagccaggtgcggtggctcatgcttgtaatcccagcactttgggaggccaagacgggtggatcacgaggtcaggagttcaagaccctcctggccaatatggtgaaacccccatctctactaaaagtacaaaaattagccgggcgtggtggcgcgtgcctgtagtcccagctactcaggaggctgaggcaggagaattgcttgaacttgggaggcggaggttgcagtgacccgagattgcacgactgcactccagcctgggtgacagagcaaaactgtctcaaaagtaaaaaaaaaaaaaaaaaagaattttgaaagcagcatatgagacaaatatgagaagagtactacaaactttaaaatgctatacaaatagtaactgcagttacatgggctacataaatccaatggcaagggaaggtaaaagtcagtgactctggaatctgaagcacagaggaaaatgttttagtgttttccactcattgtgttcaagtttatttattgctccaccagctcctgactatccatgtgttccaggttttctgtttcctttctcttacaagaaatcacatggccacaggaatattacaccacatccttatcacagctagggggttttggtaacaaaagccaaaaatcccggtatctactggatttaggtggccagaaatgcaatcatttgaagaacagatgcagaacaggggattatagttatctaatatttgatcaactgtcaattagaaggattctctctaggacaagggttagcaatgattgtttttataaataaacttttgttgcaacacaatcaggttcatttgttcacatattgtctatggctgcttttgtgctacaatgacagggttgagcagttgtgacatgaactgacatcaattatatggcctgcaaagcctaagatatttaccatatggcccttgaagaaaaagttcaggccgggcgtggtggtttacacctgtaatcccagcactttgagaggccaagatgggtggatcacttgagctcagttcaaaaccagcctgggcaatatagcaagaccccatctttgtagggggcgggaggcggggaagcaggttgtggtggtgcacacttgtagtcccagatacttaggaggctgaagtgggaggactgtttagagcccaggaagtcaaggttgcagtgagctgtgatcactccactgaactccagcttagggcaccgagcaagaccctgtatctaaaaaataaaaattaaaaaaaaaaaaaaaaaaaaaaaaaaacttacagactacctgggagatattatgaagaacagcatggagcccttatcctcagggagattacatcccatcccttccccactccccccgccaccaagacagggtctcactaccgttccccaggctgcagtgcattggctcaatcatggctcactgcggccaagacttcctgggctcagctgatcctcccacctcagcctgctgagtagctgggacgacaggcgtgtgccaccacgcccagttaattcttgtgtttttagtagagatagggttttgccatgttgcccatgctggtctcaaacttctgacctcagatgatgaacccgccacggcctccaaaagtgccaggattacaggtgtgagccactgtgcctggtccctaaaatttaaataacagaaagcaaatacacaaacagccataacataattcattaacatattgataaaacacaatagggtaggtgcagtggctcctgactgtaatcccagcactttagggaggccgaggcgggtggatcacctgaggtcaggagttggagaccagcctggccaacatggtaaaaccccatctctactaaaaatacaaaaaaattagccaggcgtggtggcatacgactgtagtcccagctacttgggaggctgagacaaaactgcttgaacccaggaggtgggggctgcagtgagccaacatcacaccactgcactacagcctgggcaacaaaagcgagactctgtctcaaaacaaaacaacaacaaaaacaaaaacccaccagtgatttgagaggaaattcctaccttctgtaggctgggcacagatcatgagattacgtgaaaattcaatgaaaccaatccagattatgaaagcgctggcttccatctagaatagtggtttcaaaatgtctttgctcatgcacccccatttgatatgtgatttttaaaaaatcataatttcagatagttgtaaagattatatttgaatactacataatgctttaaaaacatttttatcaaaactttggcatgtaaatatatttagcttcattaattgaaaaaaaaaacttcttttaaacttatttagctaatcagactttagatattaactcagtatttattctaagacagacaaggaataggaccatgtaactgagctcagacccatcccagccactcgaagagttagagggaaatctcttagttgcaatcttttagtggtaccctctggtttggtagatctgttgcagtctttttggagaattctaagagaagacttggttgataggagttcctgagttatctctattttatttttaaaattcaaaacttttttgcttaatacctgggagattctccttcaggtgctgagaactcttagaaatgatctctttatttgttgtccccaccatccaagacctttttttttttttttttttttttttgagacagtcttgctctgtcgcccgagctggagtgcagtggcatgatcttgactcactgcgacctctggcctccaggttcaagcgattctcctcccaaataactgggattacagacatatgccaccacgccctgctaatttttgtatttttagtagagaaggggtttcaccatgttggccaggctggtctcgaactcctgatctcatgatccgcccgtcttggcctcccaaagtgctgggattacaagcgtgagccaccacacctggtctcgaactcctgacctcaagtgatctgcctgccttggtctcccaaagtgacgggattaaagacgtgggccacgacaccgagcctcaagatttttacactctggggcaagacccatagtgggactcaatatggccaaaaggaatgctcttcttttgtcaagtgggagaggtacaggtatgggaagggaggtgggaaaggagggctgtcagacacagagatttaacagggaggcaaactttagaaagacagtacaagctaacaacgaagatttgtgcttatctacaccctgcaaagctgtcgcgttaccacataaatgccagtatgaagatattctcctagaacactgccgtccatcctacattatatcatggcacgcacagacaaaacttttttttttttttgagacagagtcttgctctgttatccaggctagagtgcaatggtgcaatcttggctcactgcaacctctgcctcccaggttcaagcaattctcctgccttagcctcccaagtagctgggattacagacaggcacaaccacgactggctaattttttatatttagtagagacggtggtttcaccatgttggtcaggctggtctagaactcctgacctcaggtgatccgtccacctcagcctcccaaagtgctgggattacaggcgtgacccaccacgcctggcccagacaaaacatttttaaagatatactaagcgtattttggaccagattactgtggctagaggcaactgagcccagatccctcctagctacttgaagagttagaaggaaatctcatattaagttgcaaccttttagtggcaccttctggtttggtggatctgttacagtctttttgcaaaattctaagagaagacttggttgacgaaagttgtaccttgaaagtatctgagttgtaactgcaccttggctgattttctttcacctagaagtctctcaagtttctttcattagactttctagtctgtggtctttcttaccatctggaaatgctagaacaggatgaacacaagagtccaactgggaaagacgttccaacagaggggcttcatagtgaatttcgggaggcatggtgttgatgctgcctgaaccacacagtgcgcaggagggattcacatcacagccagggcggattgtgctgttccggtgaacctgtgaaaaaagccaaacaaaactgacaattcagcatctgataaaaagccagctacccatttgttatccccatttgttattgagaagttagctccccatttgttattgcgaagacctttctagatacttgtgtgacactactaaaaggatgtttgattagtttgttaaaagatttccatttgtctaacacactgaccttcaaagtgggtaaggaaacttgcttccttttcattgatgaaatctaactacttgaagctctaagtgcttacctaggtatcaaacttctgacagtttaaaaagatactaaaactgtgctttctgagaacactttataaactctgcatgctttcacgaccttgatggtccgctaagacgaacagttggttcttgattcccaggtgggacattacttgctttcttcagcaaatttatccacctaggagccttcaattaccaaccacacctcttctcttcttttcacacctcttcttcaaaagactttcaggtggtctcaagccaggtggcaagcttccctgaagcttgtaacttaaaagtaacttattaactactctttaacctggcctaaaatccactgttacaaagctcatacctaagtaataaaataacattttgtacagcaaatgctcactttcatagtcttcatgttagattaattccaaagggtagaaattatttccactgaacttcctttgtgcacatgtgggcagaataattgataacctctccaggtaagtccaaagttaaatatgaactaatttaagtcttcaaaagattgaattctgtataaaaactgaacatctacaattttatactttgagcaaatttcaggtcatgctgaatgcaggatccctacattctagtgttaggatgaacaagtctggcatttgccaaagcctaactcataaagtcacctggacacacagccccagaaaaagaaacttgcatgttgaatggcactataagaaggcatcctaggtgcaagctcagtagtagaacaaagacaaaaagcatcaaaactctactagcaaaaactctaacatttactagagctccatttattttcagcagagacatctcgaaagccttttatggatttgtgtaagagaaagatatacataagaacaatgtggtctttatcaacattcccccgacattctattgtaaccacatagagaggtggcacgcaaataaagtcttttaaaggttagactgggcaaatcacacagaactagaagccactgaaagggagtgataccaactaggcatgctacttttgtgtagacaatattaactggtattgttttgggaaaaaaaaaatccctgtatctatgtaatcagagctggctttctggagaggatgacattttgaggtaaagagaaatgagtaggtagagatgaaaatgagatcacacagtgggtgagtgggaggatttaggaaaattggttaggatccaaaaattacactgaaactttcaatattcaaaagagattatctcactccagtaggtatagcaaataaaaaataaaaagagagagactagaaaccaacccatgacatcaactagctctccatatgggacatttaacaacactacattttatggctagagtgtatcacttaagtcaaagtcaatattgggaggccaaggcgggtggatcacttgaggtcaggagtttgagactagcctggccaacatggtgaaaccccgactctactgaaaatagaaacgtcagctgggtgtggtggtgggagcctgtaatctcagctactcgggaggctgaggcaggagaatcgcttgaatctgggaggcagaggttgcagtgagctgagatcacaccactgcactccagcctgggcgacagaatgagactaagtccaaagacaagcaaacaaacaaaaaaacaaaacaacaacaataaaaaaattcaatagatgtggctaggcgtggtggctcacaactgtaatcccaaaactttgaggtgggagagaggattgcttgaagccaggagtctgagactagcctgggcaacacagtaagactccatctcttaaaataaaatttaaaattaaaaaaaaaaaaaaaaaaaaaatttagcccagcatggtattgcatgcctttagtcccagctactcaggaggctgagggagaagaatcgcttaagcccaggagttcaggttatagtgagccatgattgcaccactgcactgcagcctgggaaaaagagtaagatcctgtctccaaaaaaaaaaaaaaaaaaaaaaaaggctgcgcatggtggctcacgcctgtaatcccagtactttgggaggccaaggtgggtggataacctgaggtcaggagttcgagaccagcctggccaacatggtgaaaccccgtctctactaaaaatacaaaaaactgggcatggtggtgggcacctgtaatcccagctactggagaggctggtaagagaatcacttgaacctgggaggcagaggttgcagtgagctgagattgcaccactgcactccagcctggggaacaagagcaaaactccgtctccaaaaaaatttaaaaatttaaaaaaataaaataaagggtagaaattctacttataacttgacaaaagggtaatgtgcacacatgtaacttaaacagtaatctcacttttaaattaaaaactgtaaagtactaatagaacccgaggagtatataaaaatatatttaatacttattttttttttgagacagagtcttgctctgtcacccaggctggagtgcagtggcgcaagtctgccttccaggttcacaccattctcctgcctcagcctctcaagtagctgggactacaggcgcccaccaccacacccagctaatatttttgtatttttttagtagagacagggtttcaccattgttagccaggatggtcttgatctcctgacctcgtgatctgcccgcctcggcctcccaaatgctgggattataggcatgagccaccgcacccggccaaagatatatttaatacttattaaaggatacattttggaaaatttttgaaagaaaacttgaattcatacccatgttgcacaaatccacaccaagaatctatcctgcagacaaacttaagtgtacacacgcacacgctcttccactgaaacaagatgccaaatcatctgcatgaattcatttaagttaaaaaacaacaagaacacacacaatattgtgttttacaataagaaaacaaatttttaaaaatatcacaacagatggtgtgcacgtgtagccctagctatttgggaggctgaggtggctcacttgagcccaggagtgaggagctatagtgatcatgtccactgcactccaggcctgggagacagagtgagtcagtctcttaaaagaaaaaaaaaacaaggatctcctgggctcaagagattcttctgccttagcctaccaagtagctgggattgcaggcatgcaccaccacgcccagctaatcttttatatttttagtagagacggggtttcaccacgttggccaggctggtctcaaactcctgacctcagatgatccacccgtatcagcttcccaaagtgctgggattacaggcgtgagccatcgcgaccggtcccagtcatgaaatcctattggcagaatccaaccacttcataccacctcaactacactcaatctagtccaagtcactatcttttctcaaatgggtttcttcaagcctcctaactgatcctcctcctactggttcttacttccaaatcaatcaacacagtaatcagtgtaaatcttgttttaaaatctcaatcacatcataccaacctcataatcttccaaatgacttctcatctcacgaggaatagaaaccaaacttcttgcatggttcccacaaggtcctatagtatttgtcgcctctatcccctctctctgacttcacctcatttttttgttactctcctagctgacactaccagttactctgatttccttgctatatttctccaagatagcaggcaaccttccagatcacaggcctctgcacttggctcttcaaccactaattccatggtcattctctcacatcgtgtctttttctttaaatgtcagtattcaaagtaactttttttttttttttgagatggagtctcgctgtcgcccaggctggagtgcagtggtgggatctcagctcactgcaagctacgcctcctagcttcatgccattctcctatctcagcctcccgagtagctgggactataggcgcccgccacaacacctgactaatgtttgtattttttgtagagacagggtttcacggtgttagccaggatggtctcgatctcctgacctcgtgatccgcctgcctcagcttcccaaagtgctgggattacagacgtgagccaccgtgtccggcccaaagtaagttttatttagaaatacaagtgaaaggccaggcgcggtggctcacgcctgtattcccagcactttgggaagccaaggcaggtggatcacctgaggttaggagttcaagaccagcctgaccaacatggtgaaacctcatctctactaaaaatacaaaaaattagccgggcatggtggcgggcgcctgtaatcccagctactcgggaggctgaggcagaagaatcgcttgaacccaggaggcagacgttacagtgagctgagatcgcaccactgcactccagcctgggcgacaagagcaaaactccctctcaaaaaaaaaaaaaagtgaaaaaagattatattcttgactgtaacaacaaaaaatgccctggaataagtttaacaagaaatttaagcacaaagcttaaagatattgatattctacaaattaatgcagaatcttaatagacttgaggggggaggggagacaaggcaaaggggatttaaacaaataatctaaaagatacaactgaaagaatgtaaggaaccattccccaaaatttctgataagcaaaaatacaggggagtgatctggcctattacatgttttatagttacagtaattaaaataatctgccctcggttaagaaacagaaaatttaaataaaaacaaaaattgaccaaagtatatatgacagtttattgtttaactaaaataatacttttaaatcagtttaaaaaaacaaaaggaggtattactttttcaacaaatgaatcaggaaaaccaagaggtcatacagaagaaaacggctgcatttctgcctcacaccaaaattaattctaaataaagatttattcattttcattttattttatttttttgatacagagtctcgctctgttgcccaggctagagtgcaatggtgcgatctcggctcactgcaacctccatctccgggttcaagtgattctcctgccttagcctcccaagtaggtgggattacaggcacccaccaccaagcctggctaatttctgtatttttagtagagacgggggtttcgccatgctggcaaggttggtctcaaactcctgacctcaggtaatccacccaccttggcctcccaaagtgctagaataacaagtgtgagccaccgtgcctggccccaaataaagatttaaatataaaaacaaatattatactcaaatctaaaaaaaaaaaaattgtgaagcaatatatagtggttaacagtatgagctgtggagccagactgcctgggtttgaaccttgactccgccacttactagctgtgtggccttaagacaagttactgtgtcttcatctttactaacaggagagtacctgatagagttgttttaaagataaataactcacaacagtatctggctctcgactcttaatcacttttgtaaaaccgtaagtatagctactgatagaacatttaccatcaaacttgatagaacatttaccatcaaagatcttgatttcaaaattctagcttcttaacactgtataatatgatcattgataagtcacatgacatccttaaattttctcacttgttaaaaaggactaataataccaatttcatgggagtgtaggaaagatcaaatgactctgtaactgttaaaacattacacaaatgttagctaaattagtataccgcatgatttctcaacagctggcacttctttgttgtggggcacagtcctgtgcactgtagatatctagcagcatctctgtcctcatggtgcatgtgcctccctactcccccaatttgtgaaaatgagtaattactacagatattgccaaatgtctcctgtgaggacaaaatcactgagaaccatgaggttcaaattacggtcatcccgtctagaaaaattcaaagcacaggctcccattaaatattagtggtgagtcacagtaaacataagactcagtaaaaaaggaaaacaaaaaaaataaaaattaatagtaagaacaaagctctcaaagactattgtcaagaacaagcctgaagagagcttcccctaccaaagatcagataacgttagcatcataaagaaaagactacaatggcttgaaatacctcaaatatgtttcaatcaatgactcacagccccttcatgaaaaacttcagtgactgtccttagaggatagtagaaaactaatttgttattttgaaaattggtaaataaaaaaaaacaacaaatcatgctttcttctgtacaaactgtacctcagggtaaacaaatagttgaaaaggacaattttccctttataaacatattctatctagctaataaaagaaaaacagaaatgatacaagtagaatatcaccattcttcagcttccaatttaacaatgggtccaggcaatgatcaccagtggttgataacaaacagtttagtcattacgtgtcttctgatacaagcataaggcggccaccttgtgttttctcacgaaactaaaactggacttattcacgtttctactagttttcaagaaaaacaagggacagaaaaacatcactgttttttaaatgcactaaaaataagatggattaataaatggaaggatgattgtatgctaaaatgttagtggtagaacctagggagtagctacataggtgttcactgtaaaattcattcaacttcgtatctgaataatttcataacaaaatttggaaaagaaaacagtgacaccacaggacttctgcttctagcagagtaatagtgatcagatttacctttcagtcataaaccagaaaactggacaacaggcagtataacactgagaaataaatggggtggtctctaagactgccctggttttccgtctggaagtacattctagactgcagggcagggagaggatctgaagcagagtataatagcttcactgagttgaggaagcaaattctcactagatcagaattcagagactaaggaaactgaaaattgcaaggcaaaattcttgagaggaggaagctttacagaaaaagagccccagaaatcttcataagatccccctgagtgtttgctaaatattaaaaggtgcatgtaaagggtgaaactatcaggccaggcaagagcaactaggcagctgtgagctgaaatggtttccacagctaacacaagcctgagaggcttttaaactgtgaccagccaaagttgcatagagaattcaagacagaagatcctgctttagttgtggagctagactactaaggtggccaactcctcacctgacctaacaaatgacaaggaatttacctgccagcaaaacaaagcctctttaaaggaagatggcacaatccacatgctacaagcagggaaaattattaattggattttcagcttaaaacataaataaaacattgttagatatgccaagaggcaagaaaatactactatagggataaaatttttaaaagaaagtaggctgtgggaaactaaggtatcagataaatgaagttttctcaacaaataaatcacctatatggatagtttgtatcaaaccaacactctcactaattggaaaagccagatttaaaacacacacacacacacacacactctctctctctctctctctctctctctctctcaaaacataagaaaaatgctgacataatgacaatattgaaagctaagattccagagaggaaaagaacctggccaacatggcgaaaacccatctctactaaaaacacaaaaattagctaggcatggtggcacgtgtctgtaatctcagctacttgctgaggcaggagaatcgcttgaacctgggagatggaggtttcagtgagccaaggatgtgccactgcactccagcctgggcaacagagcgagactccatctcggaaaaaaaaaaaaagaaagaaagaaaaaaaaaagagcagagcttttggtactcttgtagggctgaatggataacactagagacttgaaatgtcaaattatcaataaaaagaggacagggaactaagcatgacacacttccaagtaccaccctcccaaagaaatagctgaagttgtgaatggtaggaggctacaaagctaagtggaaagtctctgaaaagggcagagatgtttctggcagtctcgtgaggagactagaattagatctcaggatatgctaagaggaaaggaggctgggcacagtggctcacacctgtaatcccagcactttgggaggctgaggcgggcagaccacctaaggtcaggagttcgaaaccagcttggccaacatggtgaaaccccgtctctactaaaaatacaaaaattagctgggcatggtagcacgcgcctgtagtcccagctacttggaaggctgaggcaggaaggagaatcatatgaacccgggaggcagacgttgcagtgagccaagatcatgccattgcacttcagcctgggtgacagagcgaggcgaggctctgactccaaaaaaaaaaaaaaaaaaaagagagagagagagagagagagagagagaaaaggaaactgatcaacacatgttctcagctggaactaagagagagaaacagactgttatctttttgagacagagtctagctctgctgcccagactggagtgcagtagcttgatcttgactcactgcaacctctgcctcccagcttcaaaccattcacctgcctcagccacctgtgtagctgccaccacagctggcttttttatttttgagatgaagagattgcaccactgcactccagcctggcgacagagcgagactccatcttgggggaggggagggggacaaaaaacaaacaacaacaacaaaaaatcagcctgtgcaacacagtgagacctgcatctcaataaaataatgagataaaatacttgatacacgaagaaattcccacgttcccttaattaatactgcaatgctatcaattctctttgaaggaattcccaagaaatactcaatttaatacttatgaaggaattaataccaaagtaaaactctattcaccattttctgttaatcatagcatattcgtccaaaacactaaaagaattcttttggctcaaggacaggttataatcatttgcttttgctttgcatttgatattcgttatctaactcatccactgttaacatgtggaaagattttcaaaggtttggcaactctatcacaatcaagcatatcccacaactggctcttgaagatccatcagagtgaagaaacaaaacgtgtaagcttctattttatctcagtctttcaaaatttattttgtatgtgttttataatgtatatataaaacaccgtcataacagtttagaggtaactgttccaagcacagagtgatttctgagtattcttttagtagctttatgtcctaaggtacaattttctacatggcatgcttgctcctttccaaatgtctaactagtatgaaaaagttggttgggcctccaaggtctattgcactctgtcaaggaagaacgtatcaaattattaacttttaatactgactcatattctagttcattagtcctcaaccatggtgtcatgaaactggatttaaataggtggaatcaaaactaggaggcctagaatcatatattaacacctttatttaccctgatgtctacaggaaacctggtcatagccatgagagaatgccctgtacaaaaatgtcactcttcaagtgtgatacaatgggaagaagaggaggactactcggaattctatggaagccagctttaaaatttggcccagagcaatcccccctatgacaacaaggactacaaaattctaaaatgatgccagtacactgccaatttgttaggaaattgctactttttaaaaaattgaaagaaatgctattaagggcaataaaaatttcaagggtatgttagtaataaatgtagccattacctattctactggttattagtacaaaaaaacccagccttttcaaccattcatttccaaacactgatggtttccactgccagactatacacaagtttctaatggtccacagtaaattgagaatgagaacaatgcagtaaattattaataaaactacattcttttcttttttaaaaaaatactatttgtcttatggtttaattataaacataattttacttaaaaaataaaaagcaaccttatttgaaaattggctggtaccaattttattttaataactttattgatctgaaatcttagtacgtttaggttaagttataaacacctacttcacttaggcactgggccaggaaaagaacataatggcatataagaactttccactggagtgcttcttcattcacttagataattactaacatccaccatactagacccctaaagtgatgaaacacacaataaatagcaatataggctattcagtaattacaactagtaattccgtcattttataataaaattatgatttaggaagtactccatgttctccatgagccttactctgatattcacttaccacaccctagtggttattccttagattacatttaaaatattccacattcagagttgtagaggccttagactattatctcctccaggattactactgttagtctgtctttccacctccagtctcttgtgccaatccatcccaaacataatagttacagattggccgggcgcggtggctcacgcctgtaatcccagcactttgggaggccaaggcggatggatcagctgaagtcaggagttcgagaccagcctggccaacatggtgaaaccttgtctctactaaaaatacaaatattagccaggcgtcgtcgtgggtgcctgtgatcccagctactcaggaggctgaggcaggaaaattgcttgaacccgggaggcggaggctgcagtgagctgagattgtgccattgcactccagcctgggtgacagatcaagactccgactcaaaaaaaaaaaaaaaaacaaacaaacaaaaaaaaaaaaaaaaacatgttacagcagatttacctcccccaaaatagcttacaacacttctctgctcaaaaatttaaaacttatagactgaaacccaaatcatcagtttgggcattcaaggcttcctatttatttactgatagatctcatttctctttattcccaacgagtttaacttactgaacactttgttttagtcattgattttaagaagtacaagtgatataacaacagctttttttttttttttttttttttttagatggactctcactctctcaccaggctggagtgctgtggcgagatctcagctcactgcaacctctgacttcttggttcaagcgattctccagccccagcctctcgagtagctgggattacaggcacgtgccaccacgcccagctaatttttgtatttttagtagagatggggtttcatcatgttggccagggtggtcttgatctcctgacctcatgatctgccccaccttggcctcccaaagtgctgggattacaggcatgagccactgtgcctggccagcctttttaagggcaaaagagttactgcactaaacgtgcatctcaattttaagatatattccagccataattcaactaagctgatagccctttaaaaacacagtaattgggctgggtgtggtggctcacgcctgtaatcccagcactttgggaggccgaggcgggtggatcacttgaggtcaggagttcgagaccagtctggccaacacggtgaaacctcatctctactaaaaatacaaaaaatagctgggcgtggtggcgtatgcctgtaaccccagctactcgggagaatgaggcaggagaatcgcttgaacccgggaggaggaggttgcagtgagccgagatcgcaccattgcactccagcctgagcaacagagcaagactccatctcaaagaaaaaacaaaacaaaacaaaacctcaatgagttccctcaagtatgttttatttggttctggaatgcagtagagatcatttaagatgcaggtaaggaaaaaatattaatcacttgctttgtgtgttctgtactctgtactcacaataactgtgaactcactgtcatgtaacaatattagaacataatttacctgttaacttctttgctgtcattagaaagtaagctccatgaagataagggctttgttttccttaccaatgcaacctggctgccctgaataatacggtgggcattcaaaaatgctgttgaataaatctgtctggaaaaccgagcaattcaagatgacagaagacaagatgcttgctcatcagcaaataccactgaggtcatgtcatgagtgaggagccatgtgagacacagaaagcaacctagacagaaggaatggggtgtgtctctaactctggaagaactccagctttctgctagatctagtacatggtatatttcccaaagtcaactaatttctctgtcttatttttcatgcagcttacttttgtgtcaggatgattctgttttagaaagtggcattggaacaaaaggatatttagttttatgcctatctcttgcctaagctaccttttataattttatatgtacattcaaaactacattcgttcttaggcatggatcagaagaaggttggctacttcacatattaaaaaacaaaatccaggaggccaccacatacttcagaaaatttttatacgactcctgatgtcatgccatagtggctggtaaactgccaaaacagaggaagggtgctttattttcatgaggtggcggttttttttttttttttaaaatgtaaaagcattctgtgttaaattcatcaaggaattgacaaaaagctattttcctacacttgacagtaatatactgttttctgacattcctgttatcaactcctctgaaaatcttttagagatatacgactattagtaaaaaaaaaaaaaaaaaaacaaaaaaaaaactgagactgaaatgtcaatatgaaaaccctgccaaataccttattcttatctatttctgctattttgatatttcaggtagagtccgaggaatagacaggaagaaatggtatcgcctgacagtcaattctacaattcttttctttaaagagaacatggcaaacttacacagtacaactgcatactagaataaaacaaggaaagtactgaaaattcaccatgcaaatactaattgttccagcaattctctcatctcccttatttgtcattagcaaatatgttgctagtggctctcttaagaaaaattcccattctctgctctcttttacagcaacattctttgaaaatgttatctacaatggttccctcaattccttctgtggccttgtctcctgaaaccactccaaccatgctttaattcacctttctccctctaccaaaactgctcaccaatgtctgcaacaaccccaccccactaaattcaatggtctcaattctcagccttcatcttactgatcctgtctgtaacaactgacacagacaatccctcctcctcctccctctccaaaacactttctccccttgcctttcacataccacactctcttggtttttcttctactttattcgtcactcccttcccaatcctttcctcatctttcacaggaatgaggaggaatacctaagctctggaatacatcaaagggctaatccatatacctcttctttatctgagctctccagcactctctattccctcctctattgcatttctctctccaggattttttttaattaattaattttttattattattatactttaagttttagggtacatgtgcacaacgtgcaggttagttacatatgtatacgtgtgttttttttgtttgtttttttgtttttttaaaagacagagtctcaatcactctgtcatccaggctggagtgcagtggcacaaccatggttcactgcagtgtcaacctggtgggctcaaatgatcctcccgcctcagcctcctgagcaaatggactacacacgctcgcccacagcaggctttttttttttttaaagatatggggtctcactatgttgcccagactggtctcaaactcctgaacgcaagtgatcctccttcctcagcctcccaaagtgccaggattacaggtatgagccactgtgcctagcctctctccaagatttaatgctataggacacactgcagagttcatttattattttctttctcttaacaactagaatatttcatagggtaagcacttttgtctgttttgtttagtgttgtatacccagtgactagacagatttagctcgttgcaggaagccaataaatatttgttgaaagaatgaatgaacaacaacaaaagtggtaacaataacagccactttgtacgaggaacttatcaaccagacatcccaataagcatgttacatatatttcattgaaccctcaaacaaccctatgagatctctgaggctttggagaggagtggaagtcagggtggttaacatgcaccaaattaccaaactactaagtggtagtaccatgattcaaacccaaggttatcatcttcaaagataatgctcttaattcctgcacagtaccaattttactggaatattattatctcattagttttggaataaaggcaactgctatttgaagagtcagcaatctaaaattccctacagttgtgaattaatctccatttcctttgtgaagacaaacttttttttagtaatatcaatttaaaaactttagtgaagattcctttttttctcaggcagggtctcactctgtcacccaagcttaagtacagtggcacaaatacagctcaaagcagcctcaaccttatgggttcaagcaatcctgcctcggcctcctgaatagctgggactacaggtgtgcaccaccatgcttaatttttaaatactttgtagagatgaaggtctcactatattttccaggctggtattcaattcctaggctcaagcaatcctcctgccttggcctcccgaagtgttgggattacaggcatgagccactgcacatggccaagattcttttttagggcaaaggattctatactgccattttcagtgataacagtgaaggtgagagggcacactattctccttcaaagtgttaagggcagtacttaaactttcagtctctcccatttctattaaaaagctcaagacagtggttttcaaaactagctgcagagtcaccgaggagctttgtgttttctgaaaacaagattccaacatccaactccagagcaaacagggcccaggaacctagtattttataaagctccccagaagaccttggtggttagccaagtttagaaaacaccaaagttggcaagagactaactctatctgagcatctggctcactgcttgacaatgaccaactctcatctgtaccgaccttcttggaaagaggaacgatgctgttgggtcgaacaagcctccgcttcttacagctcagtacaggacgtgtccgggctgccacacaggtgccatcagatgatgaagagacgagattcagtcgttgcttcttatgtaattgttcctcagcatcagagctgtcacctggaatgtggtctgccaagacaggctgaagactatacaaggggaaggaagagtattctcagaacacacaaagaaacaaaataaataaacaacaagaaaacacaaagaaacaaagcctcttatactagttcaacctctatttgctaatgttcagacacaaagaagcattctagagcagaagcaggtctcctcttgatgtctgttaatctacctgtgtgtgcttatgtgtaaggttcttggtgcacattaactacatcatgtctgaaagataaaagtcaataaataaactcaagttctagtgattgagttctcctctacatcaaacacacgagtaaataaagtctagagaactacagttggttagaaaatgatgaattttgcaaatgttaatgggcttccttagaatcagttctatgaaacccgaattttaagggtgttgtacacatcattcacttgtacagaatctccctgaatcttttgttttctcccttgaatcttcataaatacagatttacaaacatagcccttggagatctaatctgtcctaagcagaggaggttaatataagcacttctgaggaattcctgcaagattaaaacaataataattcacagtaactgtagtgtcttttattttactccatgcccactccattttagtaggtaaaaggaaaatatacaattaattaaaatgcactgcttcattatacagtgaagattaaaaatgttactaagtgataaggcttccgcttctttaaaccagggtcagtcctggctaaagagaactaagagctccaaaacacctttacaagtctactaagtgtaggaagtagaagagctaaaacttacgtgttaataactccattgacaggtctgagtgctccacatgatttggtagacagtgactctgaaatatgaccaataataggggcaccatggttttccaatggctgagaaacagactcaatctgattaagaaaaaggaaaaaagaaattaacatgtacccaagcgcacccctgcctgaaaagcaccaccacttcatttgcacaaagcacctaaaacttctgatgatcaatttgaaaaacacaacttgaatgactgaagaaaaagaaaataagagaatcagtggtcaggtatgatggctcgcaactataattgcagcactttgggaggccaaggcaggaggatcgcttgagaccaggagttttgagaccagcctgggcaacacagcgagacctcatctctaattaaaaagagagagagagaggttgacagagagaaggagaatattatattagcttttgctttggggggaagagggatgaggaatccaaatgtacagactaaaagtaagtacctattgacaggaaaatgacctcaataattctatggaacagaagcttagcaaaacaattacacagtaacataagctttcaactaatgatcaagaaggatatactaacatcagtatcaagatgactaagaggaaatttaaatgtagttaatatctgcttaactctaacagagtatgctagaagcttgttttctaaaaactatgctttgtttaaaaatatacacacaggccggggatggtggctcatgactgtaaccccagtattttgagaggcaaaggtaggaggatctcttgagcccaggggttcaagaccagcctgggcaacatgacaaaaccccatctctacaacaaaaaaatacaaaattagccgggcatggtggtgcgtgcatgtagtcccagctactcaggaggctgaggtgggaggaggatcacctgagccaggaggcagaggctgcagtgagccatgatcatgccactgcactccagcctgggtgacagagtgagaccctgtctcaatgaataaataaataaataaacacacacacacatttttccctgacagaaaacaaagttaataaaatctcaatgaatctaattatctgatgctatcagatactaactattgtctttagagtattcaaatcaaatatgtttagaatataaaatgaaataacagatgagaaagaatagaaaaagtgtgatttgcagtattcaaaacaaattatatatttactaggctcaaaacggataggaacagtatgaatgccagtcatatagcacctctgaggtataggcaataaagcaacagatgcagctatccctcagttctagcaattgttgaactatcccagaaaggctatgggtctttgactccttactttatttttttgagatgaagtctcgctatcccgcccaagctggagtgcagtggcatgatagcagctcaccgtagcctccacctccctggttcaagcgattctcctgctttggcctcctgagtagctgggattacaggcacacactaccatgctcatgtaatttttgtatttttagtagagatggggtttcaccatgttggccaggctgttcttgaacttctgacctcaactgatctgccctcctcggcctcccaaaatgctgggattataggcgtgtgagccaccacacctaacctgtctccttacacttgaactgactctggggcacgctgaagttctctttcctataaaagctttcaaggtaaatattcctataaatgcttcctacaaatgctttcaaggtaaatattttgaggctgaaattctacttttcaatactgatttcttttgtctttatacccccaaggataaaacaccaaaggactgaacctgaaagtagtcctagacaagcatcaaaaagaacagactgaggctgggtgtggtggctcatgcctgtaatcccagcactttgggaggctgaagcaggcagatcacctgaggtcaggagttcgagaccaacctagccaacatggtaaaatcccatttctactaaaaatacaaaattagttgggcatggtggcgcctgtctgtaatcccagctcctccgggaggctgaggcacaagaatcacttgaacccaggaagtggaggttgcagtgagccaaatcacgccactgcactgcagcctgggaaagagagagagagagactgtctccaaaacaaaacaaaacaaaaaacaaacaaaaacaaaaaacagattgggaagataatctaaaagttttaatacaaattatcctaaaatacagatcaaactatatacacagacaagtcatataagtatgctacaatgagtgaacaccgagaaaaggctgtcttttttgttggatatcctgtacatctactaagatatcacaaacatcttgaacaattgtcaatgctatcaaaaattacagtaaatctggcatagacacattgccttaagctctatgcagatttcccttggaaagaaacacggtattaagcagcaagagctataaggatattcctatcttctgacaaaatattctaaccaatttttaaaaatctaccctaaaggagtaactcaacaaacacagccccaaaaatcttattcacaaaggtggtcactgcaatgatatctatcaataatctaaatgttgtaagcattataactatagttatcagttgtggtacaccaaatcaaaatattaaaaagaatcataaaggatatttcttctcttatggaagaagagatttcaagagaaaaaaataatagtttaatatagttgtagtgactaaaaatatacatacacagataacaacaagacaaagagtgttacagttgtaaaactattctgaaattttctttacattttaggtaatagttttatattaaaaagaaacccccataaaaccaaataccctcctgaatgctagtaaggatttactacacaggggaaacctcaaaaaggctaaacaaatatggtatgacaaagaacaagaaaaatcaaaagaatttaagattcaggttggtattaactaacagatgtataacttcaggcatgttataggtattctagatttcagaagttctggtttagatgaaaaagtttcctttcaatagaaaaatgctgtttaaaaatgctgtttgtttttatttcggcattaaattatggcagtgatttgatttatatatggtatatataatttatatggtatatttgatttatatatggtatatataatttatatggtagtgccttcacgtgttctagaaggtactacgtttaagtaacgggttgactgactctccatttgattaagtttttctggtagggattatgagatttaactgcaagaacacttgtcaagataaaatgttgccattctctaacaaagtctcatttcaaaacatttatctttcttatacaaagtctaaagaagaatatgtcaagtaaaatcaccagtaatgtcacgatccatatagctaactactactgctataacagcctgtcttgtttctcatgtctgcaggtgtatatatttaaatgctattcagctttaacatgaatgttattgattttcttatagaaacctgaatcttcctggagtaattcagcccccaaatcaaaattgaagtcaacaggcaacacattattaacatggaaatgttgtcaagaacatagaggtatacagaggtcaagagcataaacatcagaaagggactgtggctggcctgcattcccagccacaaaaaagaaagcactggatactcaggaaggatctacttcagatcttgggaaattctgtaatcaagctagtatccaacagcaggcatttggacatgtcctgcaacccatcatcaatgcaaagagcttaaaatattaatcccaatcacagtgttccatttggaaaaagaaaaacataacacacaaacacatgtaatttcacctagctccttaaatgcaggcactctcccttgagaaaaaatgaacatttcctatcctgcagtctaaaaggctgcaaatgcagaggataaacattaacaaacacttaagaaatattaaatccgcatactaatttcagcttattactactgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccg

SEQ ID NO: 2308 - DNA, 162816 bp, Homo sapiens
attctgtaacttttttttttatttttttcaatttttccttcttttttttttttaagcactagtctgtgctttgcgaacagaatcaagacattaacaaagatcagcttctctgaagaaaagcatttctatagaacaaagacagctacatgtttcgctgccattacacagctccaaagcaggaaaagaaaatatttacaaaatacaaggttttttttttccattttttgtttttgttttttttttcaatgctaaaagggttattcagaattttcaaccttataaatagaagaagcactttatgcatagggatatggtgcattattgtatttttttttaaagaaacaatgacaaaccctttaacttgcaaacagaaaaaaaaatcactaatgttgaaaattgtgaaaaaaccccaaccattaagcagttgtctactatttttatacgattacaaaatggccaaaaaaaaagagtcttctcccccctccccctttttggtgatgtgatcatacaggagacaggcacaaggttaacagagaagggtgaagggggaacaatgggaaccacagctaggaccagacaatgttccacaggcaaggggagcgtgaaagaccaagagtggaactaacaccgacagggatctggatgtgaaggaaacatggcaaagtgaatcagagggaaaaaaaaaaaaaatcacacagggagatggctgctcacttcccacaacccccagtttgcaggggagtgggaatagaggttaagtagtcctaaccctaccttcaaagatcaggataggtggtaaaaatattccaagtggaaggacgggttgtgggtgtgtacatggcatgggagagcagacagggaagggtaccaaggggcatgaggaggggaacctgagcagccacagccaggttactgcagtgaaagagtcaaaacagagaagaccaaatgcagatgaaacaaaaaatcagtctcttaagttctgggtgagaaaggaaaggtgttctgccagctgagcactcggggagagcagctggcagttatggcagagaggctctggtggggatgttccagcacgaaaaaccaaggggacccagccaggagggccacagcagagccaagccacagatgggaggggagggggtaagagtccagagcaccctgccccattccaccctagctcaagaaggccatgctaaactgtagcccgccaggctgttctgccctgcccacaggtgtgagggagggggtggtcatctaagatcagtaagtccagtgattcaacagtgcagaggatgtgccaggaccaggccagcagggtctcatcctgaacttctgtttgccaacgggaggaagtgctcaggtgtgtgacaagaaaacatggaaacaaaaacaaaacaaaaattaaaacaagaaaaaaaaataccaaagtaggatctaaattccttaagttcactaaaaactgtgaaaatttccggcatatgatgtttgaatatcaaacgcagagatttctgaagctttaatgccaatagttagtgagtctgtttagatggctgtctcccgctcatctgtgagtcgggcgctgagctgtggctgctgccaccagatgccgactcttgagggggacaatgggaggcgaggtgggcgctgcctctgtctcccggccagtcttgctgcctgaggtgcgtcgagtgcagcgggctgctcgctcctgtgcatccagctggtcctcacactccgcctggggactgtgcgccagggggaaggtccgccgctcccagggctggacagactgtaggcagacaagttgctctttgaggacccagtcccagccagcctgcttcctgctccaaggccctgccacaaaccttgtggcctggagcctaggaccagtctatctagtgttcctgcgacagtctgggaacacccctcctagggtatacccagacaactgtattgatcatttagcagtgatcaatacagttccactgaacgttgaggagatcaatttaagtgcagccctttgtcccttcaaaagggggaggggatggctaggtccctcttcagcagatgctgccccttcctggttccatcccccaaccatgccaaccccacccaaaggctgcgtcccttacctgttcatccagccccagctctggtgtggaacaacgggtatcctcactggctaagtgtcgcggagtgtcccgagccacaggggtgaggggtgctgagtgcagttccgggctaatggggctcctaggggactgaccatgggagtattctgacaaagagtggctactgctgacatcaggggaggcaggctggggggtggaggggttggcactgcccagctggggggttgtccggccgtctgatgacctgtaggacctgcacaccaaggaatgcaaatctgagtgcctgggaaatgtttacttatgggggtagagggcatgaaaaaagcatccccactggaggagttgaggcaaacaaacaccaacagattttccttaggatccagcaactcccatttcttcccactattctctggaggggtaggtatacaacatttaccatcccaagaaaaaagcatggctgaacaatgccaggtgagtccatagcaaagtgcctagtgaattcaggaggttagggagattcgtgtagactttgaaaactgtagtcaaagaaaaaaaagtaaaagtaagagctcccaaaactttctacttgagaatcccgagggtttctgccactgttaacaataaatggagacagggtagtgatggacgttaagggggggcagtttcttcaagtggcatcacaaagccactgtccaaaggaaggttaacttgtagcgaggccttccaagctccccgggttgaatcaccatgaccccccaactgtcttccaaatgccacagatcatgggaattcagaattacatagtgacttctcagcaaggatctagcacttggctccttatatctccactagttccatgtatctccactagttccaacaaacaccaaggaaattctgagctatttgccactgccagtagatgagtatgatgagcaaccaagaggcagtagcaattccatggactcaagtagggcccaaactccctgtccaccctctctccacaggccctggggacccaagcctgccccatcacctgctgccccgccgctggggtggcacactcgtggtccacagccaccgtgccctctccatctcctcacatttggcatgcagggcggcgaaggctgcgtcggataggtcctcaatctgcaatagagcagcttcatcgatcccctcttttctccaggagttaagaaccagtcccaccccattctaggttcttcccggtcacgacaggaatacaaggagcttgcacttcacacccacaagtcttcaggccatttagggtgtgtgcactcatatgtatgtgtgcatgtgtacacacgtgttcttctaacagaagaaccaggccattacctcttcattctcctcatcaggactccccttcagagactgaagatcaacctcccgccagctgcaaaaccaagaacagacaatcatgagatggcaagcaggctaaaactgggggcagggtcaaagtgtccatgcaaggatgagaatcctgcacctgtgggtgacactgctctctgccgggtaggctctgccctatcacagctcagtctccctaccctgtcaaggcctgtgaaattggccacctactcaaatgcccaagaaggccagaaatgagagaagcggcctagggtaaggctgaggctgagagactgtgacaaacacaagaaaagaaacctgtttaaagaggaccaccactgttcaggaccagctgattgctcccatatggaaatgcatacccagggttgcctaatcttctgtttggcaacaaaagctggaaacaaagatttttatgtgaaatcctgctttgatgttgacaacaaattcagtattttaaaacatactgtatgtgttgacaaaaccggtctctagaccagtaagtgaatggcctaccaggctgtgactgctggttcgtttggtgtattcctataatggaatgagagagaactatatacagaaataatttcgttcttatcagataagaatttctcttaatgagaagacagaaccaaagactagggcccaactcttggtcagaagagaagagggaaaaagggcaatagcaggaagaatggggagaggagccaactattctgagcttctacctgggcgtaaggatttccttgtattgcagtttctctacgcgagttgttgcagcaacagacattgggatgacaatgttgttaatatcaaatgagctctctccccttctcctccttactggctgctgctgtaagataaaaattaagtttaaaaggaaggtacaattttacagacatcaaatcattcatctaagagttaaagcaggatcaccaataaccaagcatctgggtccttgggttgaagctgagtaatgaccatagcagctgctcccacctaggagtcagtctccaacagcaaaaaacctcacggagaaataccaggtggtcatgaggagttagtcccattcataagtcccactggtcaccctcttccttcaagggctcatgcgtaaatttcataggggtgggtacctgggatcttaactgttggggttcctactctatatacacctctattaacctcctctccttttacaatctttatttccttcctttatccccgtttatgacttaagactcatagtggcccctcccctaaaagcaatgcttgaaagcttatgctgaaagaggcccaaaggataggcccatctcaatacatcatctaaccttggttgtcatgaatgcacctccttctcaaagatctgaactcttcagctaaatctgcacccaccatctgcccagtctttatgtgatttcccctcttttgatgattcttggggaaagagctgagagctttctagctgtatcaaaggagatgaatggagggaaactaaagaggagaacctgactatacctcacattcctggtgaaaggaaatttgcttctataggaaatagttgagaagaccaaactcttggaaaaataagacttccaaggatcgaatatcagaggcagaggtaagcatctacagtagctgggagactagggaactaaatggcttagtctcttggatggaggaagaagtctactagctgctgctgcccagatagttaataccctatcctgaaacagagactagcaactgagctgtgagaggccagaaggaaacagtggcataacaaacacgctgccatggcaacaaaacagctggaaaacacctaagaggctgcatttatacctaaaccaccaagtgtggtcagtccacagggaaggggttggaggagtaagaagtcccctataactaacccctctatcctctgttcctggacggtgagataccctttattcatcctatcatcttaggacattctcagagaatgttaaaagtcagcacttcctgggccagagtttcagtcactgtcatttataacttcagatgaccacaatgcccttttcacttcaatttctttctctatcaaatcagatgactgccattgacctcagaaatttaggatatctggttaaccaaaatggttaaacagacttttggggatcttgcctgagttctgtagctgaggattagtgatctcatacccagagacctctgccactgccagatctgtgctgaaattatacatcccactacaagaaatgcatcttaagaaagcctcaagagagacagccttcccagtatcttggtcaagaataaatgtgaaactgctggcagaaacaggtatacactttccctgaaacttcttgggcttgttgttagtaccttcgagaaaaagatactggagcaggttgtgggatggttcaacgggctcttatctcatcctctgcctagacacaccccctattatgttagctactcattaggtctaaattaactactatctcctatttagagccagagatagagagcaggtgatgagaataaaactggttcccaaacttggttgtatatcagaagcaacattaaggagtattttttaaaaaaaaaaaaaaggttctaggactcccccccgctcttttataaaatcagaattttgtttgtttgtttgtttaagagatgaggtctcactatgttgtccaggctggactcaatctcctgggctgaagagatcttcctgagtagctggagctacaggcatgcaatatcacagccagcaacaaatcagatctttagaagtgtctggttggttggttttgttttttaaagctgctgaggtgattctgatgcagctactggcttttgggaagcactgacaaaaacactcgctctcctccctacctttctccagtgtcctctggcttctttacttgatttcaaggagagctggccctttgtatccatgggttcaaccaattgtggattgaaaatatttgggggaaaaaaattgtgtctgtactgaaaaggtacagatttttcttttcattattctctaaacaatacagcatactatttttatagcatttacattgcattaggtattatcagtaatctggagatgatttaaagtatatgggatttaaagcatacacataggttatatgcaaatactatgctattttatattagggacatgagcaacaatagcttttgctatctatgggaggtcctggaaccaatccccactgcagatactgcagatactgagagcctgctgttatctggcctatcttctttctttttttttttttgagacgaagtcttgctgcgacgcccaggcttgagtgcaatggcttgatctccgctcactggaacctccgcttcccagttcaagtgattctcctgcctcagagtagctggaactataggcacatgccaccacgcccagttaatttttgtatttttagtagggatagggtttcaccttattggccaggatggtctcgaactcctgacctcaagtgatccacccgcctcagccgcctccccaagtgctgggattataggtgagcgccactgtgcctggcctatcttcttttacataaatccagagtctttgaaaaaacttggcaatgagagagcctcaggggttagcatagtgctatacacaaaatttttactcaataaatggtaaaaatttcaagtgatccaggcctaagttaacattctccagacacagaaatattgaagtgctcaccaagtcctgaatctctgagttcagattttctatcagaattagtttagactcttttttataaatactttggttatctgaaaccctttgctgctggataactgagtatgtgagggacactacacacctatttagataaaatttgtgggttacgggggtaaagaaagtcgaagagcaaagagaccatttggaaaagattgatttgtaacagcaaagagagaacaatgtgaattcctacctgatcacaggagcctagtgagtccattttatgagcttggaagtttcctgatctaggctctgaaggaacttcctaagttgcctctgcaataccctcacccaggcttagcctgtgtagtgtaatggtaaaagagctggctctacagtcaggctgcctgagtttgaatcataattataaccctcacaagttgccttgacagttttcatgcatataaaatgaaatccacagtaccaacctacatctcaaaaggcattataacatgtaacacatgtaaatcactgatcactggtatgtagtaagtgttcaataaacattacagttgcagacttttacatttaccattacattacattgtaattattatacaaaaaggaccctttgagtaggtccatagcagctacaggtatgtatgttccaagagggcacacttgaggaattaaaatattagaatgaaattaaaggaaatgtgtctggaatagctgtgcaaactgcttccagatggagtgtggtatcgtaaaatctggtgtgtgcatgccaaatgtcctgccatgggggcctgctggatctgtaattctgctctgtatacctaaaaagcatggactctgccttctcccttcccttctcttctggtaccctcacgcctagtgtttattcttagtacttcacctccactcacccagagagtaaaaccaaggaaatcaaacactgcttccaacgcccatgggaatctcccctctacccacccctcctctcttgttcacttcttgggccaacaggattagggccacggaactgttgagtcctgtgtgaaacttagtccaacagatcttgaatagtcacagatcaccttaagagtttgtccctgcatcaagctttctatggatggctcagcataaatccatctctgctatgaaaaacaactcaagaaaaacaacagaaggtcaagtaccatgactttgacttaaaaatggtacagacatacatacatatgtcatgatgagctgagatcctataaatgccctgggctttataacccaccctcacactgtcctctggagccacttgagtgagctgtgacctgcagagggggtgtccggccaaccccacacaggtacttaccgatgtgctggctgtaacctgtgagctagagctggcgggtgcaggggaatctgaggaggtggagagctgtcgcaccaagggactgtgtggaggatggtgggtggctgccaagtagctcgaactgctcatgtctgtgtgatgcttcaacactgcagaagtcaacagaaaagagagaaatacatggctatcttaaccagcgttacttctaacacaagcttggaatggcagcaatacatactaaaggcaaaaatgttttctatgcctagaggataaaaaggtgaagcacactagctgtgggaagtaggggcagggcagaggttgctgtagcagttaagaagtgacctccatttagaagcagtagcgtccctctactctgctttcctagaaagtgaaggacaaagctgggggtaattaagagaagcctaggctgccccagaaagccctgagcaggtgcagttgcaggtagaggtgccatgggcctggccctaccttcacttctctcagatgaatggtctcgcaatctcattttgctgtggtttgggtcatgcacgggtggtggtgggttgagcaagcgctctgcttttggcgctgtcactcgctccaccatgggcacggcccccacatcgtctaagtgctgcctgtgggtcctgtcaggccgggtttggtgatgggacagctctgaagaggggaacagaaaaagagctgtgaaatatgtcctctcaaatattttcttattcgagttccaagctctcgagttctctctaggccaacgccgtatacccagggcagcaggacagtccttcaggactgaagtttctagtaatttgcacaatggctaggataggcacagggagcccagaaccagagaaacatgtcaccaggatacagaagacacctgcccgtagatgaactcaatgccatgccattgctggctgttcactgagcattttgggtcttgctccaagatccatggtgtctagaatagctcccgaagtccatctgagagcatccaagacaagcagaagcagtcactgtgagctgaattttttatcggtcaactgcctctcccaaccccaacatgcatgcaaactacaaatttgagaatataaaaggaatgaaaagtcactgatactctgggggacttcccggctccctgacacttactggctgttgttaggaaggagctgaccaatttgtgcctgtccttacgagctgaatctggcagactgcccggcatgggtgctctgtgcttaagcgataactttttgggaggtttgattttgtcaaaaggcttgttctgccactgagatttcagcatgctctggaaatgcaggcttgtgggaacatctgcaagaaacataaaatgctacaggttagtccaaacacctggcctctctagtgttcaagacctacactccatcctcctttaatttgcccagtggcctgacacttggcagggcaagtgctgtcatatggaagatctgtttacgtgaacattactgaaggtcattcttctatttgcaagcaggtcactttagctttttactttcaagtcccaaagggaaacaaaacaagacacctttttggtttggttgatggagtttttgttcttgtatccttgtttgttgaatttactggtttgaaaacatcctgtttctattctagagatttaaaaacatatttaagcctacttcttttctatcaatataaagttaatcaggatgcaattattcaacaatattcattatctatgttatcaggcactgtactgagtactacatactctctccaaataagaactacataccattctctctttccttcctctgtggctccgccaattcccatcatgagattatcggggatttttagctgactggttaatgttcaatatcacaaatcaacatcttttggactgaattttttatgctgtttcttatctttccattttcttagatttttcccaagaatatatccttgagcaattcctttagaaaaggaatttctagatttaaaccattttcctctcaaacatttaaagctattcaattcttccgtgtattctaatatccagtgctatatttaagagggaatcggattctttcttacttgtaggtggtctggtttttgccttttaagcttctgcaaaaaacaacaacaaacttgtggtattacactgactctacagatcaatttggggacaacttccatgtgttccaccaccaatactgaatctttcaatcgactgacgtggtatctctctctccatctatttacgtttgtcttgattttctcttgacagcgtttagttattgttgacataccggtcttaaatacaatttgttaagtttattcctaagaattagtgttttctgatgggcagaagttggaagagtttgcagggttcagaagaagacaggaagatgagggaaagtctggaacttcttagagatttgttaaatggttttgaccaaaatactgatagaaatacgggcagtgaaggccaggctgacaaaagtctcagatggaaatgattaaagatagtaccttttaaaatttcaacttcagttcttcattactagtatatagaagtacaataaactgctatataatgaccttgtagcctgtgaaactacttcgttatagactttttcttgtttattcagtaggattttctatagacataagtacatcatctacaaatggagactgttttaccttttctttccaatctgtattccttttttacttcttgcctattactctgactggaacctctggtgctgatgtacaacttttagattttccttttcatgttttcaatattctgacatttcaccaccatggatagcggtgtgagtctgttttcaagcttctgcaaagctttccagggatattcaaatctaaaagccagcacatttttcctcacctcccagttcctcctgggaatcggtaaccacttggggcatgctcagaagttcccgccagagtccctatccactgcttcagaatagaatgaaacaccactacttcaaggaagaaggctctggtggggtgagaggacaggaaaggaaaatctaacctagctattccaaaatgagtccaaatttatcacccagacaaatgcccaggtcctatcactactccttctgccctttaattctgggtcaaaaacctcctgtaatcagttcccacctcacagcaacttactcctggcatgtgctttgggctatctttctatttatttcttcacagttatcttgtctttatccatctttcaaaaataattacaaattccagtcactgatagcatgtcttctagaactattagaaatttattttgtgtgtgtgtgtgtgtgtgtgtgtgtgtgtgtgtatatttttttttttttgagacggagtcttgctgtcgcccaggctggagtgcagtggtaccatctcggctcactgcaagctccgcttcccgggttcatgccattctcctgcctcagcctcctgagtaggtgggactacaggcacccgccacctcgcccggctagttttctgtattttcagtagagacggggtttcactgtgttagccaggatggtctcgatctcgacctcgtgatccacctgcctcggcctcccaaagtgctgggattacaggcgtgagccactgcacccggcctgtttaatatattttctaaaagcttatggggttttgggtcccatagagcacagaggatatgctcaatctgaactgaggataagaaggcagggaagagacgtctaaattaacattactgaacccattattatctgccaggcactgtgtgtttatcatcatgcgtgtgccacttaatctttgtaacagttccatgaggcaaacacaattatgcttattttaaagatagggaacaggtgcagaaaggtacattaactatgtccaaggttacatagtttaatgagtaacaaccaactttcaaactcaagattatacaaccctaaagcccatactcttagacaatataccttgaggctactcactgatccagaggatggagaggattctgtagtaaagtcaattatttctcaaattactcccaagaaatagacagtacaaaatattttccaagccagttctgcagagtaaaagaaatttagccactcctgcctatggtatagatgatgaatttcatgacactgaatgttatgccttcgaggactgaatgttaggccttccaggactggaataaaaatctgagttggggaaaaaaaaaaaaaaaaaaagctaacattctcagggatgatttttcccagtgggtaagcaccctcagctccatgattgctgggctttatgacagtgaaacaaattaggaaaactattaaagttttaatgaaaacataacatttgctacctgtccaagtgtaaaaacacagtctctgaggacagtgctgtcttctcaaacatttttcataatcactcttttccacacttaaaaactcagctataccaaatcctaggaaataaagcattgtctagaagcattcggccctgtaaaacaatctgaaagctgggctgagctggaatgtataaaagaggctcaagaaaggagacgaggtcacttctgcccatcccacaatacccctttgtcagcagaagagttactcccacttggcaaaggctgtgtatgttttgtatatatatgtaatggaactccaaaaaacatagattttattttttccttttattttcccccatcgttctcccaaatctgaaaatgaagccaggaaaaaaaaaagggacagggatatgagagacctggttatagtgaaaacagcaatgactagaaacaagtaggcctggattcaggtcctggttctatctcgagtagaaggagaaagcaagaacaaatcattcagctgggctttagttccacctgtgaaatgaggcagtggggctagatcagggctggcaacattctagcattcattctctaaccctcctgttgtactggaggtacaaacacagctgtctttcctgttgtactggagacctcagattcttcccaaacaatacattaaataactccagacagttactgtcaattcatttgaataggcacaagaaaggacatctatttgttactgctagattatatgactgctatgagtctctcaactctaaaatgtttagtcaatgactcttcaactggaactccactcctaaacccttcccctcaactaaatgctcttaagtgcaagttggcacattgtagaacccaagtcatggaacactaccttgtactctccagttgacgtattaagcggaatcaagagcgattcctctttaaacccagtataaacagtttaaggaactccagctgctagactttgttagaagtttgctgtgttgccttttaattgcttccatgttaagagtgaacaggaacccagttatatcccccagtcagtaaaaaaaaaaaaaaaagatatcttaggaattgctggttgagttcatatactaactagtaagtgataatacctaggttctgtgaagagttaaaaatctaaaatagactggatacgggacctgaaagtaagcaaaaaaagggatatgaaatggaagagaacacaccagagatccattcagctagaggtctcctacattccatacccacataggtaaactgctattttcagagaagagggtgctgatccttatcaggtaaataacaggaaaataagacgaattactaatgtcatccttaagttactgtttcctcaaacaaaatgaaagatgaatgagaagaccctgacttcaggatgactagggtctgacattccacgattcacctggctgtctggctccttactttccaccattttctcaggcgcactttttccgggtgttttgtaatgctcacttcttcctcctgctgggaagttgctgtagcctcatgtgcagggtttggcaagctctctcaaaataccacagatcttcatggccagcaggtggtgctcttattaagccccttttataaagttaacaagcttttctccaaggttatatatcctctacatttccaactaaggattaactggatttgattacttgaggtgataaaacaaagcccccttcctgctggaatactaacaggttattataccctagtctctccaccttccacagccaggcgtagagttggctataacacagtccctcaatttctatcacccacacacacttaatgagaggggctgaggtacagtcaaggtgcgaggcacaactccaggatgaaaagcagcagttggttgttattctaacaaactacacaaactggttaggaaacagcactaaaactacttaaaaaaatatctgtcctatggggccagaaaacagctaagtatcacattcaaacaattttctgcctttatgtctggtataaatgtaactatatggaatcaatgaatcaaaatcatttttaaccttgttatgaaaaaaaaaaaagttggaaatcctgccactttaaaacatcttctagagaagaggttgtaagggtggcccagtagtaaaatctaccacacaaatgtttgacctacacagtcgtatgccaagctgctagccttcactgttatttactgctatacaatgatgtacagggaatcccaagacttcagggggtgtgttatttacacgggatattatgtgaatggtgccctttggagttggctatctctgcacccatgggaatcttctgatttccaaatggactgcattctgaatgtggcagttgtttgggtcaaagcaaaattattccaacaggaataatattagacatggtaatcaggtcttcaggtcaaccaactgaggtgtaattaatctacaggcaaatacagtagttaatagagcctacatgtaaaaatatatatatatctccacagtctcataaggagaatttaatgaccaactttttcgtccaaaccccagggccatagctagaagctcttcgtgtgtgtgtgagacatagacagaaaaacaaataggattagatgcaggaaaataaaaaccataaagaccagaaaagggggagtgttccctatctttctttccattccccctcattgctgcctgtagttgctctgaatgatggtgtgggaggtgtaaggtatgcggcagggcagcattcatgtcagatctatagtgtcctgcagtcagcaggacagaaaatgttcaagggaaatggaacctcttagtagagatgctgaatgatggaacaggagctgagagacacacagtctgggtatatctgagggtgggggaggttatttgcaactgtatgtggtaatgctgttgacaaagaaatgactgttctgtttagcaggtgatatccaatgagtgtgcttaagtgtccgggcttcctgtccttcttcaagtatgagactatacaattcaacacagtaattcagagagtaacccaacaaacattcctaagtcttcctagtggcgctgtctgtagccagaatcccaaaaagggtaaaaatctgactcctcttaataatctgtctggaaaggaacttgaaatatagtaaaaggaaggacaggcatcagataatctgggtctgaactgtgaaggcattcaaacccattagccatttagttttagataagccacaaccttaccaagcctgttccttgagcactaacactgaagtaacaccttacaaaatttctgggccgggcatggtggctcatgcctataatcccagcactttaggaagccaagatgggtagatcgcttgggcccaagagtttgagaccagcatgggcaacacggggaaacctcttctctactaaaaatgcaaaaaattagccaggcatggtggtgtgcacctgtagtcccagctacccactgaagtgggagaatcacctgatcctgggaggccgatgctgcaatgagccaaaaaccacaccactgcattctagcctgagtgacagagtgagactctgtcaaaaaaaaaaaaaaaaaaaaaaaaaaaaaaagccaggtgcggtggctcatgcttgtaatcccagcactttgggaggccaagacgggtggatcacgaggtcaggagttcaagaccctcctggccaatatggtgaaacccccatctctactaaaagtacaaaaattagccgggcgtggtggcgcgtgcctgtagtcccagctactcaggaggctgaggcaggagaattgcttgaacttgggaggcggaggttgcagtgacccgagattgcacgactgcactccagcctgggtgacagagcaaaactgtctcaaaagtaaaaaaaaaaaaaaaaaagaattttgaaagcagcatatgagacaaatatgagaagagtactacaaactttaaaatgctatacaaatagtaactgcagttacatgggctacataaatccaatggcaagggaaggtaaaagtcagtgactctggaatctgaagcacagaggaaaatgttttagtgttttccactcattgtgttcaagtttatttattgctccaccagctcctgactatccatgtgttccaggttttctgtttcctttctcttacaagaaatcacatggccacaggaatattacaccacatccttatcacagctagggggttttggtaacaaaagccaaaaatcccggtatctactggatttaggtggccagaaatgcaatcatttgaagaacagatgcagaacaggggattatagttatctaatatttgatcaactgtcaattagaaggattctctctaggacaagggttagcaatgattgtttttataaataaacttttgttgcaacacaatcaggttcatttgttcacatattgtctatggctgcttttgtgctacaatgacagggttgagcagttgtgacatgaactgacatcaattatatggcctgcaaagcctaagatatttaccatatggcccttgaagaaaaagttcaggccgggcgtggtggtttacacctgtaatcccagcactttgagaggccaagatgggtggatcacttgagctcagttcaaaaccagcctgggcaatatagcaagaccccatctttgtagggggcgggaggcggggaagcaggttgtggtggtgcacacttgtagtcccagatacttaggaggctgaagtgggaggactgtttagagcccaggaagtcaaggttgcagtgagctgtgatcactccactgaactccagcttagggcaccgagcaagaccctgtatctaaaaaataaaaattaaaaaaaaaaaaaaaaaaaaaaaaaaacttacagactacctgggagatattatgaagaacagcatggagcccttatcctcagggagattacatcccatcccttccccactccccccgccaccaagacagggtctcactaccgttccccaggctgcagtgcattggctcaatcatggctcactgcggccaagacttcctgggctcagctgatcctcccacctcagcctgctgagtagctgggacgacaggcgtgtgccaccacgcccagttaattcttgtgtttttagtagagatagggttttgccatgttgcccatgctggtctcaaacttctgacctcagatgatgaacccgccacggcctccaaaagtgccaggattacaggtgtgagccactgtgcctggtccctaaaatttaaataacagaaagcaaatacacaaacagccataacataattcattaacatattgataaaacacaatagggtaggtgcagtggctcctgactgtaatcccagcactttagggaggccgaggcgggtggatcacctgaggtcaggagttggagaccagcctggccaacatggtaaaaccccatctctactaaaaatacaaaaaaattagccaggcgtggtggcatacgactgtagtcccagctacttgggaggctgagacaaaactgcttgaacccaggaggtgggggctgcagtgagccaacatcacaccactgcactacagcctgggcaacaaaagcgagactctgtctcaaaacaaaacaacaacaaaaacaaaaacccaccagtgatttgagaggaaattcctaccttctgtaggctgggcacagatcatgagattacgtgaaaattcaatgaaaccaatccagattatgaaagcgctggcttccatctagaatagtggtttcaaaatgtctttgctcatgcacccccatttgatatgtgatttttaaaaaatcataatttcagatagttgtaaagattatatttgaatactacataatgctttaaaaacatttttatcaaaactttggcatgtaaatatatttagcttcattaattgaaaaaaaaaacttcttttaaacttatttagctaatcagactttagatattaactcagtatttattctaagacagacaaggaataggaccatgtaactgagctcagacccatcccagccactcgaagagttagagggaaatctcttagttgcaatcttttagtggtaccctctggtttggtagatctgttgcagtctttttggagaattctaagagaagacttggttgataggagttcctgagttatctctattttatttttaaaattcaaaacttttttgcttaatacctgggagattctccttcaggtgctgagaactcttagaaatgatctctttatttgttgtccccaccatccaagacctttttttttttttttttttttttttgagacagtcttgctctgtcgcccgagctggagtgcagtggcatgatcttgactcactgcgacctctggcctccaggttcaagcgattctcctcccaaataactgggattacagacatatgccaccacgccctgctaatttttgtatttttagtagagaaggggtttcaccatgttggccaggctggtctcgaactcctgatctcatgatccgcccgtcttggcctcccaaagtgctgggattacaagcgtgagccaccacacctggtctcgaactcctgacctcaagtgatctgcctgccttggtctcccaaagtgacgggattaaagacgtgggccacgacaccgagcctcaagatttttacactctggggcaagacccatagtgggactcaatatggccaaaaggaatgctcttcttttgtcaagtgggagaggtacaggtatgggaagggaggtgggaaaggagggctgtcagacacagagatttaacagggaggcaaactttagaaagacagtacaagctaacaacgaagatttgtgcttatctacaccctgcaaagctgtcgcgttaccacataaatgccagtatgaagatattctcctagaacactgccgtccatcctacattatatcatggcacgcacagacaaaacttttttttttttttgagacagagtcttgctctgttatccaggctagagtgcaatggtgcaatcttggctcactgcaacctctgcctcccaggttcaagcaattctcctgccttagcctcccaagtagctgggattacagacaggcacaaccacgactggctaattttttatatttagtagagacggtggtttcaccatgttggtcaggctggtctagaactcctgacctcaggtgatccgtccacctcagcctcccaaagtgctgggattacaggcgtgacccaccacgcctggcccagacaaaacatttttaaagatatactaagcgtattttggaccagattactgtggctagaggcaactgagcccagatccctcctagctacttgaagagttagaaggaaatctcatattaagttgcaaccttttagtggcaccttctggtttggtggatctgttacagtctttttgcaaaattctaagagaagacttggttgacgaaagttgtaccttgaaagtatctgagttgtaactgcaccttggctgattttctttcacctagaagtctctcaagtttctttcattagactttctagtctgtggtctttcttaccatctggaaatgctagaacaggatgaacacaagagtccaactgggaaagacgttccaacagaggggcttcatagtgaatttcgggaggcatggtgttgatgctgcctgaaccacacagtgcgcaggagggattcacatcacagccagggcggattgtgctgttccggtgaacctgtgaaaaaagccaaacaaaactgacaattcagcatctgataaaaagccagctacccatttgttatccccatttgttattgagaagttagctccccatttgttattgcgaagacctttctagatacttgtgtgacactactaaaaggatgtttgattagtttgttaaaagatttccatttgtctaacacactgaccttcaaagtgggtaaggaaacttgcttccttttcattgatgaaatctaactacttgaagctctaagtgcttacctaggtatcaaacttctgacagtttaaaaagatactaaaactgtgctttctgagaacactttataaactctgcatgctttcacgaccttgatggtccgctaagacgaacagttggttcttgattcccaggtgggacattacttgctttcttcagcaaatttatccacctaggagccttcaattaccaaccacacctcttctcttcttttcacacctcttcttcaaaagactttcaggtggtctcaagccaggtggcaagcttccctgaagcttgtaacttaaaagtaacttattaactactctttaacctggcctaaaatccactgttacaaagctcatacctaagtaataaaataacattttgtacagcaaatgctcactttcatagtcttcatgttagattaattccaaagggtagaaattatttccactgaacttcctttgtgcacatgtgggcagaataattgataacctctccaggtaagtccaaagttaaatatgaactaatttaagtcttcaaaagattgaattctgtataaaaactgaacatctacaattttatactttgagcaaatttcaggtcatgctgaatgcaggatccctacattctagtgttaggatgaacaagtctggcatttgccaaagcctaactcataaagtcacctggacacacagccccagaaaaagaaacttgcatgttgaatggcactataagaaggcatcctaggtgcaagctcagtagtagaacaaagacaaaaagcatcaaaactctactagcaaaaactctaacatttactagagctccatttattttcagcagagacatctcgaaagccttttatggatttgtgtaagagaaagatatacataagaacaatgtggtctttatcaacattcccccgacattctattgtaaccacatagagaggtggcacgcaaataaagtcttttaaaggttagactgggcaaatcacacagaactagaagccactgaaagggagtgataccaactaggcatgctacttttgtgtagacaatattaactggtattgttttgggaaaaaaaaaatccctgtatctatgtaatcagagctggctttctggagaggatgacattttgaggtaaagagaaatgagtaggtagagatgaaaatgagatcacacagtgggtgagtgggaggatttaggaaaattggttaggatccaaaaattacactgaaactttcaatattcaaaagagattatctcactccagtaggtatagcaaataaaaaataaaaagagagagactagaaaccaacccatgacatcaactagctctccatatgggacatttaacaacactacattttatggctagagtgtatcacttaagtcaaagtcaatattgggaggccaaggcgggtggatcacttgaggtcaggagtttgagactagcctggccaacatggtgaaaccccgactctactgaaaatagaaacgtcagctgggtgtggtggtgggagcctgtaatctcagctactcgggaggctgaggcaggagaatcgcttgaatctgggaggcagaggttgcagtgagctgagatcacaccactgcactccagcctgggcgacagaatgagactaagtccaaagacaagcaaacaaacaaaaaaacaaaacaacaacaataaaaaaattcaatagatgtggctaggcgtggtggctcacaactgtaatcccaaaactttgaggtgggagagaggattgcttgaagccaggagtctgagactagcctgggcaacacagtaagactccatctcttaaaataaaatttaaaattaaaaaaaaaaaaaaaaaaaaaatttagcccagcatggtattgcatgcctttagtcccagctactcaggaggctgagggagaagaatcgcttaagcccaggagttcaggttatagtgagccatgattgcaccactgcactgcagcctgggaaaaagagtaagatcctgtctccaaaaaaaaaaaaaaaaaaaaaaaaggctgcgcatggtggctcacgcctgtaatcccagtactttgggaggccaaggtgggtggataacctgaggtcaggagttcgagaccagcctggccaacatggtgaaaccccgtctctactaaaaatacaaaaaactgggcatggtggtgggcacctgtaatcccagctactggagaggctggtaagagaatcacttgaacctgggaggcagaggttgcagtgagctgagattgcaccactgcactccagcctggggaacaagagcaaaactccgtctccaaaaaaatttaaaaatttaaaaaaataaaataaagggtagaaattctacttataacttgacaaaagggtaatgtgcacacatgtaacttaaacagtaatctcacttttaaattaaaaactgtaaagtactaatagaacccgaggagtatataaaaatatatttaatacttattttttttttgagacagagtcttgctctgtcacccaggctggagtgcagtggcgcaagtctgccttccaggttcacaccattctcctgcctcagcctctcaagtagctgggactacaggcgcccaccaccacacccagctaatatttttgtatttttttagtagagacagggtttcaccattgttagccaggatggtcttgatctcctgacctcgtgatctgcccgcctcggcctcccaaatgctgggattataggcatgagccaccgcacccggccaaagatatatttaatacttattaaaggatacattttggaaaatttttgaaagaaaacttgaattcatacccatgttgcacaaatccacaccaagaatctatcctgcagacaaacttaagtgtacacacgcacacgctcttccactgaaacaagatgccaaatcatctgcatgaattcatttaagttaaaaaacaacaagaacacacacaatattgtgttttacaataagaaaacaaatttttaaaaatatcacaacagatggtgtgcacgtgtagccctagctatttgggaggctgaggtggctcacttgagcccaggagtgaggagctatagtgatcatgtccactgcactccaggcctgggagacagagtgagtcagtctcttaaaagaaaaaaaaaacaaggatctcctgggctcaagagattcttctgccttagcctaccaagtagctgggattgcaggcatgcaccaccacgcccagctaatcttttatatttttagtagagacggggtttcaccacgttggccaggctggtctcaaactcctgacctcagatgatccacccgtatcagcttcccaaagtgctgggattacaggcgtgagccatcgcgaccggtcccagtcatgaaatcctattggcagaatccaaccacttcataccacctcaactacactcaatctagtccaagtcactatcttttctcaaatgggtttcttcaagcctcctaactgatcctcctcctactggttcttacttccaaatcaatcaacacagtaatcagtgtaaatcttgttttaaaatctcaatcacatcataccaacctcataatcttccaaatgacttctcatctcacgaggaatagaaaccaaacttcttgcatggttcccacaaggtcctatagtatttgtcgcctctatcccctctctctgacttcacctcatttttttgttactctcctagctgacactaccagttactctgatttccttgctatatttctccaagatagcaggcaaccttccagatcacaggcctctgcacttggctcttcaaccactaattccatggtcattctctcacatcgtgtctttttctttaaatgtcagtattcaaagtaactttttttttttttttgagatggagtctcgctgtcgcccaggctggagtgcagtggtgggatctcagctcactgcaagctacgcctcctagcttcatgccattctcctatctcagcctcccgagtagctgggactataggcgcccgccacaacacctgactaatgtttgtattttttgtagagacagggtttcacggtgttagccaggatggtctcgatctcctgacctcgtgatccgcctgcctcagcttcccaaagtgctgggattacagacgtgagccaccgtgtccggcccaaagtaagttttatttagaaatacaagtgaaaggccaggcgcggtggctcacgcctgtattcccagcactttgggaagccaaggcaggtggatcacctgaggttaggagttcaagaccagcctgaccaacatggtgaaacctcatctctactaaaaatacaaaaaattagccgggcatggtggcgggcgcctgtaatcccagctactcgggaggctgaggcagaagaatcgcttgaacccaggaggcagacgttacagtgagctgagatcgcaccactgcactccagcctgggcgacaagagcaaaactccctctcaaaaaaaaaaaaaagtgaaaaaagattatattcttgactgtaacaacaaaaaatgccctggaataagtttaacaagaaatttaagcacaaagcttaaagatattgatattctacaaattaatgcagaatcttaatagacttgaggggggaggggagacaaggcaaaggggatttaaacaaataatctaaaagatacaactgaaagaatgtaaggaaccattccccaaaatttctgataagcaaaaatacaggggagtgatctggcctattacatgttttatagttacagtaattaaaataatctgccctcggttaagaaacagaaaatttaaataaaaacaaaaattgaccaaagtatatatgacagtttattgtttaactaaaataatacttttaaatcagtttaaaaaaacaaaaggaggtattactttttcaacaaatgaatcaggaaaaccaagaggtcatacagaagaaaacggctgcatttctgcctcacaccaaaattaattctaaataaagatttattcattttcattttattttatttttttgatacagagtctcgctctgttgcccaggctagagtgcaatggtgcgatctcggctcactgcaacctccatctccgggttcaagtgattctcctgccttagcctcccaagtaggtgggattacaggcacccaccaccaagcctggctaatttctgtatttttagtagagacgggggtttcgccatgctggcaaggttggtctcaaactcctgacctcaggtaatccacccaccttggcctcccaaagtgctagaataacaagtgtgagccaccgtgcctggccccaaataaagatttaaatataaaaacaaatattatactcaaatctaaaaaaaaaaaaattgtgaagcaatatatagtggttaacagtatgagctgtggagccagactgcctgggtttgaaccttgactccgccacttactagctgtgtggccttaagacaagttactgtgtcttcatctttactaacaggagagtacctgatagagttgttttaaagataaataactcacaacagtatctggctctcgactcttaatcacttttgtaaaaccgtaagtatagctactgatagaacatttaccatcaaacttgatagaacatttaccatcaaagatcttgatttcaaaattctagcttcttaacactgtataatatgatcattgataagtcacatgacatccttaaattttctcacttgttaaaaaggactaataataccaatttcatgggagtgtaggaaagatcaaatgactctgtaactgttaaaacattacacaaatgttagctaaattagtataccgcatgatttctcaacagctggcacttctttgttgtggggcacagtcctgtgcactgtagatatctagcagcatctctgtcctcatggtgcatgtgcctccctactcccccaatttgtgaaaatgagtaattactacagatattgccaaatgtctcctgtgaggacaaaatcactgagaaccatgaggttcaaattacggtcatcccgtctagaaaaattcaaagcacaggctcccattaaatattagtggtgagtcacagtaaacataagactcagtaaaaaaggaaaacaaaaaaaataaaaattaatagtaagaacaaagctctcaaagactattgtcaagaacaagcctgaagagagcttcccctaccaaagatcagataacgttagcatcataaagaaaagactacaatggcttgaaatacctcaaatatgtttcaatcaatgactcacagccccttcatgaaaaacttcagtgactgtccttagaggatagtagaaaactaatttgttattttgaaaattggtaaataaaaaaaaacaacaaatcatgctttcttctgtacaaactgtacctcagggtaaacaaatagttgaaaaggacaattttccctttataaacatattctatctagctaataaaagaaaaacagaaatgatacaagtagaatatcaccattcttcagcttccaatttaacaatgggtccaggcaatgatcaccagtggttgataacaaacagtttagtcattacgtgtcttctgatacaagcataaggcggccaccttgtgttttctcacgaaactaaaactggacttattcacgtttctactagttttcaagaaaaacaagggacagaaaaacatcactgttttttaaatgcactaaaaataagatggattaataaatggaaggatgattgtatgctaaaatgttagtggtagaacctagggagtagctacataggtgttcactgtaaaattcattcaacttcgtatctgaataatttcataacaaaatttggaaaagaaaacagtgacaccacaggacttctgcttctagcagagtaatagtgatcagatttacctttcagtcataaaccagaaaactggacaacaggcagtataacactgagaaataaatggggtggtctctaagactgccctggttttccgtctggaagtacattctagactgcagggcagggagaggatctgaagcagagtataatagcttcactgagttgaggaagcaaattctcactagatcagaattcagagactaaggaaactgaaaattgcaaggcaaaattcttgagaggaggaagctttacagaaaaagagccccagaaatcttcataagatccccctgagtgtttgctaaatattaaaaggtgcatgtaaagggtgaaactatcaggccaggcaagagcaactaggcagctgtgagctgaaatggtttccacagctaacacaagcctgagaggcttttaaactgtgaccagccaaagttgcatagagaattcaagacagaagatcctgctttagttgtggagctagactactaaggtggccaactcctcacctgacctaacaaatgacaaggaatttacctgccagcaaaacaaagcctctttaaaggaagatggcacaatccacatgctacaagcagggaaaattattaattggattttcagcttaaaacataaataaaacattgttagatatgccaagaggcaagaaaatactactatagggataaaatttttaaaagaaagtaggctgtgggaaactaaggtatcagataaatgaagttttctcaacaaataaatcacctatatggatagtttgtatcaaaccaacactctcactaattggaaaagccagatttaaaacacacacacacacacacacactctctctctctctctctctctctctctctctcaaaacataagaaaaatgctgacataatgacaatattgaaagctaagattccagagaggaaaagaacctggccaacatggcgaaaacccatctctactaaaaacacaaaaattagctaggcatggtggcacgtgtctgtaatctcagctacttgctgaggcaggagaatcgcttgaacctgggagatggaggtttcagtgagccaaggatgtgccactgcactccagcctgggcaacagagcgagactccatctcggaaaaaaaaaaaaagaaagaaagaaaaaaaaaagagcagagcttttggtactcttgtagggctgaatggataacactagagacttgaaatgtcaaattatcaataaaaagaggacagggaactaagcatgacacacttccaagtaccaccctcccaaagaaatagctgaagttgtgaatggtaggaggctacaaagctaagtggaaagtctctgaaaagggcagagatgtttctggcagtctcgtgaggagactagaattagatctcaggatatgctaagaggaaaggaggctgggcacagtggctcacacctgtaatcccagcactttgggaggctgaggcgggcagaccacctaaggtcaggagttcgaaaccagcttggccaacatggtgaaaccccgtctctactaaaaatacaaaaattagctgggcatggtagcacgcgcctgtagtcccagctacttggaaggctgaggcaggaaggagaatcatatgaacccgggaggcagacgttgcagtgagccaagatcatgccattgcacttcagcctgggtgacagagcgaggcgaggctctgactccaaaaaaaaaaaaaaaaaaaagagagagagagagagagagagagagagaaaaggaaactgatcaacacatgttctcagctggaactaagagagagaaacagactgttatctttttgagacagagtctagctctgctgcccagactggagtgcagtagcttgatcttgactcactgcaacctctgcctcccagcttcaaaccattcacctgcctcagccacctgtgtagctgccaccacagctggcttttttatttttgagatgaagagattgcaccactgcactccagcctggcgacagagcgagactccatcttgggggaggggagggggacaaaaaacaaacaacaacaacaaaaaatcagcctgtgcaacacagtgagacctgcatctcaataaaataatgagataaaatacttgatacacgaagaaattcccacgttcccttaattaatactgcaatgctatcaattctctttgaaggaattcccaagaaatactcaatttaatacttatgaaggaattaataccaaagtaaaactctattcaccattttctgttaatcatagcatattcgtccaaaacactaaaagaattcttttggctcaaggacaggttataatcatttgcttttgctttgcatttgatattcgttatctaactcatccactgttaacatgtggaaagattttcaaaggtttggcaactctatcacaatcaagcatatcccacaactggctcttgaagatccatcagagtgaagaaacaaaacgtgtaagcttctattttatctcagtctttcaaaatttattttgtatgtgttttataatgtatatataaaacaccgtcataacagtttagaggtaactgttccaagcacagagtgatttctgagtattcttttagtagctttatgtcctaaggtacaattttctacatggcatgcttgctcctttccaaatgtctaactagtatgaaaaagttggttgggcctccaaggtctattgcactctgtcaaggaagaacgtatcaaattattaacttttaatactgactcatattctagttcattagtcctcaaccatggtgtcatgaaactggatttaaataggtggaatcaaaactaggaggcctagaatcatatattaacacctttatttaccctgatgtctacaggaaacctggtcatagccatgagagaatgccctgtacaaaaatgtcactcttcaagtgtgatacaatgggaagaagaggaggactactcggaattctatggaagccagctttaaaatttggcccagagcaatcccccctatgacaacaaggactacaaaattctaaaatgatgccagtacactgccaatttgttaggaaattgctactttttaaaaaattgaaagaaatgctattaagggcaataaaaatttcaagggtatgttagtaataaatgtagccattacctattctactggttattagtacaaaaaaacccagccttttcaaccattcatttccaaacactgatggtttccactgccagactatacacaagtttctaatggtccacagtaaattgagaatgagaacaatgcagtaaattattaataaaactacattcttttcttttttaaaaaaatactatttgtcttatggtttaattataaacataattttacttaaaaaataaaaagcaaccttatttgaaaattggctggtaccaattttattttaataactttattgatctgaaatcttagtacgtttaggttaagttataaacacctacttcacttaggcactgggccaggaaaagaacataatggcatataagaactttccactggagtgcttcttcattcacttagataattactaacatccaccatactagacccctaaagtgatgaaacacacaataaatagcaatataggctattcagtaattacaactagtaattccgtcattttataataaaattatgatttaggaagtactccatgttctccatgagccttactctgatattcacttaccacaccctagtggttattccttagattacatttaaaatattccacattcagagttgtagaggccttagactattatctcctccaggattactactgttagtctgtctttccacctccagtctcttgtgccaatccatcccaaacataatagttacagattggccgggcgcggtggctcacgcctgtaatcccagcactttgggaggccaaggcggatggatcagctgaagtcaggagttcgagaccagcctggccaacatggtgaaaccttgtctctactaaaaatacaaatattagccaggcgtcgtcgtgggtgcctgtgatcccagctactcaggaggctgaggcaggaaaattgcttgaacccgggaggcggaggctgcagtgagctgagattgtgccattgcactccagcctgggtgacagatcaagactccgactcaaaaaaaaaaaaaaaaacaaacaaacaaaaaaaaaaaaaaaaacatgttacagcagatttacctcccccaaaatagcttacaacacttctctgctcaaaaatttaaaacttatagactgaaacccaaatcatcagtttgggcattcaaggcttcctatttatttactgatagatctcatttctctttattcccaacgagtttaacttactgaacactttgttttagtcattgattttaagaagtacaagtgatataacaacagctttttttttttttttttttttttttagatggactctcactctctcaccaggctggagtgctgtggcgagatctcagctcactgcaacctctgacttcttggttcaagcgattctccagccccagcctctcgagtagctgggattacaggcacgtgccaccacgcccagctaatttttgtatttttagtagagatggggtttcatcatgttggccagggtggtcttgatctcctgacctcatgatctgccccaccttggcctcccaaagtgctgggattacaggcatgagccactgtgcctggccagcctttttaagggcaaaagagttactgcactaaacgtgcatctcaattttaagatatattccagccataattcaactaagctgatagccctttaaaaacacagtaattgggctgggtgtggtggctcacgcctgtaatcccagcactttgggaggccgaggcgggtggatcacttgaggtcaggagttcgagaccagtctggccaacacggtgaaacctcatctctactaaaaatacaaaaaatagctgggcgtggtggcgtatgcctgtaaccccagctactcgggagaatgaggcaggagaatcgcttgaacccgggaggaggaggttgcagtgagccgagatcgcaccattgcactccagcctgagcaacagagcaagactccatctcaaagaaaaaacaaaacaaaacaaaacctcaatgagttccctcaagtatgttttatttggttctggaatgcagtagagatcatttaagatgcaggtaaggaaaaaatattaatcacttgctttgtgtgttctgtactctgtactcacaataactgtgaactcactgtcatgtaacaatattagaacataatttacctgttaacttctttgctgtcattagaaagtaagctccatgaagataagggctttgttttccttaccaatgcaacctggctgccctgaataatacggtgggcattcaaaaatgctgttgaataaatctgtctggaaaaccgagcaattcaagatgacagaagacaagatgcttgctcatcagcaaataccactgaggtcatgtcatgagtgaggagccatgtgagacacagaaagcaacctagacagaaggaatggggtgtgtctctaactctggaagaactccagctttctgctagatctagtacatggtatatttcccaaagtcaactaatttctctgtcttatttttcatgcagcttacttttgtgtcaggatgattctgttttagaaagtggcattggaacaaaaggatatttagttttatgcctatctcttgcctaagctaccttttataattttatatgtacattcaaaactacattcgttcttaggcatggatcagaagaaggttggctacttcacatattaaaaaacaaaatccaggaggccaccacatacttcagaaaatttttatacgactcctgatgtcatgccatagtggctggtaaactgccaaaacagaggaagggtgctttattttcatgaggtggcggttttttttttttttttaaaatgtaaaagcattctgtgttaaattcatcaaggaattgacaaaaagctattttcctacacttgacagtaatatactgttttctgacattcctgttatcaactcctctgaaaatcttttagagatatacgactattagtaaaaaaaaaaaaaaaaaaacaaaaaaaaaactgagactgaaatgtcaatatgaaaaccctgccaaataccttattcttatctatttctgctattttgatatttcaggtagagtccgaggaatagacaggaagaaatggtatcgcctgacagtcaattctacaattcttttctttaaagagaacatggcaaacttacacagtacaactgcatactagaataaaacaaggaaagtactgaaaattcaccatgcaaatactaattgttccagcaattctctcatctcccttatttgtcattagcaaatatgttgctagtggctctcttaagaaaaattcccattctctgctctcttttacagcaacattctttgaaaatgttatctacaatggttccctcaattccttctgtggccttgtctcctgaaaccactccaaccatgctttaattcacctttctccctctaccaaaactgctcaccaatgtctgcaacaaccccaccccactaaattcaatggtctcaattctcagccttcatcttactgatcctgtctgtaacaactgacacagacaatccctcctcctcctccctctccaaaacactttctccccttgcctttcacataccacactctcttggtttttcttctactttattcgtcactcccttcccaatcctttcctcatctttcacaggaatgaggaggaatacctaagctctggaatacatcaaagggctaatccatatacctcttctttatctgagctctccagcactctctattccctcctctattgcatttctctctccaggattttttttaattaattaattttttattattattatactttaagttttagggtacatgtgcacaacgtgcaggttagttacatatgtatacgtgtgttttttttgtttgtttttttgtttttttaaaagacagagtctcaatcactctgtcatccaggctggagtgcagtggcacaaccatggttcactgcagtgtcaacctggtgggctcaaatgatcctcccgcctcagcctcctgagcaaatggactacacacgctcgcccacagcaggctttttttttttttaaagatatggggtctcactatgttgcccagactggtctcaaactcctgaacgcaagtgatcctccttcctcagcctcccaaagtgccaggattacaggtatgagccactgtgcctagcctctctccaagatttaatgctataggacacactgcagagttcatttattattttctttctcttaacaactagaatatttcatagggtaagcacttttgtctgttttgtttagtgttgtatacccagtgactagacagatttagctcgttgcaggaagccaataaatatttgttgaaagaatgaatgaacaacaacaaaagtggtaacaataacagccactttgtacgaggaacttatcaaccagacatcccaataagcatgttacatatatttcattgaaccctcaaacaaccctatgagatctctgaggctttggagaggagtggaagtcagggtggttaacatgcaccaaattaccaaactactaagtggtagtaccatgattcaaacccaaggttatcatcttcaaagataatgctcttaattcctgcacagtaccaattttactggaatattattatctcattagttttggaataaaggcaactgctatttgaagagtcagcaatctaaaattccctacagttgtgaattaatctccatttcctttgtgaagacaaacttttttttagtaatatcaatttaaaaactttagtgaagattcctttttttctcaggcagggtctcactctgtcacccaagcttaagtacagtggcacaaatacagctcaaagcagcctcaaccttatgggttcaagcaatcctgcctcggcctcctgaatagctgggactacaggtgtgcaccaccatgcttaatttttaaatactttgtagagatgaaggtctcactatattttccaggctggtattcaattcctaggctcaagcaatcctcctgccttggcctcccgaagtgttgggattacaggcatgagccactgcacatggccaagattcttttttagggcaaaggattctatactgccattttcagtgataacagtgaaggtgagagggcacactattctccttcaaagtgttaagggcagtacttaaactttcagtctctcccatttctattaaaaagctcaagacagtggttttcaaaactagctgcagagtcaccgaggagctttgtgttttctgaaaacaagattccaacatccaactccagagcaaacagggcccaggaacctagtattttataaagctccccagaagaccttggtggttagccaagtttagaaaacaccaaagttggcaagagactaactctatctgagcatctggctcactgcttgacaatgaccaactctcatctgtaccgaccttcttggaaagaggaacgatgctgttgggtcgaacaagcctccgcttcttacagctcagtacaggacgtgtccgggctgccacacaggtgccatcagatgatgaagagacgagattcagtcgttgcttcttatgtaattgttcctcagcatcagagctgtcacctggaatgtggtctgccaagacaggctgaagactatacaaggggaaggaagagtattctcagaacacacaaagaaacaaaataaataaacaacaagaaaacacaaagaaacaaagcctcttatactagttcaacctctatttgctaatgttcagacacaaagaagcattctagagcagaagcaggtctcctcttgatgtctgttaatctacctgtgtgtgcttatgtgtaaggttcttggtgcacattaactacatcatgtctgaaagataaaagtcaataaataaactcaagttctagtgattgagttctcctctacatcaaacacacgagtaaataaagtctagagaactacagttggttagaaaatgatgaattttgcaaatgttaatgggcttccttagaatcagttctatgaaacccgaattttaagggtgttgtacacatcattcacttgtacagaatctccctgaatcttttgttttctcccttgaatcttcataaatacagatttacaaacatagcccttggagatctaatctgtcctaagcagaggaggttaatataagcacttctgaggaattcctgcaagattaaaacaataataattcacagtaactgtagtgtcttttattttactccatgcccactccattttagtaggtaaaaggaaaatatacaattaattaaaatgcactgcttcattatacagtgaagattaaaaatgttactaagtgataaggcttccgcttctttaaaccagggtcagtcctggctaaagagaactaagagctccaaaacacctttacaagtctactaagtgtaggaagtagaagagctaaaacttacgtgttaataactccattgacaggtctgagtgctccacatgatttggtagacagtgactctgaaatatgaccaataataggggcaccatggttttccaatggctgagaaacagactcaatctgattaagaaaaaggaaaaaagaaattaacatgtacccaagcgcacccctgcctgaaaagcaccaccacttcatttgcacaaagcacctaaaacttctgatgatcaatttgaaaaacacaacttgaatgactgaagaaaaagaaaataagagaatcagtggtcaggtatgatggctcgcaactataattgcagcactttgggaggccaaggcaggaggatcgcttgagaccaggagttttgagaccagcctgggcaacacagcgagacctcatctctaattaaaaagagagagagagaggttgacagagagaaggagaatattatattagcttttgctttggggggaagagggatgaggaatccaaatgtacagactaaaagtaagtacctattgacaggaaaatgacctcaataattctatggaacagaagcttagcaaaacaattacacagtaacataagctttcaactaatgatcaagaaggatatactaacatcagtatcaagatgactaagaggaaatttaaatgtagttaatatctgcttaactctaacagagtatgctagaagcttgttttctaaaaactatgctttgtttaaaaatatacacacaggccggggatggtggctcatgactgtaaccccagtattttgagaggcaaaggtaggaggatctcttgagcccaggggttcaagaccagcctgggcaacatgacaaaaccccatctctacaacaaaaaaatacaaaattagccgggcatggtggtgcgtgcatgtagtcccagctactcaggaggctgaggtgggaggaggatcacctgagccaggaggcagaggctgcagtgagccatgatcatgccactgcactccagcctgggtgacagagtgagaccctgtctcaatgaataaataaataaataaacacacacacacatttttccctgacagaaaacaaagttaataaaatctcaatgaatctaattatctgatgctatcagatactaactattgtctttagagtattcaaatcaaatatgtttagaatataaaatgaaataacagatgagaaagaatagaaaaagtgtgatttgcagtattcaaaacaaattatatatttactaggctcaaaacggataggaacagtatgaatgccagtcatatagcacctctgaggtataggcaataaagcaacagatgcagctatccctcagttctagcaattgttgaactatcccagaaaggctatgggtctttgactccttactttatttttttgagatgaagtctcgctatcccgcccaagctggagtgcagtggcatgatagcagctcaccgtagcctccacctccctggttcaagcgattctcctgctttggcctcctgagtagctgggattacaggcacacactaccatgctcatgtaatttttgtatttttagtagagatggggtttcaccatgttggccaggctgttcttgaacttctgacctcaactgatctgccctcctcggcctcccaaaatgctgggattataggcgtgtgagccaccacacctaacctgtctccttacacttgaactgactctggggcacgctgaagttctctttcctataaaagctttcaaggtaaatattcctataaatgcttcctacaaatgctttcaaggtaaatattttgaggctgaaattctacttttcaatactgatttcttttgtctttatacccccaaggataaaacaccaaaggactgaacctgaaagtagtcctagacaagcatcaaaaagaacagactgaggctgggtgtggtggctcatgcctgtaatcccagcactttgggaggctgaagcaggcagatcacctgaggtcaggagttcgagaccaacctagccaacatggtaaaatcccatttctactaaaaatacaaaattagttgggcatggtggcgcctgtctgtaatcccagctcctccgggaggctgaggcacaagaatcacttgaacccaggaagtggaggttgcagtgagccaaatcacgccactgcactgcagcctgggaaagagagagagagagactgtctccaaaacaaaacaaaacaaaaaacaaacaaaaacaaaaaacagattgggaagataatctaaaagttttaatacaaattatcctaaaatacagatcaaactatatacacagacaagtcatataagtatgctacaatgagtgaacaccgagaaaaggctgtcttttttgttggatatcctgtacatctactaagatatcacaaacatcttgaacaattgtcaatgctatcaaaaattacagtaaatctggcatagacacattgccttaagctctatgcagatttcccttggaaagaaacacggtattaagcagcaagagctataaggatattcctatcttctgacaaaatattctaaccaatttttaaaaatctaccctaaaggagtaactcaacaaacacagccccaaaaatcttattcacaaaggtggtcactgcaatgatatctatcaataatctaaatgttgtaagcattataactatagttatcagttgtggtacaccaaatcaaaatattaaaaagaatcataaaggatatttcttctcttatggaagaagagatttcaagagaaaaaaataatagtttaatatagttgtagtgactaaaaatatacatacacagataacaacaagacaaagagtgttacagttgtaaaactattctgaaattttctttacattttaggtaatagttttatattaaaaagaaacccccataaaaccaaataccctcctgaatgctagtaaggatttactacacaggggaaacctcaaaaaggctaaacaaatatggtatgacaaagaacaagaaaaatcaaaagaatttaagattcaggttggtattaactaacagatgtataacttcaggcatgttataggtattctagatttcagaagttctggtttagatgaaaaagtttcctttcaatagaaaaatgctgtttaaaaatgctgtttgtttttatttcggcattaaattatggcagtgatttgatttatatatggtatatataatttatatggtatatttgatttatatatggtatatataatttatatggtagtgccttcacgtgttctagaaggtactacgtttaagtaacgggttgactgactctccatttgattaagtttttctggtagggattatgagatttaactgcaagaacacttgtcaagataaaatgttgccattctctaacaaagtctcatttcaaaacatttatctttcttatacaaagtctaaagaagaatatgtcaagtaaaatcaccagtaatgtcacgatccatatagctaactactactgctataacagcctgtcttgtttctcatgtctgcaggtgtatatatttaaatgctattcagctttaacatgaatgttattgattttcttatagaaacctgaatcttcctggagtaattcagcccccaaatcaaaattgaagtcaacaggcaacacattattaacatggaaatgttgtcaagaacatagaggtatacagaggtcaagagcataaacatcagaaagggactgtggctggcctgcattcccagccacaaaaaagaaagcactggatactcaggaaggatctacttcagatcttgggaaattctgtaatcaagctagtatccaacagcaggcatttggacatgtcctgcaacccatcatcaatgcaaagagcttaaaatattaatcccaatcacagtgttccatttggaaaaagaaaaacataacacacaaacacatgtaatttcacctagctccttaaatgcaggcactctcccttgagaaaaaatgaacatttcctatcctgcagtctaaaaggctgcaaatgcagaggataaacattaacaaacacttaagaaatattaaatccgcatactaatttcagcttattactactgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggagga

SEQ ID NO: 2309 - DNA, 195390 bp, Homo sapiens
attctgtaacttttttttttatttttttcaatttttccttcttttttttttttaagcactagtctgtgctttgcgaacagaatcaagacattaacaaagatcagcttctctgaagaaaagcatttctatagaacaaagacagctacatgtttcgctgccattacacagctccaaagcaggaaaagaaaatatttacaaaatacaaggttttttttttccattttttgtttttgttttttttttcaatgctaaaagggttattcagaattttcaaccttataaatagaagaagcactttatgcatagggatatggtgcattattgtatttttttttaaagaaacaatgacaaaccctttaacttgcaaacagaaaaaaaaatcactaatgttgaaaattgtgaaaaaaccccaaccattaagcagttgtctactatttttatacgattacaaaatggccaaaaaaaaagagtcttctcccccctccccctttttggtgatgtgatcatacaggagacaggcacaaggttaacagagaagggtgaagggggaacaatgggaaccacagctaggaccagacaatgttccacaggcaaggggagcgtgaaagaccaagagtggaactaacaccgacagggatctggatgtgaaggaaacatggcaaagtgaatcagagggaaaaaaaaaaaaaatcacacagggagatggctgctcacttcccacaacccccagtttgcaggggagtgggaatagaggttaagtagtcctaaccctaccttcaaagatcaggataggtggtaaaaatattccaagtggaaggacgggttgtgggtgtgtacatggcatgggagagcagacagggaagggtaccaaggggcatgaggaggggaacctgagcagccacagccaggttactgcagtgaaagagtcaaaacagagaagaccaaatgcagatgaaacaaaaaatcagtctcttaagttctgggtgagaaaggaaaggtgttctgccagctgagcactcggggagagcagctggcagttatggcagagaggctctggtggggatgttccagcacgaaaaaccaaggggacccagccaggagggccacagcagagccaagccacagatgggaggggagggggtaagagtccagagcaccctgccccattccaccctagctcaagaaggccatgctaaactgtagcccgccaggctgttctgccctgcccacaggtgtgagggagggggtggtcatctaagatcagtaagtccagtgattcaacagtgcagaggatgtgccaggaccaggccagcagggtctcatcctgaacttctgtttgccaacgggaggaagtgctcaggtgtgtgacaagaaaacatggaaacaaaaacaaaacaaaaattaaaacaagaaaaaaaaataccaaagtaggatctaaattccttaagttcactaaaaactgtgaaaatttccggcatatgatgtttgaatatcaaacgcagagatttctgaagctttaatgccaatagttagtgagtctgtttagatggctgtctcccgctcatctgtgagtcgggcgctgagctgtggctgctgccaccagatgccgactcttgagggggacaatgggaggcgaggtgggcgctgcctctgtctcccggccagtcttgctgcctgaggtgcgtcgagtgcagcgggctgctcgctcctgtgcatccagctggtcctcacactccgcctggggactgtgcgccagggggaaggtccgccgctcccagggctggacagactgtaggcagacaagttgctctttgaggacccagtcccagccagcctgcttcctgctccaaggccctgccacaaaccttgtggcctggagcctaggaccagtctatctagtgttcctgcgacagtctgggaacacccctcctagggtatacccagacaactgtattgatcatttagcagtgatcaatacagttccactgaacgttgaggagatcaatttaagtgcagccctttgtcccttcaaaagggggaggggatggctaggtccctcttcagcagatgctgccccttcctggttccatcccccaaccatgccaaccccacccaaaggctgcgtcccttacctgttcatccagccccagctctggtgtggaacaacgggtatcctcactggctaagtgtcgcggagtgtcccgagccacaggggtgaggggtgctgagtgcagttccgggctaatggggctcctaggggactgaccatgggagtattctgacaaagagtggctactgctgacatcaggggaggcaggctggggggtggaggggttggcactgcccagctggggggttgtccggccgtctgatgacctgtaggacctgcacaccaaggaatgcaaatctgagtgcctgggaaatgtttacttatgggggtagagggcatgaaaaaagcatccccactggaggagttgaggcaaacaaacaccaacagattttccttaggatccagcaactcccatttcttcccactattctctggaggggtaggtatacaacatttaccatcccaagaaaaaagcatggctgaacaatgccaggtgagtccatagcaaagtgcctagtgaattcaggaggttagggagattcgtgtagactttgaaaactgtagtcaaagaaaaaaaagtaaaagtaagagctcccaaaactttctacttgagaatcccgagggtttctgccactgttaacaataaatggagacagggtagtgatggacgttaagggggggcagtttcttcaagtggcatcacaaagccactgtccaaaggaaggttaacttgtagcgaggccttccaagctccccgggttgaatcaccatgaccccccaactgtcttccaaatgccacagatcatgggaattcagaattacatagtgacttctcagcaaggatctagcacttggctccttatatctccactagttccatgtatctccactagttccaacaaacaccaaggaaattctgagctatttgccactgccagtagatgagtatgatgagcaaccaagaggcagtagcaattccatggactcaagtagggcccaaactccctgtccaccctctctccacaggccctggggacccaagcctgccccatcacctgctgccccgccgctggggtggcacactcgtggtccacagccaccgtgccctctccatctcctcacatttggcatgcagggcggcgaaggctgcgtcggataggtcctcaatctgcaatagagcagcttcatcgatcccctcttttctccaggagttaagaaccagtcccaccccattctaggttcttcccggtcacgacaggaatacaaggagcttgcacttcacacccacaagtcttcaggccatttagggtgtgtgcactcatatgtatgtgtgcatgtgtacacacgtgttcttctaacagaagaaccaggccattacctcttcattctcctcatcaggactccccttcagagactgaagatcaacctcccgccagctgcaaaaccaagaacagacaatcatgagatggcaagcaggctaaaactgggggcagggtcaaagtgtccatgcaaggatgagaatcctgcacctgtgggtgacactgctctctgccgggtaggctctgccctatcacagctcagtctccctaccctgtcaaggcctgtgaaattggccacctactcaaatgcccaagaaggccagaaatgagagaagcggcctagggtaaggctgaggctgagagactgtgacaaacacaagaaaagaaacctgtttaaagaggaccaccactgttcaggaccagctgattgctcccatatggaaatgcatacccagggttgcctaatcttctgtttggcaacaaaagctggaaacaaagatttttatgtgaaatcctgctttgatgttgacaacaaattcagtattttaaaacatactgtatgtgttgacaaaaccggtctctagaccagtaagtgaatggcctaccaggctgtgactgctggttcgtttggtgtattcctataatggaatgagagagaactatatacagaaataatttcgttcttatcagataagaatttctcttaatgagaagacagaaccaaagactagggcccaactcttggtcagaagagaagagggaaaaagggcaatagcaggaagaatggggagaggagccaactattctgagcttctacctgggcgtaaggatttccttgtattgcagtttctctacgcgagttgttgcagcaacagacattgggatgacaatgttgttaatatcaaatgagctctctccccttctcctccttactggctgctgctgtaagataaaaattaagtttaaaaggaaggtacaattttacagacatcaaatcattcatctaagagttaaagcaggatcaccaataaccaagcatctgggtccttgggttgaagctgagtaatgaccatagcagctgctcccacctaggagtcagtctccaacagcaaaaaacctcacggagaaataccaggtggtcatgaggagttagtcccattcataagtcccactggtcaccctcttccttcaagggctcatgcgtaaatttcataggggtgggtacctgggatcttaactgttggggttcctactctatatacacctctattaacctcctctccttttacaatctttatttccttcctttatccccgtttatgacttaagactcatagtggcccctcccctaaaagcaatgcttgaaagcttatgctgaaagaggcccaaaggataggcccatctcaatacatcatctaaccttggttgtcatgaatgcacctccttctcaaagatctgaactcttcagctaaatctgcacccaccatctgcccagtctttatgtgatttcccctcttttgatgattcttggggaaagagctgagagctttctagctgtatcaaaggagatgaatggagggaaactaaagaggagaacctgactatacctcacattcctggtgaaaggaaatttgcttctataggaaatagttgagaagaccaaactcttggaaaaataagacttccaaggatcgaatatcagaggcagaggtaagcatctacagtagctgggagactagggaactaaatggcttagtctcttggatggaggaagaagtctactagctgctgctgcccagatagttaataccctatcctgaaacagagactagcaactgagctgtgagaggccagaaggaaacagtggcataacaaacacgctgccatggcaacaaaacagctggaaaacacctaagaggctgcatttatacctaaaccaccaagtgtggtcagtccacagggaaggggttggaggagtaagaagtcccctataactaacccctctatcctctgttcctggacggtgagataccctttattcatcctatcatcttaggacattctcagagaatgttaaaagtcagcacttcctgggccagagtttcagtcactgtcatttataacttcagatgaccacaatgcccttttcacttcaatttctttctctatcaaatcagatgactgccattgacctcagaaatttaggatatctggttaaccaaaatggttaaacagacttttggggatcttgcctgagttctgtagctgaggattagtgatctcatacccagagacctctgccactgccagatctgtgctgaaattatacatcccactacaagaaatgcatcttaagaaagcctcaagagagacagccttcccagtatcttggtcaagaataaatgtgaaactgctggcagaaacaggtatacactttccctgaaacttcttgggcttgttgttagtaccttcgagaaaaagatactggagcaggttgtgggatggttcaacgggctcttatctcatcctctgcctagacacaccccctattatgttagctactcattaggtctaaattaactactatctcctatttagagccagagatagagagcaggtgatgagaataaaactggttcccaaacttggttgtatatcagaagcaacattaaggagtattttttaaaaaaaaaaaaaaggttctaggactcccccccgctcttttataaaatcagaattttgtttgtttgtttgtttaagagatgaggtctcactatgttgtccaggctggactcaatctcctgggctgaagagatcttcctgagtagctggagctacaggcatgcaatatcacagccagcaacaaatcagatctttagaagtgtctggttggttggttttgttttttaaagctgctgaggtgattctgatgcagctactggcttttgggaagcactgacaaaaacactcgctctcctccctacctttctccagtgtcctctggcttctttacttgatttcaaggagagctggccctttgtatccatgggttcaaccaattgtggattgaaaatatttgggggaaaaaaattgtgtctgtactgaaaaggtacagatttttcttttcattattctctaaacaatacagcatactatttttatagcatttacattgcattaggtattatcagtaatctggagatgatttaaagtatatgggatttaaagcatacacataggttatatgcaaatactatgctattttatattagggacatgagcaacaatagcttttgctatctatgggaggtcctggaaccaatccccactgcagatactgcagatactgagagcctgctgttatctggcctatcttctttctttttttttttttgagacgaagtcttgctgcgacgcccaggcttgagtgcaatggcttgatctccgctcactggaacctccgcttcccagttcaagtgattctcctgcctcagagtagctggaactataggcacatgccaccacgcccagttaatttttgtatttttagtagggatagggtttcaccttattggccaggatggtctcgaactcctgacctcaagtgatccacccgcctcagccgcctccccaagtgctgggattataggtgagcgccactgtgcctggcctatcttcttttacataaatccagagtctttgaaaaaacttggcaatgagagagcctcaggggttagcatagtgctatacacaaaatttttactcaataaatggtaaaaatttcaagtgatccaggcctaagttaacattctccagacacagaaatattgaagtgctcaccaagtcctgaatctctgagttcagattttctatcagaattagtttagactcttttttataaatactttggttatctgaaaccctttgctgctggataactgagtatgtgagggacactacacacctatttagataaaatttgtgggttacgggggtaaagaaagtcgaagagcaaagagaccatttggaaaagattgatttgtaacagcaaagagagaacaatgtgaattcctacctgatcacaggagcctagtgagtccattttatgagcttggaagtttcctgatctaggctctgaaggaacttcctaagttgcctctgcaataccctcacccaggcttagcctgtgtagtgtaatggtaaaagagctggctctacagtcaggctgcctgagtttgaatcataattataaccctcacaagttgccttgacagttttcatgcatataaaatgaaatccacagtaccaacctacatctcaaaaggcattataacatgtaacacatgtaaatcactgatcactggtatgtagtaagtgttcaataaacattacagttgcagacttttacatttaccattacattacattgtaattattatacaaaaaggaccctttgagtaggtccatagcagctacaggtatgtatgttccaagagggcacacttgaggaattaaaatattagaatgaaattaaaggaaatgtgtctggaatagctgtgcaaactgcttccagatggagtgtggtatcgtaaaatctggtgtgtgcatgccaaatgtcctgccatgggggcctgctggatctgtaattctgctctgtatacctaaaaagcatggactctgccttctcccttcccttctcttctggtaccctcacgcctagtgtttattcttagtacttcacctccactcacccagagagtaaaaccaaggaaatcaaacactgcttccaacgcccatgggaatctcccctctacccacccctcctctcttgttcacttcttgggccaacaggattagggccacggaactgttgagtcctgtgtgaaacttagtccaacagatcttgaatagtcacagatcaccttaagagtttgtccctgcatcaagctttctatggatggctcagcataaatccatctctgctatgaaaaacaactcaagaaaaacaacagaaggtcaagtaccatgactttgacttaaaaatggtacagacatacatacatatgtcatgatgagctgagatcctataaatgccctgggctttataacccaccctcacactgtcctctggagccacttgagtgagctgtgacctgcagagggggtgtccggccaaccccacacaggtacttaccgatgtgctggctgtaacctgtgagctagagctggcgggtgcaggggaatctgaggaggtggagagctgtcgcaccaagggactgtgtggaggatggtgggtggctgccaagtagctcgaactgctcatgtctgtgtgatgcttcaacactgcagaagtcaacagaaaagagagaaatacatggctatcttaaccagcgttacttctaacacaagcttggaatggcagcaatacatactaaaggcaaaaatgttttctatgcctagaggataaaaaggtgaagcacactagctgtgggaagtaggggcagggcagaggttgctgtagcagttaagaagtgacctccatttagaagcagtagcgtccctctactctgctttcctagaaagtgaaggacaaagctgggggtaattaagagaagcctaggctgccccagaaagccctgagcaggtgcagttgcaggtagaggtgccatgggcctggccctaccttcacttctctcagatgaatggtctcgcaatctcattttgctgtggtttgggtcatgcacgggtggtggtgggttgagcaagcgctctgcttttggcgctgtcactcgctccaccatgggcacggcccccacatcgtctaagtgctgcctgtgggtcctgtcaggccgggtttggtgatgggacagctctgaagaggggaacagaaaaagagctgtgaaatatgtcctctcaaatattttcttattcgagttccaagctctcgagttctctctaggccaacgccgtatacccagggcagcaggacagtccttcaggactgaagtttctagtaatttgcacaatggctaggataggcacagggagcccagaaccagagaaacatgtcaccaggatacagaagacacctgcccgtagatgaactcaatgccatgccattgctggctgttcactgagcattttgggtcttgctccaagatccatggtgtctagaatagctcccgaagtccatctgagagcatccaagacaagcagaagcagtcactgtgagctgaattttttatcggtcaactgcctctcccaaccccaacatgcatgcaaactacaaatttgagaatataaaaggaatgaaaagtcactgatactctgggggacttcccggctccctgacacttactggctgttgttaggaaggagctgaccaatttgtgcctgtccttacgagctgaatctggcagactgcccggcatgggtgctctgtgcttaagcgataactttttgggaggtttgattttgtcaaaaggcttgttctgccactgagatttcagcatgctctggaaatgcaggcttgtgggaacatctgcaagaaacataaaatgctacaggttagtccaaacacctggcctctctagtgttcaagacctacactccatcctcctttaatttgcccagtggcctgacacttggcagggcaagtgctgtcatatggaagatctgtttacgtgaacattactgaaggtcattcttctatttgcaagcaggtcactttagctttttactttcaagtcccaaagggaaacaaaacaagacacctttttggtttggttgatggagtttttgttcttgtatccttgtttgttgaatttactggtttgaaaacatcctgtttctattctagagatttaaaaacatatttaagcctacttcttttctatcaatataaagttaatcaggatgcaattattcaacaatattcattatctatgttatcaggcactgtactgagtactacatactctctccaaataagaactacataccattctctctttccttcctctgtggctccgccaattcccatcatgagattatcggggatttttagctgactggttaatgttcaatatcacaaatcaacatcttttggactgaattttttatgctgtttcttatctttccattttcttagatttttcccaagaatatatccttgagcaattcctttagaaaaggaatttctagatttaaaccattttcctctcaaacatttaaagctattcaattcttccgtgtattctaatatccagtgctatatttaagagggaatcggattctttcttacttgtaggtggtctggtttttgccttttaagcttctgcaaaaaacaacaacaaacttgtggtattacactgactctacagatcaatttggggacaacttccatgtgttccaccaccaatactgaatctttcaatcgactgacgtggtatctctctctccatctatttacgtttgtcttgattttctcttgacagcgtttagttattgttgacataccggtcttaaatacaatttgttaagtttattcctaagaattagtgttttctgatgggcagaagttggaagagtttgcagggttcagaagaagacaggaagatgagggaaagtctggaacttcttagagatttgttaaatggttttgaccaaaatactgatagaaatacgggcagtgaaggccaggctgacaaaagtctcagatggaaatgattaaagatagtaccttttaaaatttcaacttcagttcttcattactagtatatagaagtacaataaactgctatataatgaccttgtagcctgtgaaactacttcgttatagactttttcttgtttattcagtaggattttctatagacataagtacatcatctacaaatggagactgttttaccttttctttccaatctgtattccttttttacttcttgcctattactctgactggaacctctggtgctgatgtacaacttttagattttccttttcatgttttcaatattctgacatttcaccaccatggatagcggtgtgagtctgttttcaagcttctgcaaagctttccagggatattcaaatctaaaagccagcacatttttcctcacctcccagttcctcctgggaatcggtaaccacttggggcatgctcagaagttcccgccagagtccctatccactgcttcagaatagaatgaaacaccactacttcaaggaagaaggctctggtggggtgagaggacaggaaaggaaaatctaacctagctattccaaaatgagtccaaatttatcacccagacaaatgcccaggtcctatcactactccttctgccctttaattctgggtcaaaaacctcctgtaatcagttcccacctcacagcaacttactcctggcatgtgctttgggctatctttctatttatttcttcacagttatcttgtctttatccatctttcaaaaataattacaaattccagtcactgatagcatgtcttctagaactattagaaatttattttgtgtgtgtgtgtgtgtgtgtgtgtgtgtgtgtgtatatttttttttttttgagacggagtcttgctgtcgcccaggctggagtgcagtggtaccatctcggctcactgcaagctccgcttcccgggttcatgccattctcctgcctcagcctcctgagtaggtgggactacaggcacccgccacctcgcccggctagttttctgtattttcagtagagacggggtttcactgtgttagccaggatggtctcgatctcgacctcgtgatccacctgcctcggcctcccaaagtgctgggattacaggcgtgagccactgcacccggcctgtttaatatattttctaaaagcttatggggttttgggtcccatagagcacagaggatatgctcaatctgaactgaggataagaaggcagggaagagacgtctaaattaacattactgaacccattattatctgccaggcactgtgtgtttatcatcatgcgtgtgccacttaatctttgtaacagttccatgaggcaaacacaattatgcttattttaaagatagggaacaggtgcagaaaggtacattaactatgtccaaggttacatagtttaatgagtaacaaccaactttcaaactcaagattatacaaccctaaagcccatactcttagacaatataccttgaggctactcactgatccagaggatggagaggattctgtagtaaagtcaattatttctcaaattactcccaagaaatagacagtacaaaatattttccaagccagttctgcagagtaaaagaaatttagccactcctgcctatggtatagatgatgaatttcatgacactgaatgttatgccttcgaggactgaatgttaggccttccaggactggaataaaaatctgagttggggaaaaaaaaaaaaaaaaaaagctaacattctcagggatgatttttcccagtgggtaagcaccctcagctccatgattgctgggctttatgacagtgaaacaaattaggaaaactattaaagttttaatgaaaacataacatttgctacctgtccaagtgtaaaaacacagtctctgaggacagtgctgtcttctcaaacatttttcataatcactcttttccacacttaaaaactcagctataccaaatcctaggaaataaagcattgtctagaagcattcggccctgtaaaacaatctgaaagctgggctgagctggaatgtataaaagaggctcaagaaaggagacgaggtcacttctgcccatcccacaatacccctttgtcagcagaagagttactcccacttggcaaaggctgtgtatgttttgtatatatatgtaatggaactccaaaaaacatagattttattttttccttttattttcccccatcgttctcccaaatctgaaaatgaagccaggaaaaaaaaaagggacagggatatgagagacctggttatagtgaaaacagcaatgactagaaacaagtaggcctggattcaggtcctggttctatctcgagtagaaggagaaagcaagaacaaatcattcagctgggctttagttccacctgtgaaatgaggcagtggggctagatcagggctggcaacattctagcattcattctctaaccctcctgttgtactggaggtacaaacacagctgtctttcctgttgtactggagacctcagattcttcccaaacaatacattaaataactccagacagttactgtcaattcatttgaataggcacaagaaaggacatctatttgttactgctagattatatgactgctatgagtctctcaactctaaaatgtttagtcaatgactcttcaactggaactccactcctaaacccttcccctcaactaaatgctcttaagtgcaagttggcacattgtagaacccaagtcatggaacactaccttgtactctccagttgacgtattaagcggaatcaagagcgattcctctttaaacccagtataaacagtttaaggaactccagctgctagactttgttagaagtttgctgtgttgccttttaattgcttccatgttaagagtgaacaggaacccagttatatcccccagtcagtaaaaaaaaaaaaaaaagatatcttaggaattgctggttgagttcatatactaactagtaagtgataatacctaggttctgtgaagagttaaaaatctaaaatagactggatacgggacctgaaagtaagcaaaaaaagggatatgaaatggaagagaacacaccagagatccattcagctagaggtctcctacattccatacccacataggtaaactgctattttcagagaagagggtgctgatccttatcaggtaaataacaggaaaataagacgaattactaatgtcatccttaagttactgtttcctcaaacaaaatgaaagatgaatgagaagaccctgacttcaggatgactagggtctgacattccacgattcacctggctgtctggctccttactttccaccattttctcaggcgcactttttccgggtgttttgtaatgctcacttcttcctcctgctgggaagttgctgtagcctcatgtgcagggtttggcaagctctctcaaaataccacagatcttcatggccagcaggtggtgctcttattaagccccttttataaagttaacaagcttttctccaaggttatatatcctctacatttccaactaaggattaactggatttgattacttgaggtgataaaacaaagcccccttcctgctggaatactaacaggttattataccctagtctctccaccttccacagccaggcgtagagttggctataacacagtccctcaatttctatcacccacacacacttaatgagaggggctgaggtacagtcaaggtgcgaggcacaactccaggatgaaaagcagcagttggttgttattctaacaaactacacaaactggttaggaaacagcactaaaactacttaaaaaaatatctgtcctatggggccagaaaacagctaagtatcacattcaaacaattttctgcctttatgtctggtataaatgtaactatatggaatcaatgaatcaaaatcatttttaaccttgttatgaaaaaaaaaaaagttggaaatcctgccactttaaaacatcttctagagaagaggttgtaagggtggcccagtagtaaaatctaccacacaaatgtttgacctacacagtcgtatgccaagctgctagccttcactgttatttactgctatacaatgatgtacagggaatcccaagacttcagggggtgtgttatttacacgggatattatgtgaatggtgccctttggagttggctatctctgcacccatgggaatcttctgatttccaaatggactgcattctgaatgtggcagttgtttgggtcaaagcaaaattattccaacaggaataatattagacatggtaatcaggtcttcaggtcaaccaactgaggtgtaattaatctacaggcaaatacagtagttaatagagcctacatgtaaaaatatatatatatctccacagtctcataaggagaatttaatgaccaactttttcgtccaaaccccagggccatagctagaagctcttcgtgtgtgtgtgagacatagacagaaaaacaaataggattagatgcaggaaaataaaaaccataaagaccagaaaagggggagtgttccctatctttctttccattccccctcattgctgcctgtagttgctctgaatgatggtgtgggaggtgtaaggtatgcggcagggcagcattcatgtcagatctatagtgtcctgcagtcagcaggacagaaaatgttcaagggaaatggaacctcttagtagagatgctgaatgatggaacaggagctgagagacacacagtctgggtatatctgagggtgggggaggttatttgcaactgtatgtggtaatgctgttgacaaagaaatgactgttctgtttagcaggtgatatccaatgagtgtgcttaagtgtccgggcttcctgtccttcttcaagtatgagactatacaattcaacacagtaattcagagagtaacccaacaaacattcctaagtcttcctagtggcgctgtctgtagccagaatcccaaaaagggtaaaaatctgactcctcttaataatctgtctggaaaggaacttgaaatatagtaaaaggaaggacaggcatcagataatctgggtctgaactgtgaaggcattcaaacccattagccatttagttttagataagccacaaccttaccaagcctgttccttgagcactaacactgaagtaacaccttacaaaatttctgggccgggcatggtggctcatgcctataatcccagcactttaggaagccaagatgggtagatcgcttgggcccaagagtttgagaccagcatgggcaacacggggaaacctcttctctactaaaaatgcaaaaaattagccaggcatggtggtgtgcacctgtagtcccagctacccactgaagtgggagaatcacctgatcctgggaggccgatgctgcaatgagccaaaaaccacaccactgcattctagcctgagtgacagagtgagactctgtcaaaaaaaaaaaaaaaaaaaaaaaaaaaaaaagccaggtgcggtggctcatgcttgtaatcccagcactttgggaggccaagacgggtggatcacgaggtcaggagttcaagaccctcctggccaatatggtgaaacccccatctctactaaaagtacaaaaattagccgggcgtggtggcgcgtgcctgtagtcccagctactcaggaggctgaggcaggagaattgcttgaacttgggaggcggaggttgcagtgacccgagattgcacgactgcactccagcctgggtgacagagcaaaactgtctcaaaagtaaaaaaaaaaaaaaaaaagaattttgaaagcagcatatgagacaaatatgagaagagtactacaaactttaaaatgctatacaaatagtaactgcagttacatgggctacataaatccaatggcaagggaaggtaaaagtcagtgactctggaatctgaagcacagaggaaaatgttttagtgttttccactcattgtgttcaagtttatttattgctccaccagctcctgactatccatgtgttccaggttttctgtttcctttctcttacaagaaatcacatggccacaggaatattacaccacatccttatcacagctagggggttttggtaacaaaagccaaaaatcccggtatctactggatttaggtggccagaaatgcaatcatttgaagaacagatgcagaacaggggattatagttatctaatatttgatcaactgtcaattagaaggattctctctaggacaagggttagcaatgattgtttttataaataaacttttgttgcaacacaatcaggttcatttgttcacatattgtctatggctgcttttgtgctacaatgacagggttgagcagttgtgacatgaactgacatcaattatatggcctgcaaagcctaagatatttaccatatggcccttgaagaaaaagttcaggccgggcgtggtggtttacacctgtaatcccagcactttgagaggccaagatgggtggatcacttgagctcagttcaaaaccagcctgggcaatatagcaagaccccatctttgtagggggcgggaggcggggaagcaggttgtggtggtgcacacttgtagtcccagatacttaggaggctgaagtgggaggactgtttagagcccaggaagtcaaggttgcagtgagctgtgatcactccactgaactccagcttagggcaccgagcaagaccctgtatctaaaaaataaaaattaaaaaaaaaaaaaaaaaaaaaaaaaaacttacagactacctgggagatattatgaagaacagcatggagcccttatcctcagggagattacatcccatcccttccccactccccccgccaccaagacagggtctcactaccgttccccaggctgcagtgcattggctcaatcatggctcactgcggccaagacttcctgggctcagctgatcctcccacctcagcctgctgagtagctgggacgacaggcgtgtgccaccacgcccagttaattcttgtgtttttagtagagatagggttttgccatgttgcccatgctggtctcaaacttctgacctcagatgatgaacccgccacggcctccaaaagtgccaggattacaggtgtgagccactgtgcctggtccctaaaatttaaataacagaaagcaaatacacaaacagccataacataattcattaacatattgataaaacacaatagggtaggtgcagtggctcctgactgtaatcccagcactttagggaggccgaggcgggtggatcacctgaggtcaggagttggagaccagcctggccaacatggtaaaaccccatctctactaaaaatacaaaaaaattagccaggcgtggtggcatacgactgtagtcccagctacttgggaggctgagacaaaactgcttgaacccaggaggtgggggctgcagtgagccaacatcacaccactgcactacagcctgggcaacaaaagcgagactctgtctcaaaacaaaacaacaacaaaaacaaaaacccaccagtgatttgagaggaaattcctaccttctgtaggctgggcacagatcatgagattacgtgaaaattcaatgaaaccaatccagattatgaaagcgctggcttccatctagaatagtggtttcaaaatgtctttgctcatgcacccccatttgatatgtgatttttaaaaaatcataatttcagatagttgtaaagattatatttgaatactacataatgctttaaaaacatttttatcaaaactttggcatgtaaatatatttagcttcattaattgaaaaaaaaaacttcttttaaacttatttagctaatcagactttagatattaactcagtatttattctaagacagacaaggaataggaccatgtaactgagctcagacccatcccagccactcgaagagttagagggaaatctcttagttgcaatcttttagtggtaccctctggtttggtagatctgttgcagtctttttggagaattctaagagaagacttggttgataggagttcctgagttatctctattttatttttaaaattcaaaacttttttgcttaatacctgggagattctccttcaggtgctgagaactcttagaaatgatctctttatttgttgtccccaccatccaagacctttttttttttttttttttttttttgagacagtcttgctctgtcgcccgagctggagtgcagtggcatgatcttgactcactgcgacctctggcctccaggttcaagcgattctcctcccaaataactgggattacagacatatgccaccacgccctgctaatttttgtatttttagtagagaaggggtttcaccatgttggccaggctggtctcgaactcctgatctcatgatccgcccgtcttggcctcccaaagtgctgggattacaagcgtgagccaccacacctggtctcgaactcctgacctcaagtgatctgcctgccttggtctcccaaagtgacgggattaaagacgtgggccacgacaccgagcctcaagatttttacactctggggcaagacccatagtgggactcaatatggccaaaaggaatgctcttcttttgtcaagtgggagaggtacaggtatgggaagggaggtgggaaaggagggctgtcagacacagagatttaacagggaggcaaactttagaaagacagtacaagctaacaacgaagatttgtgcttatctacaccctgcaaagctgtcgcgttaccacataaatgccagtatgaagatattctcctagaacactgccgtccatcctacattatatcatggcacgcacagacaaaacttttttttttttttgagacagagtcttgctctgttatccaggctagagtgcaatggtgcaatcttggctcactgcaacctctgcctcccaggttcaagcaattctcctgccttagcctcccaagtagctgggattacagacaggcacaaccacgactggctaattttttatatttagtagagacggtggtttcaccatgttggtcaggctggtctagaactcctgacctcaggtgatccgtccacctcagcctcccaaagtgctgggattacaggcgtgacccaccacgcctggcccagacaaaacatttttaaagatatactaagcgtattttggaccagattactgtggctagaggcaactgagcccagatccctcctagctacttgaagagttagaaggaaatctcatattaagttgcaaccttttagtggcaccttctggtttggtggatctgttacagtctttttgcaaaattctaagagaagacttggttgacgaaagttgtaccttgaaagtatctgagttgtaactgcaccttggctgattttctttcacctagaagtctctcaagtttctttcattagactttctagtctgtggtctttcttaccatctggaaatgctagaacaggatgaacacaagagtccaactgggaaagacgttccaacagaggggcttcatagtgaatttcgggaggcatggtgttgatgctgcctgaaccacacagtgcgcaggagggattcacatcacagccagggcggattgtgctgttccggtgaacctgtgaaaaaagccaaacaaaactgacaattcagcatctgataaaaagccagctacccatttgttatccccatttgttattgagaagttagctccccatttgttattgcgaagacctttctagatacttgtgtgacactactaaaaggatgtttgattagtttgttaaaagatttccatttgtctaacacactgaccttcaaagtgggtaaggaaacttgcttccttttcattgatgaaatctaactacttgaagctctaagtgcttacctaggtatcaaacttctgacagtttaaaaagatactaaaactgtgctttctgagaacactttataaactctgcatgctttcacgaccttgatggtccgctaagacgaacagttggttcttgattcccaggtgggacattacttgctttcttcagcaaatttatccacctaggagccttcaattaccaaccacacctcttctcttcttttcacacctcttcttcaaaagactttcaggtggtctcaagccaggtggcaagcttccctgaagcttgtaacttaaaagtaacttattaactactctttaacctggcctaaaatccactgttacaaagctcatacctaagtaataaaataacattttgtacagcaaatgctcactttcatagtcttcatgttagattaattccaaagggtagaaattatttccactgaacttcctttgtgcacatgtgggcagaataattgataacctctccaggtaagtccaaagttaaatatgaactaatttaagtcttcaaaagattgaattctgtataaaaactgaacatctacaattttatactttgagcaaatttcaggtcatgctgaatgcaggatccctacattctagtgttaggatgaacaagtctggcatttgccaaagcctaactcataaagtcacctggacacacagccccagaaaaagaaacttgcatgttgaatggcactataagaaggcatcctaggtgcaagctcagtagtagaacaaagacaaaaagcatcaaaactctactagcaaaaactctaacatttactagagctccatttattttcagcagagacatctcgaaagccttttatggatttgtgtaagagaaagatatacataagaacaatgtggtctttatcaacattcccccgacattctattgtaaccacatagagaggtggcacgcaaataaagtcttttaaaggttagactgggcaaatcacacagaactagaagccactgaaagggagtgataccaactaggcatgctacttttgtgtagacaatattaactggtattgttttgggaaaaaaaaaatccctgtatctatgtaatcagagctggctttctggagaggatgacattttgaggtaaagagaaatgagtaggtagagatgaaaatgagatcacacagtgggtgagtgggaggatttaggaaaattggttaggatccaaaaattacactgaaactttcaatattcaaaagagattatctcactccagtaggtatagcaaataaaaaataaaaagagagagactagaaaccaacccatgacatcaactagctctccatatgggacatttaacaacactacattttatggctagagtgtatcacttaagtcaaagtcaatattgggaggccaaggcgggtggatcacttgaggtcaggagtttgagactagcctggccaacatggtgaaaccccgactctactgaaaatagaaacgtcagctgggtgtggtggtgggagcctgtaatctcagctactcgggaggctgaggcaggagaatcgcttgaatctgggaggcagaggttgcagtgagctgagatcacaccactgcactccagcctgggcgacagaatgagactaagtccaaagacaagcaaacaaacaaaaaaacaaaacaacaacaataaaaaaattcaatagatgtggctaggcgtggtggctcacaactgtaatcccaaaactttgaggtgggagagaggattgcttgaagccaggagtctgagactagcctgggcaacacagtaagactccatctcttaaaataaaatttaaaattaaaaaaaaaaaaaaaaaaaaaatttagcccagcatggtattgcatgcctttagtcccagctactcaggaggctgagggagaagaatcgcttaagcccaggagttcaggttatagtgagccatgattgcaccactgcactgcagcctgggaaaaagagtaagatcctgtctccaaaaaaaaaaaaaaaaaaaaaaaaggctgcgcatggtggctcacgcctgtaatcccagtactttgggaggccaaggtgggtggataacctgaggtcaggagttcgagaccagcctggccaacatggtgaaaccccgtctctactaaaaatacaaaaaactgggcatggtggtgggcacctgtaatcccagctactggagaggctggtaagagaatcacttgaacctgggaggcagaggttgcagtgagctgagattgcaccactgcactccagcctggggaacaagagcaaaactccgtctccaaaaaaatttaaaaatttaaaaaaataaaataaagggtagaaattctacttataacttgacaaaagggtaatgtgcacacatgtaacttaaacagtaatctcacttttaaattaaaaactgtaaagtactaatagaacccgaggagtatataaaaatatatttaatacttattttttttttgagacagagtcttgctctgtcacccaggctggagtgcagtggcgcaagtctgccttccaggttcacaccattctcctgcctcagcctctcaagtagctgggactacaggcgcccaccaccacacccagctaatatttttgtatttttttagtagagacagggtttcaccattgttagccaggatggtcttgatctcctgacctcgtgatctgcccgcctcggcctcccaaatgctgggattataggcatgagccaccgcacccggccaaagatatatttaatacttattaaaggatacattttggaaaatttttgaaagaaaacttgaattcatacccatgttgcacaaatccacaccaagaatctatcctgcagacaaacttaagtgtacacacgcacacgctcttccactgaaacaagatgccaaatcatctgcatgaattcatttaagttaaaaaacaacaagaacacacacaatattgtgttttacaataagaaaacaaatttttaaaaatatcacaacagatggtgtgcacgtgtagccctagctatttgggaggctgaggtggctcacttgagcccaggagtgaggagctatagtgatcatgtccactgcactccaggcctgggagacagagtgagtcagtctcttaaaagaaaaaaaaaacaaggatctcctgggctcaagagattcttctgccttagcctaccaagtagctgggattgcaggcatgcaccaccacgcccagctaatcttttatatttttagtagagacggggtttcaccacgttggccaggctggtctcaaactcctgacctcagatgatccacccgtatcagcttcccaaagtgctgggattacaggcgtgagccatcgcgaccggtcccagtcatgaaatcctattggcagaatccaaccacttcataccacctcaactacactcaatctagtccaagtcactatcttttctcaaatgggtttcttcaagcctcctaactgatcctcctcctactggttcttacttccaaatcaatcaacacagtaatcagtgtaaatcttgttttaaaatctcaatcacatcataccaacctcataatcttccaaatgacttctcatctcacgaggaatagaaaccaaacttcttgcatggttcccacaaggtcctatagtatttgtcgcctctatcccctctctctgacttcacctcatttttttgttactctcctagctgacactaccagttactctgatttccttgctatatttctccaagatagcaggcaaccttccagatcacaggcctctgcacttggctcttcaaccactaattccatggtcattctctcacatcgtgtctttttctttaaatgtcagtattcaaagtaactttttttttttttttgagatggagtctcgctgtcgcccaggctggagtgcagtggtgggatctcagctcactgcaagctacgcctcctagcttcatgccattctcctatctcagcctcccgagtagctgggactataggcgcccgccacaacacctgactaatgtttgtattttttgtagagacagggtttcacggtgttagccaggatggtctcgatctcctgacctcgtgatccgcctgcctcagcttcccaaagtgctgggattacagacgtgagccaccgtgtccggcccaaagtaagttttatttagaaatacaagtgaaaggccaggcgcggtggctcacgcctgtattcccagcactttgggaagccaaggcaggtggatcacctgaggttaggagttcaagaccagcctgaccaacatggtgaaacctcatctctactaaaaatacaaaaaattagccgggcatggtggcgggcgcctgtaatcccagctactcgggaggctgaggcagaagaatcgcttgaacccaggaggcagacgttacagtgagctgagatcgcaccactgcactccagcctgggcgacaagagcaaaactccctctcaaaaaaaaaaaaaagtgaaaaaagattatattcttgactgtaacaacaaaaaatgccctggaataagtttaacaagaaatttaagcacaaagcttaaagatattgatattctacaaattaatgcagaatcttaatagacttgaggggggaggggagacaaggcaaaggggatttaaacaaataatctaaaagatacaactgaaagaatgtaaggaaccattccccaaaatttctgataagcaaaaatacaggggagtgatctggcctattacatgttttatagttacagtaattaaaataatctgccctcggttaagaaacagaaaatttaaataaaaacaaaaattgaccaaagtatatatgacagtttattgtttaactaaaataatacttttaaatcagtttaaaaaaacaaaaggaggtattactttttcaacaaatgaatcaggaaaaccaagaggtcatacagaagaaaacggctgcatttctgcctcacaccaaaattaattctaaataaagatttattcattttcattttattttatttttttgatacagagtctcgctctgttgcccaggctagagtgcaatggtgcgatctcggctcactgcaacctccatctccgggttcaagtgattctcctgccttagcctcccaagtaggtgggattacaggcacccaccaccaagcctggctaatttctgtatttttagtagagacgggggtttcgccatgctggcaaggttggtctcaaactcctgacctcaggtaatccacccaccttggcctcccaaagtgctagaataacaagtgtgagccaccgtgcctggccccaaataaagatttaaatataaaaacaaatattatactcaaatctaaaaaaaaaaaaattgtgaagcaatatatagtggttaacagtatgagctgtggagccagactgcctgggtttgaaccttgactccgccacttactagctgtgtggccttaagacaagttactgtgtcttcatctttactaacaggagagtacctgatagagttgttttaaagataaataactcacaacagtatctggctctcgactcttaatcacttttgtaaaaccgtaagtatagctactgatagaacatttaccatcaaacttgatagaacatttaccatcaaagatcttgatttcaaaattctagcttcttaacactgtataatatgatcattgataagtcacatgacatccttaaattttctcacttgttaaaaaggactaataataccaatttcatgggagtgtaggaaagatcaaatgactctgtaactgttaaaacattacacaaatgttagctaaattagtataccgcatgatttctcaacagctggcacttctttgttgtggggcacagtcctgtgcactgtagatatctagcagcatctctgtcctcatggtgcatgtgcctccctactcccccaatttgtgaaaatgagtaattactacagatattgccaaatgtctcctgtgaggacaaaatcactgagaaccatgaggttcaaattacggtcatcccgtctagaaaaattcaaagcacaggctcccattaaatattagtggtgagtcacagtaaacataagactcagtaaaaaaggaaaacaaaaaaaataaaaattaatagtaagaacaaagctctcaaagactattgtcaagaacaagcctgaagagagcttcccctaccaaagatcagataacgttagcatcataaagaaaagactacaatggcttgaaatacctcaaatatgtttcaatcaatgactcacagccccttcatgaaaaacttcagtgactgtccttagaggatagtagaaaactaatttgttattttgaaaattggtaaataaaaaaaaacaacaaatcatgctttcttctgtacaaactgtacctcagggtaaacaaatagttgaaaaggacaattttccctttataaacatattctatctagctaataaaagaaaaacagaaatgatacaagtagaatatcaccattcttcagcttccaatttaacaatgggtccaggcaatgatcaccagtggttgataacaaacagtttagtcattacgtgtcttctgatacaagcataaggcggccaccttgtgttttctcacgaaactaaaactggacttattcacgtttctactagttttcaagaaaaacaagggacagaaaaacatcactgttttttaaatgcactaaaaataagatggattaataaatggaaggatgattgtatgctaaaatgttagtggtagaacctagggagtagctacataggtgttcactgtaaaattcattcaacttcgtatctgaataatttcataacaaaatttggaaaagaaaacagtgacaccacaggacttctgcttctagcagagtaatagtgatcagatttacctttcagtcataaaccagaaaactggacaacaggcagtataacactgagaaataaatggggtggtctctaagactgccctggttttccgtctggaagtacattctagactgcagggcagggagaggatctgaagcagagtataatagcttcactgagttgaggaagcaaattctcactagatcagaattcagagactaaggaaactgaaaattgcaaggcaaaattcttgagaggaggaagctttacagaaaaagagccccagaaatcttcataagatccccctgagtgtttgctaaatattaaaaggtgcatgtaaagggtgaaactatcaggccaggcaagagcaactaggcagctgtgagctgaaatggtttccacagctaacacaagcctgagaggcttttaaactgtgaccagccaaagttgcatagagaattcaagacagaagatcctgctttagttgtggagctagactactaaggtggccaactcctcacctgacctaacaaatgacaaggaatttacctgccagcaaaacaaagcctctttaaaggaagatggcacaatccacatgctacaagcagggaaaattattaattggattttcagcttaaaacataaataaaacattgttagatatgccaagaggcaagaaaatactactatagggataaaatttttaaaagaaagtaggctgtgggaaactaaggtatcagataaatgaagttttctcaacaaataaatcacctatatggatagtttgtatcaaaccaacactctcactaattggaaaagccagatttaaaacacacacacacacacacacactctctctctctctctctctctctctctctctcaaaacataagaaaaatgctgacataatgacaatattgaaagctaagattccagagaggaaaagaacctggccaacatggcgaaaacccatctctactaaaaacacaaaaattagctaggcatggtggcacgtgtctgtaatctcagctacttgctgaggcaggagaatcgcttgaacctgggagatggaggtttcagtgagccaaggatgtgccactgcactccagcctgggcaacagagcgagactccatctcggaaaaaaaaaaaaagaaagaaagaaaaaaaaaagagcagagcttttggtactcttgtagggctgaatggataacactagagacttgaaatgtcaaattatcaataaaaagaggacagggaactaagcatgacacacttccaagtaccaccctcccaaagaaatagctgaagttgtgaatggtaggaggctacaaagctaagtggaaagtctctgaaaagggcagagatgtttctggcagtctcgtgaggagactagaattagatctcaggatatgctaagaggaaaggaggctgggcacagtggctcacacctgtaatcccagcactttgggaggctgaggcgggcagaccacctaaggtcaggagttcgaaaccagcttggccaacatggtgaaaccccgtctctactaaaaatacaaaaattagctgggcatggtagcacgcgcctgtagtcccagctacttggaaggctgaggcaggaaggagaatcatatgaacccgggaggcagacgttgcagtgagccaagatcatgccattgcacttcagcctgggtgacagagcgaggcgaggctctgactccaaaaaaaaaaaaaaaaaaaagagagagagagagagagagagagagagaaaaggaaactgatcaacacatgttctcagctggaactaagagagagaaacagactgttatctttttgagacagagtctagctctgctgcccagactggagtgcagtagcttgatcttgactcactgcaacctctgcctcccagcttcaaaccattcacctgcctcagccacctgtgtagctgccaccacagctggcttttttatttttgagatgaagagattgcaccactgcactccagcctggcgacagagcgagactccatcttgggggaggggagggggacaaaaaacaaacaacaacaacaaaaaatcagcctgtgcaacacagtgagacctgcatctcaataaaataatgagataaaatacttgatacacgaagaaattcccacgttcccttaattaatactgcaatgctatcaattctctttgaaggaattcccaagaaatactcaatttaatacttatgaaggaattaataccaaagtaaaactctattcaccattttctgttaatcatagcatattcgtccaaaacactaaaagaattcttttggctcaaggacaggttataatcatttgcttttgctttgcatttgatattcgttatctaactcatccactgttaacatgtggaaagattttcaaaggtttggcaactctatcacaatcaagcatatcccacaactggctcttgaagatccatcagagtgaagaaacaaaacgtgtaagcttctattttatctcagtctttcaaaatttattttgtatgtgttttataatgtatatataaaacaccgtcataacagtttagaggtaactgttccaagcacagagtgatttctgagtattcttttagtagctttatgtcctaaggtacaattttctacatggcatgcttgctcctttccaaatgtctaactagtatgaaaaagttggttgggcctccaaggtctattgcactctgtcaaggaagaacgtatcaaattattaacttttaatactgactcatattctagttcattagtcctcaaccatggtgtcatgaaactggatttaaataggtggaatcaaaactaggaggcctagaatcatatattaacacctttatttaccctgatgtctacaggaaacctggtcatagccatgagagaatgccctgtacaaaaatgtcactcttcaagtgtgatacaatgggaagaagaggaggactactcggaattctatggaagccagctttaaaatttggcccagagcaatcccccctatgacaacaaggactacaaaattctaaaatgatgccagtacactgccaatttgttaggaaattgctactttttaaaaaattgaaagaaatgctattaagggcaataaaaatttcaagggtatgttagtaataaatgtagccattacctattctactggttattagtacaaaaaaacccagccttttcaaccattcatttccaaacactgatggtttccactgccagactatacacaagtttctaatggtccacagtaaattgagaatgagaacaatgcagtaaattattaataaaactacattcttttcttttttaaaaaaatactatttgtcttatggtttaattataaacataattttacttaaaaaataaaaagcaaccttatttgaaaattggctggtaccaattttattttaataactttattgatctgaaatcttagtacgtttaggttaagttataaacacctacttcacttaggcactgggccaggaaaagaacataatggcatataagaactttccactggagtgcttcttcattcacttagataattactaacatccaccatactagacccctaaagtgatgaaacacacaataaatagcaatataggctattcagtaattacaactagtaattccgtcattttataataaaattatgatttaggaagtactccatgttctccatgagccttactctgatattcacttaccacaccctagtggttattccttagattacatttaaaatattccacattcagagttgtagaggccttagactattatctcctccaggattactactgttagtctgtctttccacctccagtctcttgtgccaatccatcccaaacataatagttacagattggccgggcgcggtggctcacgcctgtaatcccagcactttgggaggccaaggcggatggatcagctgaagtcaggagttcgagaccagcctggccaacatggtgaaaccttgtctctactaaaaatacaaatattagccaggcgtcgtcgtgggtgcctgtgatcccagctactcaggaggctgaggcaggaaaattgcttgaacccgggaggcggaggctgcagtgagctgagattgtgccattgcactccagcctgggtgacagatcaagactccgactcaaaaaaaaaaaaaaaaacaaacaaacaaaaaaaaaaaaaaaaacatgttacagcagatttacctcccccaaaatagcttacaacacttctctgctcaaaaatttaaaacttatagactgaaacccaaatcatcagtttgggcattcaaggcttcctatttatttactgatagatctcatttctctttattcccaacgagtttaacttactgaacactttgttttagtcattgattttaagaagtacaagtgatataacaacagctttttttttttttttttttttttttagatggactctcactctctcaccaggctggagtgctgtggcgagatctcagctcactgcaacctctgacttcttggttcaagcgattctccagccccagcctctcgagtagctgggattacaggcacgtgccaccacgcccagctaatttttgtatttttagtagagatggggtttcatcatgttggccagggtggtcttgatctcctgacctcatgatctgccccaccttggcctcccaaagtgctgggattacaggcatgagccactgtgcctggccagcctttttaagggcaaaagagttactgcactaaacgtgcatctcaattttaagatatattccagccataattcaactaagctgatagccctttaaaaacacagtaattgggctgggtgtggtggctcacgcctgtaatcccagcactttgggaggccgaggcgggtggatcacttgaggtcaggagttcgagaccagtctggccaacacggtgaaacctcatctctactaaaaatacaaaaaatagctgggcgtggtggcgtatgcctgtaaccccagctactcgggagaatgaggcaggagaatcgcttgaacccgggaggaggaggttgcagtgagccgagatcgcaccattgcactccagcctgagcaacagagcaagactccatctcaaagaaaaaacaaaacaaaacaaaacctcaatgagttccctcaagtatgttttatttggttctggaatgcagtagagatcatttaagatgcaggtaaggaaaaaatattaatcacttgctttgtgtgttctgtactctgtactcacaataactgtgaactcactgtcatgtaacaatattagaacataatttacctgttaacttctttgctgtcattagaaagtaagctccatgaagataagggctttgttttccttaccaatgcaacctggctgccctgaataatacggtgggcattcaaaaatgctgttgaataaatctgtctggaaaaccgagcaattcaagatgacagaagacaagatgcttgctcatcagcaaataccactgaggtcatgtcatgagtgaggagccatgtgagacacagaaagcaacctagacagaaggaatggggtgtgtctctaactctggaagaactccagctttctgctagatctagtacatggtatatttcccaaagtcaactaatttctctgtcttatttttcatgcagcttacttttgtgtcaggatgattctgttttagaaagtggcattggaacaaaaggatatttagttttatgcctatctcttgcctaagctaccttttataattttatatgtacattcaaaactacattcgttcttaggcatggatcagaagaaggttggctacttcacatattaaaaaacaaaatccaggaggccaccacatacttcagaaaatttttatacgactcctgatgtcatgccatagtggctggtaaactgccaaaacagaggaagggtgctttattttcatgaggtggcggttttttttttttttttaaaatgtaaaagcattctgtgttaaattcatcaaggaattgacaaaaagctattttcctacacttgacagtaatatactgttttctgacattcctgttatcaactcctctgaaaatcttttagagatatacgactattagtaaaaaaaaaaaaaaaaaaacaaaaaaaaaactgagactgaaatgtcaatatgaaaaccctgccaaataccttattcttatctatttctgctattttgatatttcaggtagagtccgaggaatagacaggaagaaatggtatcgcctgacagtcaattctacaattcttttctttaaagagaacatggcaaacttacacagtacaactgcatactagaataaaacaaggaaagtactgaaaattcaccatgcaaatactaattgttccagcaattctctcatctcccttatttgtcattagcaaatatgttgctagtggctctcttaagaaaaattcccattctctgctctcttttacagcaacattctttgaaaatgttatctacaatggttccctcaattccttctgtggccttgtctcctgaaaccactccaaccatgctttaattcacctttctccctctaccaaaactgctcaccaatgtctgcaacaaccccaccccactaaattcaatggtctcaattctcagccttcatcttactgatcctgtctgtaacaactgacacagacaatccctcctcctcctccctctccaaaacactttctccccttgcctttcacataccacactctcttggtttttcttctactttattcgtcactcccttcccaatcctttcctcatctttcacaggaatgaggaggaatacctaagctctggaatacatcaaagggctaatccatatacctcttctttatctgagctctccagcactctctattccctcctctattgcatttctctctccaggattttttttaattaattaattttttattattattatactttaagttttagggtacatgtgcacaacgtgcaggttagttacatatgtatacgtgtgttttttttgtttgtttttttgtttttttaaaagacagagtctcaatcactctgtcatccaggctggagtgcagtggcacaaccatggttcactgcagtgtcaacctggtgggctcaaatgatcctcccgcctcagcctcctgagcaaatggactacacacgctcgcccacagcaggctttttttttttttaaagatatggggtctcactatgttgcccagactggtctcaaactcctgaacgcaagtgatcctccttcctcagcctcccaaagtgccaggattacaggtatgagccactgtgcctagcctctctccaagatttaatgctataggacacactgcagagttcatttattattttctttctcttaacaactagaatatttcatagggtaagcacttttgtctgttttgtttagtgttgtatacccagtgactagacagatttagctcgttgcaggaagccaataaatatttgttgaaagaatgaatgaacaacaacaaaagtggtaacaataacagccactttgtacgaggaacttatcaaccagacatcccaataagcatgttacatatatttcattgaaccctcaaacaaccctatgagatctctgaggctttggagaggagtggaagtcagggtggttaacatgcaccaaattaccaaactactaagtggtagtaccatgattcaaacccaaggttatcatcttcaaagataatgctcttaattcctgcacagtaccaattttactggaatattattatctcattagttttggaataaaggcaactgctatttgaagagtcagcaatctaaaattccctacagttgtgaattaatctccatttcctttgtgaagacaaacttttttttagtaatatcaatttaaaaactttagtgaagattcctttttttctcaggcagggtctcactctgtcacccaagcttaagtacagtggcacaaatacagctcaaagcagcctcaaccttatgggttcaagcaatcctgcctcggcctcctgaatagctgggactacaggtgtgcaccaccatgcttaatttttaaatactttgtagagatgaaggtctcactatattttccaggctggtattcaattcctaggctcaagcaatcctcctgccttggcctcccgaagtgttgggattacaggcatgagccactgcacatggccaagattcttttttagggcaaaggattctatactgccattttcagtgataacagtgaaggtgagagggcacactattctccttcaaagtgttaagggcagtacttaaactttcagtctctcccatttctattaaaaagctcaagacagtggttttcaaaactagctgcagagtcaccgaggagctttgtgttttctgaaaacaagattccaacatccaactccagagcaaacagggcccaggaacctagtattttataaagctccccagaagaccttggtggttagccaagtttagaaaacaccaaagttggcaagagactaactctatctgagcatctggctcactgcttgacaatgaccaactctcatctgtaccgaccttcttggaaagaggaacgatgctgttgggtcgaacaagcctccgcttcttacagctcagtacaggacgtgtccgggctgccacacaggtgccatcagatgatgaagagacgagattcagtcgttgcttcttatgtaattgttcctcagcatcagagctgtcacctggaatgtggtctgccaagacaggctgaagactatacaaggggaaggaagagtattctcagaacacacaaagaaacaaaataaataaacaacaagaaaacacaaagaaacaaagcctcttatactagttcaacctctatttgctaatgttcagacacaaagaagcattctagagcagaagcaggtctcctcttgatgtctgttaatctacctgtgtgtgcttatgtgtaaggttcttggtgcacattaactacatcatgtctgaaagataaaagtcaataaataaactcaagttctagtgattgagttctcctctacatcaaacacacgagtaaataaagtctagagaactacagttggttagaaaatgatgaattttgcaaatgttaatgggcttccttagaatcagttctatgaaacccgaattttaagggtgttgtacacatcattcacttgtacagaatctccctgaatcttttgttttctcccttgaatcttcataaatacagatttacaaacatagcccttggagatctaatctgtcctaagcagaggaggttaatataagcacttctgaggaattcctgcaagattaaaacaataataattcacagtaactgtagtgtcttttattttactccatgcccactccattttagtaggtaaaaggaaaatatacaattaattaaaatgcactgcttcattatacagtgaagattaaaaatgttactaagtgataaggcttccgcttctttaaaccagggtcagtcctggctaaagagaactaagagctccaaaacacctttacaagtctactaagtgtaggaagtagaagagctaaaacttacgtgttaataactccattgacaggtctgagtgctccacatgatttggtagacagtgactctgaaatatgaccaataataggggcaccatggttttccaatggctgagaaacagactcaatctgattaagaaaaaggaaaaaagaaattaacatgtacccaagcgcacccctgcctgaaaagcaccaccacttcatttgcacaaagcacctaaaacttctgatgatcaatttgaaaaacacaacttgaatgactgaagaaaaagaaaataagagaatcagtggtcaggtatgatggctcgcaactataattgcagcactttgggaggccaaggcaggaggatcgcttgagaccaggagttttgagaccagcctgggcaacacagcgagacctcatctctaattaaaaagagagagagagaggttgacagagagaaggagaatattatattagcttttgctttggggggaagagggatgaggaatccaaatgtacagactaaaagtaagtacctattgacaggaaaatgacctcaataattctatggaacagaagcttagcaaaacaattacacagtaacataagctttcaactaatgatcaagaaggatatactaacatcagtatcaagatgactaagaggaaatttaaatgtagttaatatctgcttaactctaacagagtatgctagaagcttgttttctaaaaactatgctttgtttaaaaatatacacacaggccggggatggtggctcatgactgtaaccccagtattttgagaggcaaaggtaggaggatctcttgagcccaggggttcaagaccagcctgggcaacatgacaaaaccccatctctacaacaaaaaaatacaaaattagccgggcatggtggtgcgtgcatgtagtcccagctactcaggaggctgaggtgggaggaggatcacctgagccaggaggcagaggctgcagtgagccatgatcatgccactgcactccagcctgggtgacagagtgagaccctgtctcaatgaataaataaataaataaacacacacacacatttttccctgacagaaaacaaagttaataaaatctcaatgaatctaattatctgatgctatcagatactaactattgtctttagagtattcaaatcaaatatgtttagaatataaaatgaaataacagatgagaaagaatagaaaaagtgtgatttgcagtattcaaaacaaattatatatttactaggctcaaaacggataggaacagtatgaatgccagtcatatagcacctctgaggtataggcaataaagcaacagatgcagctatccctcagttctagcaattgttgaactatcccagaaaggctatgggtctttgactccttactttatttttttgagatgaagtctcgctatcccgcccaagctggagtgcagtggcatgatagcagctcaccgtagcctccacctccctggttcaagcgattctcctgctttggcctcctgagtagctgggattacaggcacacactaccatgctcatgtaatttttgtatttttagtagagatggggtttcaccatgttggccaggctgttcttgaacttctgacctcaactgatctgccctcctcggcctcccaaaatgctgggattataggcgtgtgagccaccacacctaacctgtctccttacacttgaactgactctggggcacgctgaagttctctttcctataaaagctttcaaggtaaatattcctataaatgcttcctacaaatgctttcaaggtaaatattttgaggctgaaattctacttttcaatactgatttcttttgtctttatacccccaaggataaaacaccaaaggactgaacctgaaagtagtcctagacaagcatcaaaaagaacagactgaggctgggtgtggtggctcatgcctgtaatcccagcactttgggaggctgaagcaggcagatcacctgaggtcaggagttcgagaccaacctagccaacatggtaaaatcccatttctactaaaaatacaaaattagttgggcatggtggcgcctgtctgtaatcccagctcctccgggaggctgaggcacaagaatcacttgaacccaggaagtggaggttgcagtgagccaaatcacgccactgcactgcagcctgggaaagagagagagagagactgtctccaaaacaaaacaaaacaaaaaacaaacaaaaacaaaaaacagattgggaagataatctaaaagttttaatacaaattatcctaaaatacagatcaaactatatacacagacaagtcatataagtatgctacaatgagtgaacaccgagaaaaggctgtcttttttgttggatatcctgtacatctactaagatatcacaaacatcttgaacaattgtcaatgctatcaaaaattacagtaaatctggcatagacacattgccttaagctctatgcagatttcccttggaaagaaacacggtattaagcagcaagagctataaggatattcctatcttctgacaaaatattctaaccaatttttaaaaatctaccctaaaggagtaactcaacaaacacagccccaaaaatcttattcacaaaggtggtcactgcaatgatatctatcaataatctaaatgttgtaagcattataactatagttatcagttgtggtacaccaaatcaaaatattaaaaagaatcataaaggatatttcttctcttatggaagaagagatttcaagagaaaaaaataatagtttaatatagttgtagtgactaaaaatatacatacacagataacaacaagacaaagagtgttacagttgtaaaactattctgaaattttctttacattttaggtaatagttttatattaaaaagaaacccccataaaaccaaataccctcctgaatgctagtaaggatttactacacaggggaaacctcaaaaaggctaaacaaatatggtatgacaaagaacaagaaaaatcaaaagaatttaagattcaggttggtattaactaacagatgtataacttcaggcatgttataggtattctagatttcagaagttctggtttagatgaaaaagtttcctttcaatagaaaaatgctgtttaaaaatgctgtttgtttttatttcggcattaaattatggcagtgatttgatttatatatggtatatataatttatatggtatatttgatttatatatggtatatataatttatatggtagtgccttcacgtgttctagaaggtactacgtttaagtaacgggttgactgactctccatttgattaagtttttctggtagggattatgagatttaactgcaagaacacttgtcaagataaaatgttgccattctctaacaaagtctcatttcaaaacatttatctttcttatacaaagtctaaagaagaatatgtcaagtaaaatcaccagtaatgtcacgatccatatagctaactactactgctataacagcctgtcttgtttctcatgtctgcaggtgtatatatttaaatgctattcagctttaacatgaatgttattgattttcttatagaaacctgaatcttcctggagtaattcagcccccaaatcaaaattgaagtcaacaggcaacacattattaacatggaaatgttgtcaagaacatagaggtatacagaggtcaagagcataaacatcagaaagggactgtggctggcctgcattcccagccacaaaaaagaaagcactggatactcaggaaggatctacttcagatcttgggaaattctgtaatcaagctagtatccaacagcaggcatttggacatgtcctgcaacccatcatcaatgcaaagagcttaaaatattaatcccaatcacagtgttccatttggaaaaagaaaaacataacacacaaacacatgtaatttcacctagctccttaaatgcaggcactctcccttgagaaaaaatgaacatttcctatcctgcagtctaaaaggctgcaaatgcagaggataaacattaacaaacacttaagaaatattaaatccgcatactaatttcagcttattactactgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcg

SEQ ID NO: 2310 - DNA, 3152 bp, Homo sapiens
cgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaa

SEQ ID NO: 2311 - DNA, 558121 bp, Homo sapiens
tggagaagagaaagcggtgatgcgaagagggggcgggaccagagagtggatggcagaggtgggctgtagagccaaagtggggtgggagcgcgaagatggcagctgctgaggaggagccgaagcccaaaaagctgaaggtggaggcgccgcaagcgctgaggtgagcgctgccggacttggggaggagggtgacggcgctgcaagcaagccagggcccacgtggggttgcacggccccgacgctgggtggtgtctctcactgccagcttggggccaacacgcaggacctcccccagctgcccgcttggccgcgaccccttgccagacgttctctccgtttggctgagtccccgcctgtctggtgcagctccggctccagcagcccttcgccagtcgtggcccgcagggggaccgagctggctgaccgcgccacctgcgagcaagcccaggctgggctggtgcgaccccggagggtcggaccggagcagcgtctgtaggcggccgccttctcttcccgggggatggcgggaaagaggctcggcaactgctgtacactggggcaaagtcagaattcttggggatttttcagagtgttgcggaagggcacgttgaccttccttttcgtgcacattctgaaagcccgtacctttgaggaccctctaccagggacccagacccctccgatgctttgcaggggcagcatttggatgaatggataggaaaggttgatttctcttttttatttacactttttggcagcaacggggacagtgctgcccctaacacctgcctcacatgtgattgatgttgcaacttttacttatgaagagtcatttgttaaaatatcccttcctaataagtataaagtgaagcaggcagtctttgatgatttggaaatgttcgctgaaaggcagcgatttttttttccatcttaaaatagacatatcaaactgatttaaaactattaggacactcctgattaaacaggacatatcccatttcttccagtatcactcttcttcacctccaaaggaaggaatcactcacaattgaaaagaaaaggacacttaggggcctggtggtgtgttcatgctgctttgaatggagggtgaacaaatccttgccagttcctttaatgtattcctactaccctcaaagggttagtgtgcctaccttataccaagaacataaactttaaaataaaaaccctcaggatattctatttttattttaaatattccaactatatgcagaataaaaagcaacggcttttgaatcagacctacctgagttcaaggcatgtgctttccctactctgccctttattagagtatttccttataaggcacctccttcgccaaactggaagacagatgcaacttttccctaccatcctactgaacatataacccttagatttccttagatttttccttaataaaaattattatatataatgctgatccattttcactgtgttttcctatttattatcttgttggacagttctgtgatcaaaggaaggcaagaattatgcctattttacaattgaagatattgaagcccaaataaaacaattagtacaggaacagaaataggaactagctgagcatgttttcttatacctgcagtcctggtgctttgtgaggctgtggtgagagcattccttaggcaactaaaattcactttatacaatatgaatttagtgccacctgtagacatgaagttaaaagattagacacttgagtactgggacaaatctctaattttgtggggagacattttaggatcggctattattacttttattatattaatttgctttcagactcaaagtgtgataatgcattgagtatttacactgaatttatgatgacttgcttgacaggggattgctactggttttggttaaggagaatggattataaagactttgcataatttaatgtgcagcatcagtgggaacaaataatgagatatatttgtagatgtcaggaaaaatatttagatttagggatttgtgagaatttggtcagctctgggataataattctccaccaggggaaattttgccctccaggggacatttggcgtggtctagaaagatatttttggtagggagagctattggcacctagtggatggaattcaggggtgctgctaaacatgctacataggacaacccccacaacaaagaattatctggccaaatacgtcaacggtgttgaggttgagaaatctgttctagagggagcatctgacaagactagtctgcctttctcaaatatctattatttttctaggctcggttgcttttcagcatataacagttgcttataaagaaagaatcaggctctgacatgttttcacgtgggattaggggaaagaagggaacgttaattgagtgctagacattatactatgtgctctatatatgttatctcttttaaccctcccagtgacctatgaggtaggagcaatgattcctgtgttacagacgagctattttgtgatgaaagaagtggagaaacatttttgggaactgctccctagatgaaggtgttccatgatgatcacttatatttaagacaacttagttttcttttctctcctttggaaatctcatccaagttcatttctttagcgatcgcctcttaagaggctacagtgccttccaaggcttgttgagcacgtgccaagtcttttccttcagtttgtctttcaagtacatgctattttagacatggtgttaaaaactggatatatatagagagagaaagaggtaaggcacaggtaccatcctcttggtgggaaataagtggggtttgggaaaatgacacctgagtattcttaaagatgactaggagttaaccagtcatctgtgactgtagggtatctgtgaagtagggtatctgccttataggaaagtttgtttggtggcagaactgggagagagctgcctcttggggaagtgcagatagtctgactgaagcagagatgtatggggtccaggctttgtattagacactctcacatgtgtcctttctatctctgtgcctctcagttctcagatcttaatttaatttaattttgtatatatttttgagttggagtctcactctggcgcacaggttggagtgcagtggcaccatctcggctcactgcaacctctgcctcctgggttcaagcaattctgctgcctccgcctcccaagtagctgggattacaggcgtacaccactatgcctggctaatttttgtatttttagtagagacgggattttgccatgttggctaggctggtcttgaacttctgacctcaagcgatccacctgcctcagcctcccaaagtgttgggattacaggtgtgagccaccgtgccctgccttcccagaccttaatttttactgtctgctgagtatgtgcttctgagtgactttctgacatttcgaagtcatatataccaaactaaattatctgttatcctgaatctgtgcatttttccatatttcctgcatctgttaatggcaccagtaacctcctttactccaaagtttgagacctagatatttgattcattttacatccacattataatgtctttccttttccattcctgctgccacaccttacgtttagactttatcttttgcttagattttgttttgacttcctaagcagtctctttaccttcagcctcaagttctgcctacttttctttaggcacagctctacttattcatcacggcaaatatttgtaaactctgaagttgatgttaggaaacgttgaatcctgaaagcccatatcattactccatctgacattagcaattaaggattattaaggatcatgacttttaatagtactaaaaaggaaacaaactacagttctctaatcagcaaatgctgagcttttctcaaatattgcttcctaactgtttcacttccatggaccccttttattattttcctctatctcctacctcactatggaccctgtgttctaaaattaaacctaggagctgggcatggtggctcacacctacattccagcactttgggaggccaaggtgggaggtttgcttgaacccagaagttcgagaccagtctgggcaacaaaatgagaccctcgaatctttaaaaaaaacgaaacaaaaactagctggacatggtggcataagcctgtggtcccagctacacaggaggctgaggcaggaggattccttggcttcccaaagtgctgggattacacgtgtgagccaccaagcctggccttaattaatgtttgttgcatagagtggcactgataactttcatttttctagaccctatatatatatttttttgtttgtttgtttttgtttttgagacagagtctcgctctgtcgcccaggctggagtgcagtggcacagtctcggctcactgcaagctccgcttcccgggttcatgccattctcctgcctcagcctctgagtagctgggactacaggcgcctgccatcacgcccggccaattttttgtatttttaatagagacggggtttagtagagacgtgttagccgggatggtcttgatcgcctgacctcgtgatccacccgcctcagcctcccaaagtgctggattacaggggtgagccaccgtgcccggcgaccctatacttttaataatgcagcctaaaattgagctttgctactattttcttttttcatcatgataatctactattgaaagagtttggttatttttggatgatattgcatgccttttacttatattcgcaaatttaatcctttaagattaaggctttgggctatgaaggaatggaaaacaaaagtcccctaatgcacttagtatgaatgccttaataagatcctttcctgggcaatatatactagtgcagcgtgagggtggtagagagagccagaggaaagcttgcatggatggttctgggtatccagggacaagcatggaagtgcttgaaactcagggaaagtgggaagggccttaggaaaacaaggggcattgaagactatgtttcttattttgggtacaggcctagactgaatattcagcctcaaataaaacatgaggctgatgtgctgcttttttttacctggaatatgtctttgctttacttccatcaattaaaatcctggccacatggtgtggctcatgcctgtaatcccagcactttgggaggccaaggtgggaggattgcttgaggccaggagttctagactggcctgggcaacatagtgagaccctagctctacaaaaataaacttagccaggcatggcagcaggttcctgttgtcccaaccactctggaagctgaggcactggcactactacattccagcctgggtaacagcaagactctgtctcaaaaaaagaaaacaaaatatctttcctgtgtccaaagtgtttacagttaggtgggggaaaaaaagtatcaaaattttaaagagcattctggtcagaatggatcccagtagagcagtggttaagagcatggtctctggcatcagctatctggtttgacccttgatccttattagctagtgatctcgggaagattggctacttgccccatacctcttttctcacctgtaaaatgggtatagtaatagtacgaacctcataaggatgttgagagggaaacgcagcaattaaaaatttaaaaaggaaaggaaaagatatagatatactcaagaacaagataaacatctccagggaccaagaacagaaaagaaacatgcagttagactctgggttcaggagctagtagaaataacatgtaggggacctagggtcagatgctctgtatgaaactgaagctgggctgagactggatgaaagagggctgaaaacatctgctcttggctgttgctttaaaaagctgtggacctggagtgaagatgcagaagtggctgagctgccagatggctcagagtcaggaactgtggtttccccactatcagctagtacaagagcaccaagcttggaggtcgtggactctggaagaggggtggcctatcacagaacccctgggaaaagagggaatgtctgagcctataaacacacgaggaagaccattacttagaaaattaacacagttaccaagagataaattcacaaaaaatctgatggaaatatgggtaatttcaaaacaattgtaagtattttaaagatccttaaaaaagataaaagaaataatggtcataaaaaaacatgaatcaaaaataggtagatatgaaatagatggctatattaaagaaaaaatggaattattgaaattaaaaaaaaaataggtcagttgaactctagaccagacaaatttgaagggaaaattaatgaattggaagaaagtacccagatgtatcacagagaaataaataggaattaacaaatatgagctgggcgtgatggctcatgccggtaattccagtactttgggaggccaaggcgggcagatcacctgaggttgggaatttgagaccagcctgaccaacatggagaaactccatctttactaaaaaaaaaaaaaaaaaaatacaaaattagctggatgtggtggtccatgcctataatcccagctactcaggaggctgaggcaggagaatctcttgaacccgggaagtggaggttggggtgagccgagatcgtgccattgcactccagcctgggcaacagcgcaactccataaattgagaggcaccaacttacatctaactgggagttccaaaaagaggaaataatgtgaatggtggagaagccaggttggaagagctgatggctgagaatttaccaaaatttaagaaagaccagttctcagcttgaaagggcattatatgtatctagtaagatggaaacaaaaatataaactaaaacttcagagattttcttgctaattatattaatgtatctattatagaaagactgaaaatttagacactccaaatttaatagtgggcatctttaggtggaagaattatgaggtttaaaaaaaaacttgtattttccaatgtttctacactgaacatattaggaatcttgcttttaagttggagagacttgaagtacactgaatatataagtggccaagtgctgtgtggctaaatattatctttacagaatggacctctgggataccaaatacctctgaaacttggtaacataattattatgactttattgtaggctataatcttttaagctatatttctgaaatcccaaagctctggaagctggaagttttttaaaaagtttgagatgaattaatttggcagcaaaatttgaactgatgtaaaggtgtcagtagtatttatttgtctgacacaaatgtatatgctttgctatggaaatattaggctgttaatgacatgccacatgaattcctcctgggtgttctacaaaatatatagtgcagtgttaccttcctaaaatccataaaattctgaattccaaaacataccctgccccaaggatttaagaaagggtttgtggacttttattacttatttatagtttacttttaaaagttggctactgtgcaggaacaataatttctcatcagagttagttcctagatttttttctctagtcactgttctgcacttctatgatactaagtagatgctcatttcaaagatactttttggctagctctactgtaataccagtacagttgatgtcactgagttattaggcttttcttcctctccagtagtaactgaaaagacagacttctcttcaacttttggacttgaagatttggaaggctgttttacaaaatggtctcccaaactgaagtttcacatactgcttgaagaagatacattctgatgatttatcaaagcagatttagagtttttgctctcatttatgtgtattatttctgatgttgtttgtacttttggcttcgtaccatttctttaaaaatttggttcatacacttcagatctagaagcaatgtgattagcctttgatataagaacatctgagtttctatttgcatttttactttcattgcatgcatgctgactttagtattttctttacaatttagaagatatatatgtatagcaattatgtaagaaattcttgccttctgtaggcacaacagtttggttactgtattaacatggtcttaaccattttgtcagcaagccacatttggttagtagtgagtcctgctattttactatgttacctgcaaacaggattgcagatgtgaaggtagcctgtgtgatcattggtcactcactgaattagggattatcagaaattatattgaagtggtcacttggctacttgccttctacatgcttaggctagactttggttcatacttagaaccattttgaaatctctgaaagactcagttgactcaacctaactggaaagtccatctaatttttttttttttgagatggagtcttgatctgtcacccaggctggagtgcggtggcacgatctcagctcactgcaacctccgcctcctgggttcaagcaactctcctgcctcagcctcccgagcagctgggattacaggcatgcaccaccatgcccagctactttttgtatttttagtagagacagggtttcacaatgttggccaggctggtctcaaatgcctgacctcaggtgatccacctgccttggcctcccaacgtgctgggattacaggtgtgagccacagcacctggcctaaagtccatctaaatatgactcaatctaggagttcaccgcttgtctctgttgtcctttagattcaatttatctctcacgtaggccatttcagtgtaacaagatggcagttctcaactccaagccaaaatctcatgagtccaaaggaagagagtttttctatatgcttgtatcagttttgagagaaatttggttctgcctgtgttacacactaccttgaaccagttgaggtaggaggtggggctcagacactggaccaaattgaggactagctaaaacagggacagagtggaatcagctttccgtaagtcacacctactaatgtgccatgtcagtttcccattgccacggcaacacccagaagttagcgtcccttttcatgacagtgtcctggaagttaccacccttttcctagaaatttctgcataatctgcctcttaatttgtatataattaaaattgggtataaatatgaccacagaactgcttctgagctgctactctgggcatactgcctatggggtagccctgctctgcaaggggcagtacctctgccgatgctttacactgctgcttcaataaaagttgctgacacaccactggctgacccttgaattttttcctggatgaagccaagcaccgtcctgggctaagccccagttctggggcttacctgccctgcattacaatcactgtatcagaggtggagatttgggctggccttggatacattctcactgtctgcccgtctgttgtgtgcgtgcatgcaggtaggggtgtgtgcgtgcatgcaggtaggggtgtgtgtgtgtgtgtgtgtgtgtgtgtatgtgtgtgtgtaggtagtactaggtatatggggagccagtgagtgtaggcattgttcgtatatggggggaaatggatgggtgttgatgggtacactgtaatcaacaactccgacaggaccttgtagagtaagggaggtagtgtcattccctcagcaagagaaaaatccattttagcatgtacaatatttattaaaacaaccttcctcttctccccttccaaaaaacccgacaacctcagtcttcaaggtctagccaaattctctcttctctataaaacttttctactcaccaaacctagaaatggtttctcctttgactgtttgtactttatactttgcgttattgcaatgtacagtatgtgcatgttttatctcacctattgctacttgaagttgggaaactagttgaataactcttagtgcctcataactgatcacttcattgcaatataacaggctctgaatttctgttgaatcaaggaattcctatttatttttttgagatgaagtctcgctctgctgcccagactggagttcagtggcatgatctcggctcactgcaacattcacctctcaggttcaagcaattctcctgcctcagcctcccgagtagctgggactacaagtgcacaccaccacacctggctaaatttgtgtatgtgtgtgtttttagtacagacggggtttcactgtgttagccagtatggtctcgatctcctgatctcgtgatctacctgcctcaacctcccaaagtgctgggattacaggcatgagtcaccgcgcctggcctatttattttaaaattttaattaattttttttttgtttttagagacagggtttcactatgttgcccatgctggtcttgcctatgcctgtcttgaactcctggcctcaagtgatcttccctctcagcctcccaaagtgctgggattacaggtgtgagcaaccattcctggcagaatcagggaattcttaacactttttttttttgttttttttgagatgagggggtcttgctgtgttgcctaggctggagtgcagtggtacaatcatggctcactgcagctttgacctcccaggctcaagcgatcctcctatctcagcctccagagtagctggaactacagggatgcaccactgtgcccagctaattaaagaaaaaattttcttttgtagaaacagggtctcactctattgcccaggctggtcttgaactcaagcagtcctcctgcctcggcctcctaaagtgctaggattacaagcctgagctgcatgcctggcctcttaaccctttaaagatttttttgtttgttttttagacagagtttcactcttgttgaccaggctggagtgtagtggcacgatcttggctcactgcaacccccgccttctggtttcaagcgattctcctgcctcagcctcccaagtacctggggttacaggtgcccgccaccacacctggctaaattttgtatttttagtagagacagggtttcaccatgttggccaggctggtctcgaactccagaccttgtgatccgcccaccttggcctcccaaagtgctgggattacaggcgtgagccactgggctcggctgcttgtagcatttaatggtgcaaaatggattcatgtgttgtctataaattcttaccaataatgggagttgatggagagaactattacctgaaaatacttcacgattctttggcctttcatttttttgttaaatggagtgagcttgtgtgcaaaatcaacctgatactaaaggataagaaaggtactcccgattgcatttcttttgtgtgtgtgtgtgtgtgtgtgtgtgtgtgtgtgtgtgtgtgagacagagtctcactgtgtcgcccaggctagagtgcagtggcatgatctcacctcactgcaacctccacctcccaggttcaagcaattctcctgcctcagcctcctgagtagctgggattacagtcatgcaccactgtgcccagctcatttttgtatttttgtgtttttaggtttcaccatgttggccaggctggtcttgaactcctaacctcaagtgatctgcctggcttggcctcccaaagttctgggattacaggtgtgagctaccacgcctgtccccagtttgcgtttctgttctttctggtgaccatagtgagctcgattataatagccatttattatatttgtctatggggaaaaattccctcagaataaatacacttctcctacgtgaacagtaacattttctttcttttttttttgagatgagtcttgctctgtcacccaggctggagtgcagtggcatgatctcggctcactgcagcctccaccttccgggttcaagcgattctcctgcctcagcctctgagtagctgggactacaggtgcccgctaccacacctggctaattttttgtatttttagtagagacggggtttcaccatgttagccaggatgttctcgatctcctgaccttgtgatccatccgcctcggcctcccaaagtgttgggattacaggcgcgagccactgtgcccggccaacagtaaccttttcttaaggtcccgtggttgatgtcttcactcattctttcttcttttaatatagtagaattgcgtatttgggggaggaatagagtttctgaaagagtgaatgtacaaagaagatcccagtgacctgttagaatgatgaatctcttttctctgtgttagcaagcctttaattagtaaggctgtttgcagtgtaattagaactgcacaagcatggaaggtcagtaatactgttcagaatttcataatgtactgtgtaacataacatactgtgaaatgaatccatagtaccacaaaatttgtttttaaagaagtttgtctctattgactcatctaggaggggtcacttaaaaacaaaatagggcaaaaaagtcaaattcagatgtcttaggttttctcaaattcctttaatctcgatatagcaaaagaaactgtttccttcttagccctagaatggcagtctgaaaaattatctaagtttttgaggaaacaaattgaaatacaagaaaattatttcctttacaaataaacagttctcttgtttgtctttgaacttaaccacatagagatttaaatagtttgttgttttataggcttgactgaggaagtcttctcctaaaatagaattttttaaaatagttttttctcagcccagctgagaccttagttatcatttttagttcttagttttgttgaagattgaagccattaagccgtagaagtgatgcagatttatgctgttgtctatatctgttctcacctactcaggatgaattgattataaaacattttatcataggatagcatgttgatgcatataaaacatagtgatgaaattctactttgtcttgttttacttattgcttgttcatccaaatgtattaaatttgattgtttaggtttgagatattataataaaacttggttacattattaaattcagtacatagtataaaatgtttattaaaaatagtattttaggctgggtatgttggctcatgcctgtaatcccagcactttgggaggctgaggcaggcagatcacttgaggtcaggagttcgagaccagcctggccaacatgttgaaaccctgtctctactaaaaatacaaaaattagctgggcatggtggtgggcgcctgtaatcccagctacttgggaggctgaggcaggataattgcttgaacctgggaggcagaggttgcagtgagcccagattgctccactgcaccacagcctgggcgacagagtgagactccatcttaaaaaaggaaaaatttgtcctttttttttgggaggggagtgtaggttcttctctacataatacattgacttccttaggggtattcatctctgtgtttgcatatcctaagggtgttctttagagaaatatatacatttctagacttatactcgtagattcttatctttgcctagtttcctctggaggacaagaatctcttctttagcactatttcccccatatttgtgtagcattcctacatttttcaaatgtaaaaaaacaccacatcagagacctttgacctcagttctctgtgaagtttcaataaactcgattcctgagaagacgtgttagtttcttgtagatatcaagtcaaactcaaagatctttaagtgttttctttgtttcccaagatgttgattctttactctcataaaacaggttaaagcaggctctctcagcctttctctttgagaaactactttcatatttccgaagactgcttgggaatgctggtgggagttgggataggagcagcggagggaggagatgcctaagagtgcctgttctcaggtagagttggaaatgttccctcctagagctgagatttcctgcaagacatcgagttggggtgtgaaagcagcagatttcagtatcagccagatgtggctttgaaatggtggttcacagtttcttgtgatttttgaaaactctgaacatattttagactttttagattattagtgcttgatgaggtacttaaaatcagagtctaatatttgggttgtacagttgagggtattaaagcccagagaggctaggtggtatcagtaaggtaacacagtaagttacagctactaagtatccaaggtgagatttgatcctgagtcttataacttaccgttgctctaggctctggaataagaaatgaagcatcaatttcctggggagcttttttttttaattaaatttaattttttttaagataagaataacatatttgaagaaaatgtcaagtactttcacttacattttcttattgatctccacaagaagacaaccaggcaatctgtctttagctgaggaaacagacccccgagaggttaagagtccctaagtagtaaacattcatctcacgttcaggacctctgactcatgtgtcttgctgtttatattatgtatgaagatagaaattgagaagctgtcagtaaattctgtatgtgctagataagcaccctgtttaaagaaattctgtggcaattgtcaattgtgttttataatcttgtctagacttgtgtctctcaagttttcttattcacacatatgtagttttatcccccccaaaataattattctcttgtgggatctacttagtggtatggtttgcaaatggattaactcattgaactggaatttttagtagattatattttcttttttctcatgtttctttgagacagagttgctctgttgcccaggctggagtgcagtggcctcctgggtacacttccacttcctgggttcaagtgattctcctgactcagcctcccaagtagctaggattaagggcatgcgccaccacacccagtgaatttttgtatttttagtagagacggggtttcactgtgttggcctggctggtcttgaagttccaaccttaggtgatctgcccgcctcggcctcccaaattgctgggattacaggcgtgagccaccatgcccggccagtagattgtattttctaatcaaaactttagacaaaccaattttgcttgtgtttaattaaaatgttctagttaagaacaatttattagtactattttttgagatggggtcttacttggttgcagaggctgtagtgcagttgaacaatcttagctcactgtaacattcacctccgggctcaagccatcctcccaccgcagcctcccaagtagctgggaccacaggcttgtgccaccacgcccaactaattttggtattttttgtagagatgaggttttgccatgtcacccaggctggtctgaaactcctggcctcaagtgttctgcccacgttggctactcaggaggctgaggtaggagaatcgcttgaacttggaaggtggaagttgcaataagccaagattgcgccactgcactccagcctgggtgacaaagtgagactccgtctcaaaaaaaaaaaaaaagaaaaaaaaaaaagaaatggttaaaataggaaaagtctcagttcctcttagctatttctgattgctacatgacttccatgaagctttttaagctttcactcagttctgaggtgtttatatgagcttgtgaggaacttctggttacaaactgtaatacctattggcttttagcatggtgcaaggaaaagagctttggattagggataaggacacctgagtcctattaaggtctctgtctggatttgtgaatgcacctgttaagtgagttgtatagactaaaatgttttccagactacatgagcctttttgagtattgcacaagtggtattttataaacgagaaatagaataaaaaatattgtgcattgagtacctaagaggtaagtattgctctgtgaatcattgtttcagttatatgtatagggtactgggttacaatgtaaaaaatgtatttttaattaaaaaaatataaatgtagaaaaatataatagagatgaggtctcactatgttgcccaggctggtcttgaactcctaagctcaagtgatcctcccgcctcagcctcccaaaatgttaggattacaggcgtgagccactgtgtctggccaaaaaatgtatttttcacacagtttggttttctattccaaaatttggtggcttaaaataactactttattagatgtcatgatttttggattaggaattcagacacagcttggcctgttgattctgttctatatggtgaataagatcacttggaggtgtttagctgacaacaggtctggtctggagggtccatcttatctttattcactcaccttatgccttagggtaactggaggcttggctcaactgggcttctcttagtgtagtttgagatcctctctgtggtttcttcagctgggtagttggacttctcacgtggcagctccaagagaccaaagcaggagctggcagccctctcaaaggctagcttagaatctggcatagcatcaccttcactatacactattggtcagaggagttccaggctagcccagatttaagagaagggaacatagacttcttgtctctaagatattgttcccattttaagtctgccacaattatgtaaaataatttagaaaaacatgactgaattatatatccaagcttttaattctgttattgccctttgaaggatgatcacttttaaagtgttttttcctccattgggaaatttgtctgcttttggtaaattttcatagttcaatttgagtatgtatattatttttccatggaatactgagggttttatgcttttgaagaaatgatttaaagtttaaaatttctttctctacattgatctgctggttttaattctttgaatagcacttatgatcatttgatgctgttcttttttgttacttgattattcatctttctctccttagaatgtaagttctaaaagggcagcacatgttcttgatctttgccaaatctgtagtgtctcctgtagtagaacagatgctcgataaatatttgttgagttaatgaatgaacaatttaaaagattgtgagctgggcgcggtggcttacgcctgtaatcccagcactttgggaggccgaggcgggcagatcatgaggtcaggagatcgagaccatcctgtctaacacagtgaaaccccatctctactaaaaatactaaaaaattagcggggcatggtggcatgcgctgtagttccagctacttgggagcctgaggcaggagaatggcatgaacccgggaggcggagcttgcagtgagccgagatcgcgccactgcactccagcctgggcgacagagcgagactgtctcaaaaaaaaaaaaaaagaaagaaagaaaaaaaagattgtgaagtatcatagatcagatctacgttgaaatgataaaaataaggaaaatctttttttagacggagtctctctgtgtcgcccaggctgtagtgcagtggcatgacctcggcccactgcaacctccacctcccgggttcaagcgattctcctgcctcagcctcctgaatagctggaattacaggcatgtgccaccacacccggctaatttgtgtatttttagtagtgatggggtttctccacgttggtcaggctggtctcaaactcctgacctcgtgatcctcccgccttgtccttccaaactgctgtgattacagacgtgagccaccgtgccttgccaaaataaggaaaatcttttagatagaaaatataggaccggtgtggtggctcatgcctgtaatcccagcactttgggaggctgaggcaggtggatcccttgagctcaggagtttgataccagcctgggcaacatcgtgagaccacatctctaccaaaaaattagctgggcatggtggcgtgcatatgtggtcccagccgctcaggaagctggggtgggaggattgctcgagcctgggaggcggaagttgcagtgaaccaagattgtgccagtacacttcagcctgcgtgacagtgggaccctgtcttaaaaaaaaaggaaaaagaaaatatatttcataaggttagcaacaagcttttgagaagggctattctttatttctgtgatgtactttctatatttttgtattaaaatcccttttctgttgtgaaatgatagtgatattcacttctatagtttaaaaatatgttctgtgcagcataaataattgataagcagtgttatcttgtactttcagattggagttgcctttgagagtcaaagatttgtagctcacagaaaataaagaagtactgtgtgggtgtgcctgggagggagttttgctaagaattcttactaaataaagttcaatcagtcaaatgttattgtactcttcaaattctccagggaaataaattgccagcttccatttaaagattgtattttgtttgaatatgtgatgttaaagtgaaatgtgacatataagaatctaaagatgattattaaaagcaaacaacataatagcattcttacaatgtcttttgcaggagagaattaatagatttagcagtgtttctttgaataaacttgtccataatgaaagctaactaaaattgcattaaaatttatcaactcctttaaaaaaattcaatatgttttgagatacaagtatgcacaagtattttctttcattgtctaataagaacttaaaggaacctgagatgtcacctataacaaactcctttgtgtttcagaaaaggaaactgatggtcaaagaggtaatgatttgtcaaaagtaataaagttattggtaagtccaggattcgaatcccttctcattcccaggcccctgacctttacatggctgcacactattttagggagacaagttttaagaagtttctctttttggatatgatatagattctttaaataatattattttactgatttttgaattcatattaaatgagggtttgtatttttaagtaacatgcagggaaaacattccacattcatgttatgacagctgggctcgtcaaggctttgcaaagctctaaaagtaggatacacacttttaacttttgtcaagttgtgatttaaaattaatcaaaaaaatcatgaggacaccttatttttgttattcctgtcttaaagaatctttatacatgaaaaaatgaaacatttataaaattagcccaatttgtctaaaaataagggtagttttgacggttgtgaatttctttttttaaaaaaactcaggaacaaggttatgattttaaaaatgcaagttttcaaaaagggcaggagtaagttttgtatttttaagccatttaaaaaagatagtaaggccgggcacggtggctcacgcctgtaatcctagcactttgggaggccgaggcaggcggatcacgaggtcaggagatcgagaccatcctggctaacacggtgaaaccctgtctctactaaaaatacaaaaaaaatttgccgggcgtggtggcgggcacctgtagtcccagctactcgggaggctgaggcaggagaatggcgtgaatctgggaggctgagcctgcagtgagccgagatcgcgccactgcactccagcctgggcgacagagcaagactccatctcaaaaaaaaaaaaaaaagaaaaaagatagttgatatttaataataattataaaaattataactataaaaccagtattagaaaattaatgatggatgaatgtaaataaagtaaaattatgcataatcctactttccagagataactaataacatttaggtgtatttctttccaatcatttttttctatgcatatatggtgtgtatttttttaaacacagtcaagttcatactctacttccttttgttttgcttttttcatttaacattatatcatgagcattttcttatgtccctaaaaagtctgtggaaacattttataatagttccataacattctgtaattatttaactattaccctatttctggttatttgggatataataaatttttgctattgttaataaggctgaaatgaataactgggtatacaaatctttatacacatttgtctctcttttaatgatagttgcctaaaagttggaattactgacacatattgccaaaattctttatagtagaaatgtactaatttatactcccattaattttatatgagagtgcttgttttatcgcacccttaacaaactggttgtgtttgaagagaactttgctattattttggggcttgaagcatttgttgaagagattagtggatgggtccacatttttggtatgctatttggaggcacttagctattttgggttatgtatctgattgcttttatagggccagaccacaagattagataaagtatatggaatatttacatatcagtcttacgaagagcaaactattcagacccacttatcttgattcagctattctaattgtaaaaagactactgaaggttaaaaatttcagttgactattttctcctaaagtaggataagctaggcttttaggaaaaaaatagggttgaaataaattgtttagaaaattgatcaaaagtagtagttactcagtactctctctctcagcgctcactctctttctgtctctctctgtctctctgtgtgtgtgtgtgtgtgtgtgtgtgtgtgtgtatttagaaaaagagtagaatggaaagattagaaatagagcatgaaaggctggggaagggaagttgctgtgaataacagaacttctgcctttacctgggaaaatatatctttacttttgtcgctacattattgactctgaaagatcacatgagtcctctttcttgaaataatatttttgtgtttgtaactgctgacacgactggtacttaaattttgagagaataaactttttgaaaatttttttgaccattaataaaaaacttttttttcatttcctacagtacatggattttctttttttttttttttttttaagacagggtcttgttctatctctcaggctagattgcagcggcgcaaacacagcttgctgtagccttgaactcttgggctcaagccatccttccatctgagcctcccaggtagctcggactacaggtgtgtggtctccctatgttgcccaagctggttttgaacccctaggctcaagtggtcttcctgccttggtctccctcagtgctgggattacaggtgtgagccattgcacctggctagacagctgattggctgggcgcggtggctcacctgtaatcccagcattttgggaggccgaggtgggcggatcacctgaggttgggagtttgagaccagcctgaccaacatggagaaaccccatctcttattaaaaatacaaaatcagccgggtatggtggcacatgcctataatcccagctgctagggaggttgaggcaggagaattacttgaacctgggaggcagaggttgcagtgagccgagatcgcgccattgcaccccagcctgggcaacaagagtgaaactccatctcaaaaaaaaaaaaaaaaaaaaagcggatcacgaggtcaggatatcaagaccatcctggccaacatggtgaaaccccatctctactaaaatacaaaaaatttgccaggcctggtggcgcacgcctaggggattgcttgaacccgggaggcagaggttgcagtgagccaagagtgcaccactgccctccagcttggtgacagagtgggactccatgtcaaaaaaaaaaaaaaaacggttagatgcaaatatcaaaaatgagttaaaaaatatctttggtgtggcttcaattttattaactattttaatattgcagacccatatcttcccttaattatactgaatttagtatatttgttaaaaaataaagttttaagactacctgttttggtatcaaaattagttttttttttttctttttttttgagatggagtcttgctctgtcacctaggctggagtgcagtggcatgatctctgctcactgcaagctccaccttgggttcacaccattctcctgcctcagcctcccaagtggctgggactacaggcacccgccaccacgcccggctaattttttttttaatttttagtagagatggggtttcactgtgttagccaggatggtctcgatctcctgacctcgtgatccacccgccttggcctcccaaagtgctgggattacaggtgtgagccactgcgcccggctaggttttttcaaattgaaaattttttttctttttctttctttttttttttcttttgagatggagtcttgctcttgttgcccaggctggagtgcagtggagcaatctcagctcactgcaacctctgcctcccaggttcaagtgattctcctgcctcagcctcccaagtagctgggactataggtgtgtgccaccgcgcccaactaattcttgtatttttagtaaagatggggtttcaccatattggccaggctggtctcgaactcctgaccttgtggtcctcctgcctcagcctcccaaagtgctgggattacaggcgtgagccactgtgcctggctttaatttgaaaattttaatgttacaaatcaaaggtaggtgttaccaaagtatgttaagcatgagcaaaagtgcatttgattgttcagagggccaagttcatgttagctttgggatcatgcctccagagatgtaagtttaactattatgataataacaaagtaataattatgccatgtgccaaggattctattagactctttactatagttaattaaattttaatcttcacagtgccctgaacagcatataatgggtaaaccgagggacagacagtttaagaaccagtttaaaggctgggtgtggtggctcatgcctgtattcccagcattttgggaggctgaggtgggcggatcacttgaggtcaggagttcaagcccagcctggccaacacggtgaaaccttgtctctactaaaaacacgaaaaaaaaattagctaggcatggtggtgcgtgcctttagtcccagctactcgggaggctgaggtgggagaattgcttgaaccccggggatgggggcggaggttgcagtgaaccgagatcatgctactgcactccagcctgggtgatagactgagactccatctcaaaaaaaaaaaaaaaaaaaaaaaaagaaccagcttaaagtcatacaggtaataggaagtcaagcagaagttgcaaaccagataccttttgctacctttacaggcttgctactcagcctggcccacagaccagaagcaattagtgagacctgggaacataaagaaatgcaaaattttggtcactgatacctgcagtgccaaacctgcattttaacaagatccacgagatttgtatgcatgttaaagtttgaaaagcactgatggtgtgaaatgtggattatctatcaacattttccacaagagaaggtgggtaactctagccagtgtctccaccactgtgaattgctaatccagctgctgctttgcttcagatcctgtttaatccagaggaacaattgactaattctgcttgtggaccttcggtcaaagtcttaaccacgccaagtatagctcagtgttttaacagcttttactcatggactgaacacatcagttttatagaccatggcttcattctggataggcatttcccaggttaaagagaacagtgctaaaaatagcattttctaaagaaacttgaaatcttctggaatatttgatgtgttttatggctagcaagaaaacagatttgtataaactggcttccttactaatttcattttgtgaacttaattattctatcacagggacagtgataggtaaagctaacttagactagagcagcactgttctgtagaaatataatgcaagattcctgtaattttaaattttctagtagccacattaaaaaaggtaaaaaagaggccaggagtgttggctcacgcctggaaggctgaggcgggcagatcgcttgaggccaggagtttgagaccagcctggccaacatggtgaaactccgtttctaccaaaaatacaaaaaaatttagccaggtacggtggcgcatgcctgtagtcccagctactcgggagcctgaggcacaagaatcgcttgaacccaggaggcagaggttggagatcgcaccactgcactccaacctgggcgacagaacaagactccagctcaaaaaaaaaaaaaaagtgaaatgtagtccaactaaaacaatacaattgtgtttagtggaaaaatatattgcttcagttataaaatttaaatgaattaaaattaaataaattaaaaattaagttcttcagtcccatcagccacatttcaatatcggatggtattggttgcttctgatataactgatttcagacatatgaaattgatcaccatcctagatggtcagtaagttaatgccacaggatattgtagtctattaataacattgtagaacagggcccagtcgttcacacctatattcccagtgctttgggaggccaaggtgggagggttgcttgaggctaggagttcaagaccagcctgggcaacatagtgagaccctgtctctacaaaaataaaaaaatgaaaattaaaaaaattattgcacagagaataaaggaataaaagcaatttggatcataaagcatttactgattccccccttttcatagttggagttaattttccttttattggttcacaatttcttaactcttcaactgcattaaactgtaagattagagccaggagttagggtgccatccacttttcccctctatggtcttagattcttttttttttatagcccgcatgcttctttggaaagtgaggtaattgtgtcaaataggatagccttgagtggggcccagaggttgtaaaattttatgtctgtacctgattcacctggtaacttgctaaaaataccgatgtccaggcctacctttctagattcggatacataaagtgacactttccatattaaataagctgctctaagtgtttctgaagttcaggaacgtttgggaccatcagatccagcaattgactctcaaaggctgcggactggaattagtacgtcgtgctgccgttgccaggcattttatattttcctaggctgaggcttcccaggctgttgctttttttccccccacctttgcagatggattttgcaggctgttaaatcccactcccgaagacctgccctgacagcgcctctttcctaagtgctgttacagggagctgagcttgccgaggtagacagtggccacgtgactgctaaaccggttgccagaggcgcggccatttttggggcgggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgctgggcaggagggcgaagccatgacgtcagtcaggtaacgagcgggcggctgccttgactgctccgagctgggcgttagcctcccgagcgcgtgagcactgtcgctccttctcgcgggtggtctggagcctgcctccgcctctggtccccctcgtgttgggggttccctccgcacttttcatttgggcatttctgctttcctcagaagttttcgggtctgtggcacattgcggagttctgtgtgtcgctgcttggtcgaggtgaccctcgcccaaattccagggttgcaagcgttcttgggtgtgtagtggatttcccatgaaaaatgtgccccacccgcgcccccgggggcggcccagggccggagggagcgtggcgtgcacagtgtgtgtcatgcctgcgtgtcatgccctctgacagaacttcattgttggccgggagcagacctgcaaagttggcccttctctgatgcaggtatattgccctcaagttgtgaaattgtgtgtctctaaaatgtttgctcatgactggaattaggaccctggttcccgaaggtaccatcttgtttctttactccttttatctcagagtcacaagtgaaatgagttgagagatactgggcatgtagcgaaatccatgaaactggagactttcccccaattgctcttccagtttggaaggttctttttttgttaatgaggacaggataatgggcttgtccactttctcccagtagccttgactgaatgtttaatttacgctagttcaactatttataaaaagagataaattgccttatatacccagtgttctgactggcctttttaaaagcagaacttgggctttgttgtcccagagaaagggaggccccagcacaaaaatgtgaagagaaataaaataagctcatttttggtctatgagctttccaggctccacccgtcctggtgatttgagggcttctcaatgccaatttttactacattgtgtttaagagacagcttgggaacctaaccctcagtaagatctaactgtgctgaactcggacatagtctgtctcttaaattgcataattatatatatatatatatatatatttttttttttttgagacagagtttcgctcttgttgcccaggctggagtgcaatggcgcgctctctgctcactgcaatctccgcctcccgggttcaaacgattctcctgcctcagccatccaagtagctggaattataggcgccagccaccacacccagctaattttgtagttttagtagagatgggggtttcaccatattggccaggctggtctcgaactcctgacctcaagtgatccacctgccttagcctcccaaagtgttgggattacaggagtgagccaccgctactggtctaaattgcttcattctgtactaacatagacaaagtacttatctcattatgcagaaggagattcaggtgctgaaacatggagacccacatggaaggatttcacagtaaattatattggggcatataaatctagcttttaaagctaacagtattttaggatgaattagaattaggctattatacccagagttaattccccttcttcccattcccactcttattatcacagaatgctactaattaggtgtaggggtcaaatactttctgtgttaagaatcagttgttatgtggattcagttttaattgactatcatcttcctgaccgtgcctcattggagaaacatccaaatctaaagcttctgctgtttaataagtgacagcaggatgtatcttttactgtaggggttgatagttttttttaaaagactgatgtaaaggttgacaccagccttacttgacatgttttgaaaggatggataactgataataaaatttatttatgcttgtttcttcagatgtcagtctgtattttacataatcttgaactatggtaacatggctcgagaaagctcttttagatgttatttaaaccagctattacattttacacctgaggaaactgagacaaaagttgagtgccttgtgcaaaatcagcggcaaaattaggaattgaatccagatttccatgatttagtgctctgcatggtgcctttgtagaaacaatatactatttaaacttcctgaaaaagctgtttctgtggacagaaattgtaaagtatcatgagagacaactatagtaactcttttgctttcttcttatcctgcaacgaacttgataactggggtttagaagtaggcagggttagccaagagaacacaactactgggtgttgggaagtgcagggaggccattgaaagtgaagtgactctgtatggtgatagttttgaatgagttggtcatcctacagataccagccatttcctggtgaacactacatttaatacaattatgtcatatctttagtttttgcaataatgatgtcagacatgttcctatcagaggcatttgagccagagcgactccatcttgaatagggtctgggtaaaataaggctgagacctaccagggtgcattcctaggaggttaggcattcttagtcacaggatgagataggagatagtcagaagatacaggtcacaaagaccctacaacaggatgcagtaaagaagccagcaaaaactcaccaaaaccaagatggtgatgagagtgacttctggtcatcctcactgcttattatacactaattataatgtattagcatgctaaaatacactcccaccagtgccattgacagtttacaaatgccatggcaacgttcagaccttaccctatatagtctaaaaaggtgagagaccttcagttctgagatatcagaactgatttcttcctttcctggaaaactcatgattaatccaccccttgtttagcatacaatcaagaaataacaagatacttagttgagcagcccatacccgtgctctgtctttggaatcgtcatccttttgtttctttatttctctaataaacttgctttcactttatggacttgccttgaattctttcttgcatgatgtctaagaaccctcttggggtctagatcgggacccctttctgttaacattcccattttgtgctcagtctaacagtagcctaaaaggtaggtattattgacccccttttactgataagctgaatgattacaagatatccaactctgactttgtgtccaatgttcttgttttataccacccttaattgttgctaaatatagtagtatgtgactcttttcatagcaatggctatgaaagaatacaggattggaaatcaatgaggaccaatggtcagaatatcttgggccccactgagggccttttctgagttactgagcttccatttctcttttctttttattattattattattattattattgttattattaattattattttgagacagtgtcttgctctgtcgcccaggctggagtgcagtggcgcgatctcggctcattgcaacctccacctcctgggttgaagccattctcctgcctcagcctcccgagtagctgggtttacagacgcctgcctcacgcccagctaatttttttctatttttggtagagacggagtttcatcatgttggccaggctagtctttttttttttttttttttttgagacggagtctcgctctgtcacccaggctggagtgcagtggtgcgatccggctcacttgaagctccgcctcctgggttcatgccattctcctgcctcagcctctctagtagctgggactacaggcgcccgccaccacgcccagctaattttttgtatttttagtagagacggggtttcaccgtgttagccaggatggtctcgatctcctgacctcatgatctgcccgcctcagcctcccaaagtactgggattacaggcgtgagcaaccgtgcccggctggccatgctagtcttgaattcctgacgtcgtgatccccccacttcggcctcccaaagtgctgggattacaggcgtgagccaccgcccccagccccatttctcttttctattctggacatttgtttaatgaaataactcagtagcagagatactaatatgcatcctaccagtgttgttggataagtgtaaaagtgcttttaaattttaaagcattttaaaaatagaataaaagcactttgagccctctagagaatggtgtcatctgaggaaaaaaatgtttaaatcttaaatttttagacaggaaacaaatttacctatctaattttctcattttacagttgaattaaagcccagagatagtgtgacatgttcaagttcacacagttacatatcttgaactagatatgagatctctagataccttgttcagttccctttctagtatagcattcaactctgaggaattcctaaataatgatttttttttggggggggtctctttaggaattcctaaataataattttaaatgaaaacttttctttttttttaacttaagatctttgaatttggctggagttagtatttcatcatttgtattctattctacttaattactgattaagagtctaaatttacagcctctgaaaccagatatccttggggaacaacttatatcctttgttatgtatatcagattcctactggtcttcatttgggaaatgatagaacatatttgataaattgatgcttttgtcattttaaattggcccaatagttaagttggcgcctgagttaagttcaggagacagaggaagatgcagaatgtcaggattcaaagaggatcttagcattttactttttttccttttctatactggatcttgtgtccaaagtaaagtgaaatgtcctacttagacctagtggtagagcctaagatagaatttagaccttctgactcctaatttatgtatttttcactgagcaacactatttcaaaattcccctctgaatattgccttgttttcctaacatcagtgtctagtctggttttgggcatcgcttacagcttgggtttgcgccagggaagactaggaaatggagttggggaatatttgttgtagagctaatgagccctattctttggtctgcccagataggtcaggtttggtctaaaactattctgggactctggacatcactgtgccctacatgatgattctggaacccacttttgtgggttaagcctacattggaaaatttatgtgggcagtgggtggggtcgtggggtattttccttctaacactcgaaactttttgaggtatgtccaatagaatctgccaagccactcagaacattcatatggagactaaaatctggctaagattgaaactgtctttgttgagttggtttctttagagccttaaagttttcaaactcatttttacctgtgtttttaaaatacgaattgtaaattcacattactgcacaattttttttatgctgtgggatgtttttagagaggtaagtgagcttttaaactaaaattgtttcatttatggaatattttgaagaagtaaaacagaaatctttttatttatttatttatttatttatttatttatttttgagacacagttatactcttattgcccaggctggagtgcaatggcacaatatctgctcactgcaacctccgcctcccgggttcaagcaattatcctctctcagcctcctgagtagctggaattacaggcacatgccaccatgcccggctaatttttgtatttttagtagagatggggtttcatcgtattggtcaggctggcctcgaacttctgacctcaggtgattctcctgccttggcctcccaaagtgctcacaggcatgagctaccgtgccggccaggaatcttttatgtgcaacgttgtcagctgttaatgctcctatttatgaataggtcacctttgtttgaaaaaagcgtacaaggttttctaactccaaatctttccagccacaatattgctacgttaagcagaactgtcaaagataaaacttgaaccaaagtgattttctagactgtttgaatgttaaccctttcctgcaatattggttaacagtcacgtctccctacctcttcatacctccttggttttattttattatttttattttttgaggcacggtcttgccctgttgcccttgctggagtgtggtggcatgaacacagttcactgcaacgtcaacctctgggcttaagtgatcctaccacctcagcctcctgagcagctgggagtagtcccacttgtagtccctacagtcccacctgtagtcctgtagtcccacctttgtattttttgtagagatggggtttaaccatattgtccaggctggctttgaactcctgagctcaagtgatccacctgctttgacctcacaaagtgctgggcctcccaaaatgctgggattacaggcatgagccgctgtgcccagccacatccttggttttaaattgttatttaaaaaatactgttgctgggcacggtggcacatgcctataatctcagcactccgggaggccgaggtgggaggatcactttgaggccaggagttcaaggccagcctgggcaatatgataaaaccccgtctctacaaaaaatacgaaaatttgcagggtatgatggtattgtgcctgtagtcccagctacttcagaagctgagtcaggaggatcccttgatcctgtaatgaaatatactatttttttttttttgagatggagttttgctcttgctgcccaggctggagtgcagtggcgccatcttggctcaccgcaacctccacttcccaggttcaagcaattcacctgacacagcctccctagtagctgggattacaagcgtgtgccaccacacctggctgattttgcatttttagtagagatggggtttctccatgttggtcaggctggtctcgaacccagcctcagcttacccacccacctcggcctcccaaagtgctgggattataggcacaagccaccacgcctggccatgaaatatactactaataaaataaaatactgtgataaaacataaataaacatttttattttttactttttacttttttagctggcattctggtctgagattattttattttatttttattttattcgagacagagtctcgctctgtcacccaggctggagtgcagtggcacaatctcagctcaccgcaacctccgcctcccggattcaagcaattctccctgcctcagcctcccgagtagctgggattacaggtgcccaccaccacgccctgccaatttttgtatttttagtagagacggggtttcacaatgttggcaaggctggtcttgaactcctgacctcaggtgatccacccaccttggcctcccaaaatgctgggactacaggtgtgagccactgtgcccggcagagatttttattttttaaatggcaaagctaggttatgaacaggatgaccatatgttccagtttgcccaggacaattctggatcatgcctgttatcctgacattattatttattattattttttcttttgtagacacagggtcttgctctgctgcccagctggagtgcagtagtgcaatcatggctcactgtaaccttgaaatcctgggctcaagtgatcctcccacctcagccctccagagaggctgggactataaacacacaccaccatgcctggctatattttgtgtgtgtgtgtgtgtgtgtgtgtgtgtgtgtgtgtgtgtgtcaggggggtgggtaaagatggggtcttgccatgttgcccaggctggtcttgaacctcctggcctcaaactcttggtcaagtgatcctcccgcctcagccacctaaagtgctgggattataggcatgagccattgtccccggctatcctgacacaattattaatagacacataaatgtgtctcatttactctcaaaagtgtcccatttggataataaattatctggtcacctacatatgcattacaatcattttgttgtactaggttttgtttgttgaaatgttatttgaactaggaccataagataatggaattttggcctattttgggtacatttggatgtttttcattggtcagacatttttattgtatggagagttctgagtgtacaaatgtatattaaatagtaatgcacatgatttgaaattagggattatttgttatcttacttttgggaggttacataaccttgaggaacctcttgtttcctcatccgttaaaaagagataatagcgatacctatcctacatgggtgttttgaagatattaaagaggtgacataccaaaaaatgcattttaagttgaaaattgttatataagtgttagtcatgtcacacatgtgcctttctgcaattgaatttaaaatgaataattttacctagtttggggaacttactatttgatagagcactggtagtgttttgctgtaaaggagagcagggaaataatggtagttggaagtacatgctgggctaaggttttctgcggggaggttttgaaattttcacatttgtgtgctgaaaagagtggtccaatagaaagcagaaaaaatagatgatgcttgacagaaggaagaaatcaatgttgagtaggaaagaaggatagaatctagaatacatatggaaggattggctttacgtaaccaagaaacacatttccctagtctgttcactttaaaaaaaaatgccaacaatataatttttttttttttttgaagcagagtcgtcggccgggcgcggtggctcacgcctgtaatcccagcactttgggaggccgaggcgggtagatcacgaggtcaggagatcgagactatcctggctaacacagtgaaaccccgtctctactaaaaatacaaaaaaaaaattagccaggcgtggtagcgggcgcctgtagtcccagctactcgggaggctgaggcaggagaatgccgtgaacccgggaggcggagcttgcaagtgagccgagatcgtgccagtgcagtgcagcctgggcgacaaagcgagactccgtctcaaaaagaaaaaaaaaaaaaaaaaaaaaaagaaacagatcctccctctgttgcccaggctggagtgcagctgcccgatctcggctcactgcaacctacctctcctggggtcaagggattcttctgcctcagccccctgagtagctgggattacaggtgcgccccaccgtgccaggctaatttttgtatatttttgtagagatggagtttcaccatgtcggccaggctgctctggaactcctgacctcaagtgatctgcctacctcggcctcccaaagtgctgggattacaggcgttagccactgtgcctggctctctcagtataatttacctaaagtcaaatcagccttccctttccttcccttcccttcccttcccttcctttcccttcccctcctttcccttccccttccgcctttcccctttcccttctcccttctcccctttcccttctcctttcctttccacagggtcttactttgtcgcccgggcttgagtgcaatggggcaaacacgtctcactgcaaccttgacctccccagcccaagccatctacttgcctcagtcccccaagtagctggggctacaggtgtgcaccaccacgcctggctattttttttgtattttttgtaacaatgccgggggagtggggtgggggtggggtcttgctatgttgcccagggtggtcttgaactcctgagcccaagtgatccacccacctcggccttccaaagtgctgggattacaggtgtgagccactgtgcctgatccagcctctttttaattaattctgtcccccttctcacccaggcaaccacttttggacttcttttactatagatgttagttctgcctgttctagaacttcacataaatggaatcatacagcaaggagtattttgtgtctgattacttttgttcaatataatattttttagattcacccattttggtgtgtgtatcagtagtttttcccttttattgtgaagtaatattccattatatgtatgtagcaacaagtcttctattgatgggctttgggttatttccagtttttggttactatgagtaaagttgctatgaacatttttgtatatatctttatgtggacttgggtaaatatctaggagtgaaattgctgtgtactagggtagatttatgtttaactttagaaaccactaaacttttccaaaatggaaaatttaacactttttacattcccaccagttttttttttatgagagttcagttttccacattcttcacaatgtttggcattttaaaatttaggcattctcctgagtgtgtacttgtatttcatcatggtttttgtttatatttccttgatggctaatatgtgattattggccatttgcttatcttttattttgaagtgtcaattcatttctgaaatattatcactgaataatatttcattgtatagatatgccacaatttatccatttatcacttgatagatatttggattattttcacttttgggctattatgaacaatggtgctataaacatttatgtacaagtttttattaaacttttatgtgcaaccctattttattgggttgtctttttgttgctgatttgtaggagttctctttatatctgaatgcaggttatttgccaggtttctcagattttacacgcacatacacacacacacacactctttctctctctctctctaaatattttctcctggtctgagctatgttgttgcattttcttaatgccttttgagagcagaacttttaagttttgagcaagttgaatttgttgatttattttattttatggtattaccttttctgttctaagaagtctttccttactctctgctaggcttgtgaaactattctctcatggtttttttctagaagctttatgtttttgtcttttgtatttaggcctatgatctatcttaaactactcttttgctatcatgtaagggtttctcaaaaggattttcaattaattgattagatagctgtgggtcttttcttggatttgttctattctgttgatttatttgtatcttcttatgtcaatgccacactgtcttaattattgtagctttataagattggtattgttactttaaattttgatagaattaatcagtgcagccgtgtgggcctggagtgtttttgtgggaaaaagcagaaggttttaaattagtgtaattacttttacaggtttaattactttagctgatatataagcattcaggttcttcactttttcctgtggcagttttaagaagttgaatttttaaatgaatttattctcaattgttgagttgttataaagttcataaaatttcctaatattctgttattgcctgtatgaactgctgtatgtctccatttgcattcttgatgttggtacttcttttgaatttttggatcagttttgctaggggtttagcaattaatcttttcaaaaacccagattttgttttgttgaatttctattttggacatgtatttttaatttttttttttttttttttttttgagacggggtcttgctttgtcacccaggctggagtgcagtggcgcgatcttggctcactgcaagctccgcctcccgggttcacaccattctcctgcctcagcctcccgagtagcagggactaccggcacccgccaccacacccggctaattttttttgtgtgtttttagcagagacggggtttcaccgtgttagccaggatggtctccatctcctgacctcgtgacctgcctgcctcggcctctcaaagtgctggtattaggggcatgagccactgcgcccggccaccttgctctcctcttgtggatttgatttgctctcttttttctaccttttttgagttagaagtttagattattgtttttaaacctttcttgttttctaatgtgcatttcatttcattcattcattcatacattcattcagagacggagtcttgctctgttgcccaggctggagtgcagtggtacgatcttcgtttactgcaaccttcgcctcccaggttcaagcgattcttctgcctcaggctcccgagtagctgggactataggcgtgcaccaccacgccaggctgatttttgtatttttagtagagacggggttttaccatgttggccaggctggtctctaactcctgacctcgtgatccgcccaccttggccccccaaagtgccaccgctcccagccacatttctttcattattattattttttctttgctaacccctagtagtcattctaatgtacatttcttatataattaacattttcttctaagtactcctttagctgcagcatacaatttcgatgtgttcaattcaaatttctatttccattgtgatttttctggtccacaggtcatttagaagtttattgtttcttaatatttggggattttttagctattttcaattttacatggtgttcagggaatgcgttgttgacatattgtgtacatatctgtaccatatatctgtaaatgataagttgtttatcattttaatcctttgatagctactgagattagttttaaggcctaccctgtggtggtctgttttggtgaatgttacctgtgtctctaattccgctctgcaatattttgaggttttcagtgtagatattttatgtatcttttattaaatacggtgtatactgcagttattgaatttagtgttctataatttatcaattaggtcagatagttttatgtgtttgttactatataactgagatataattcagctactgtaaaatgcaccacttaaaaattgcacagctcagtagttttcagtatattcacaaggttgtacagccatcggcactatttaattccagaacgtttttgtcccccaaaatgaaaacccatacccgttagcagttactcttcatgtctccctaacctctaacccctggcaaccactaatctaccttgtccctacaaatttgcctattctgaacatttcctaagtggaatcatataatatttggccttttgtagctggcttttttttttaactaagtatgttttcaaagttcatacatgttgtagcgtgtatcagtatttcattctttcttatgactgaaataatatttcattgtatagatatgccccaatttatccatttatcacttgagagatatatgggttattttcacttttgggctgctatgaataatggtgctataaacattcatctacaagtttttgtggtgttctatttttctatttcccctaagggtagaattgctggggcatgtggtaattttatgtttactttttgagcaactgccaaactattttccaaagcggctgaatcactttataatttgcaacagcaatgtatgaagattccagtttctccacattcttgtcaatacttgttactgttctagtcttcgctgagaggctctgtgtgcttgttggagcacactttcagcactcaaccaggctttcagttcatccatagccttgacttcctgttttgccgagcttcatgctcagtcagtggtgattgcttagggccttctcaggtctttcttgagtatgcccataggcctgggcacactgttttcatcttccagggtcttaggaatttcagaacttttcaaaactccctatggacatctcattctcctacttttccttttgtgttttttggttagcttgtttgccccagctgcttcagggagctgaaatgttaagcaattgtagctgattgtttttgacaaataaataccttgggggaaaagcctgttagcaatgggcaagctctgaatcaggttaaatattaggaagtcttgggagtggggtttttcagggaattgctagtcagctcaaataataactgtactctgaaaatgggactttgaaggaactctagccctgttctgtcacctccactggctgctaggctccaggattccacagattgtggtttgctgcttttcagggctagcctggagctgggaagaggggcatgggaataaggcatgttaaaatgccacaaagcttgctattcttactgagatgcagccatctttttttgaataaatgctccttggattgttgcaaactttttggttaatattcagagttctgaaaaaggctatttttgactttttttttttttttttgagatgcagtcttgcattgtcgcccaggctgaagtgcaatggtgtaattttggctcactgcaacctctgcctcccaggttcaaacgattcccctgcttcagcctctggagtatctgggattataggcacctgccaccatgcccagctaatttttgtatttttagtagcgacggggtttcaccaggttggccaggctggtctcgaactcctgaccttgtgatctgcccgccttggccttccaaagtgctgggattacaggtgtgagccactatgcccggcccaagtcttgacatttttttgccagtgttcttgttggttttatggaagagaggatttttggaggtccttactctgccattcccaatgatgtcacccaatttgttttttaagcattaaaaaaaattattttaaaatataaagacagggtctcactatgtcaattaaaaagacagggtctcgcccaggctggtctcgaactcttgggctcaagtgattgtcctgccttggcctcccaaagtgctgagactacaggtgtgagccaccacacctggcctaaacatttttaatatatctgtttttatatcctgttcctcccttttcttttgaaatacaactcacagaaattgcaaaaatagtacagaaagttcctgtgcaccattcactcaacttcccccaatgatatatcttttataactatagtgtgttaccaaaaccaggaagctgatttcggtgttatacaatagtattaaattaactatagacgttattagaatttcacgggtttttgtatatactgtttttaattgaggaggtggtggtgtatagttctataaagttttatcatgtccagattcatgtagctattaccacattcagggtattaaactattctgttaccacaaagaaatttcttcatattatttctttatggttatgcttttctctgaaccctaacccctggcaactactgatctgatttccatcactgtaattttgtaacttcgagagtgttatataaatggaatcatatagtaggtaacccgtagatacggcttttttctcacttagcacaatgcctttgagatccgtttaagttgttgtgtgtgtcatagttcattcctttttattgtttctcttttatgggtgtaccatagtttgtttacctatttacttgttgaaggacatttattatgtttccagatttttaccatttttttttctttttctttcttttatttgttttttttgagacagagtcttgctctgtcacccaggctggagtgcagtgccgcgatcttggctcaccacaacctccgcctcccgggttcaagtgatttttctgcctcagcctcctgagtagctgggattacaggcgcacactaccacacccagctaatttttctgtttttagtagaagcaagttttcactatgttggtcaggctagtctcgaactcctgaccttgtgatccgcccgcctcggcctcccaaagtgctgggattacaggcgtgagccactgcacctggcccattttttttttttttcaaacagatatggttttgctctctctgtcactcaggccagagtgtattggcatgatcattgcacactacagtcctcctgggcttaaagaattctcccacctcagcttcctgaggaactaggagtagagacatgcacaactgcacccagctagtaattttaatttttgtagagatgaggtcttactatgttgcccaggctggtcttgagctctggcctcaagtgatcctcctacctcagcctcccaaagtgctgggattacaggtgtgagccaccatggctggcctagtgttttacaaataaatctgttaggaacatttgtgtacagatttctctgtgtacttaagtttttcttcctctgggataaatgctgtgtagtgtgattctttaatttttggtgtgtctgcctgttttactaattactgaaagaagggtgctaaactaagattatgtatttgcctatttcttttgtttctaagtttttaaaaaagtattttgaagccattttatttggtgtgtacatattttgtattgttacctttagcatttcttttcttgatgatttgacctattttcatgaaatccctttgtatctggtgatactctgtattttaaagcttaccttgtctgtgtcttaatatagccactgtatagtgtctatatagtgtcttaatatagccactgtaatttatgattagtgttttctttttttttcttttttttattatactttaagttttaaggtacatgtgcacaacatgcaggtttgttacatatgtatacatgtgccatgttggtgtgctgcacccattaactcgtcatttaacattaggtatatctcctaatgctatccctccctcctcccgcctccccccaccccagtgtgattagtgttttcatggtgtgtctttttgctaactttttattttcaaaacttctttgtctttataaaagtgtatcttgtgctaggcatgctggctcatgcctgtaatcctagaacctagggaggctgaggcagaagtatagcttgagcccaagagtttgagatgagcctgggcaacagagggagacccagtctctattaaaaagaaaaaaattaactgggtatggtggctatagtcccaacttattgggaggctgaggtgggagagcttgggaggttgagcctgcagtgagctgtgattgcaccactgccctccagcctgggcaacagaacaggagcctgtctcaaaaaaagaaagaaacaaaagatcagaacctataatcacagaatcactgaaaacccatggaattatcatatgctagccattgggaatacaaatgtaaatgagatttcaaaaaaatctttaccctttgttgtctaggtggttaagatcagttgattgagataaagttcaaagcaacccctaaaatcaactaaaaagttcatcaaaggacttttagaactgagcaggagggaatgaataaatctttgggagggagggatgcagtgccttgatatacagtaccaggagccattttctacattgttaacagcactcttgagtgatgttggtggcagcttgtatatcttatgtggaagcccttgggtaggagtcgatcaggaaaaacttcccaagacaggtagcatacagggaattttaaaaagatgaatgggagtttgccaggcaaaggaagcaggagaagaactttacaagcagagtcttattcaaagaacagtaaggcattatgattaaaatagtttgtatatattagaatggtgagaggtaaggttaaagaattactgaattttgattatcttagtgtgcacatttcttcccattttaacaactctgaaattggcatacatcttacaactgattgtgttttgcatcaccattggaaattgggattattttatgaataatggcatcttagatatgatgaaatatggtaagtttgagtagattcaatgtcctttaagttatgcttttggattttatcctattaataatcagaagctaggtagattttaagtagaaaaatattatgtctagaattgtttaaaataatatgattttggtgatattgtgcaggatttattgtggctaaaacaattgctaacaatgtagaaattcaggcaatgtctgcagagggcctagtgctagtgggtgtattgtgggaaatccaggtacaggaagcgtttgataaaaccaagatgatgtcgttactagtaagatggggctagttgacgtagagagaagagtcatataaagctgaggtttctggatttaaagagaagatgactggtgtaacagttaaaggcagtcattgttagtgtttattctggcatcataattaaatgtttctattactgagagggctaatcaacattcaaacattaatatatcaatagccaagaaaagattttctcaggaactcttactgtaaaatatatgtcagtataaaatttgttgactgtccaataaaataataattatagtgtaggtttatgttggctgcaagcctaaattatgagacatttataaaattactgaccgctcccccccccaaaaaaaaaagattgttcagaatctctcatcctagcatccattccaagaaaaagatattgctaacatttggaataaaaagtaatcccagtacgggttagtcatagtttttggctatagactaaacctcatcttgttcacattctagtagaacaagataaaaacaaatgcttattcatatagtatgttcatcatttaagaaggtcatagtatttactggcctggacactagtttatatgtgtttgtatttaagaaactagccattataatctcaattatgtgcagtgaaggagagagaaacgtgacatgagcaaagttttatttgcttttgaaaataattgtatcttttttacttaacttactatttcaagatatcttttatatgctactttatttaattaatttgtttttaagacagggtcttattctgtcacccagggctggagtgcaatggtgcaattacagcttactgcaacctcgaccttccaggcttaagcgatcctcccacctcagcctccctggtagctgggattatgggtgtgcaccaccatgcctggctcaattttttatatttttctttttctttctttctttctttctttctttttcttttctttcttttttttttttttttttttgaggtagtagcatactcatggctcactgtagcctcaacctcctgggctcaaggattcttccacctcagcttccctagtaactggggctataggcacatgccaccacacgcggctaatttttgtattttttgtagagatggagtctcgccatgttgcccaggctggtcttgaactcctgtgcagaggcaatgcgcccgcctcagcctcccaaagtgctgagattacaggtgtgagccactgtgcccagccaattttttgtagagatggagttttggcatgttgccctggctggccttgaactcctggactcaaaccatctacatgcctcagcctcccaaagtgctgggattacaggtgtgagccaccacgtccagcctgtgctaatttaaattattttctcctcactgctgtactagccacaacttctgcaaccagtttcatgtgggctttggacaattgcagcctaacagcatcactcatcagggtctatgttgcatacgttctcccttggggaactgtaatgttaagattaggctgggtgcggtggctcacacctgtaatcccagcactttgggaggccaaggagggcagatcacgaggtcaagagatggagaccatcctggccaacatggtaaaaccccatctctactaaaaatacagaaattagctgggcatagtggtgcgtgcctgtaatcccagctacttgggaggctgaggcaggagaatcgcttgaacctgggaggcggagtttgcagtgaaccgagattgcgctactgcattccagcctggtgacagagcgagattctgtctcaaaaaaaagaaaatgagcactaataatcttttctatattacagttttataataaaaatgcattacatattaaacagattcacaaagtgaactaatgacaatttacgtctgtccctatactttcagttgtaagtaactaaaaaccagcctcaaatggaaataaacaaaactaccgacatatgtaattgaaaagtccagatacctgggtgatgaaataacctgtacaacaaacccccatgacacaagtttacctatgtaacagacctgcacttgtacccctttacttaaaaaagcaaaacaaaacaacagaaaagttcagatggagtataggtttcaggtaaagctttattaggtggtccaacaacttcattaatgacctggtttctttcagttttcgcactctgctttctgtggtgttaaatttatcccaaggcagccacattgaagccattaggtttttaaggcttctagcaccttcttcatttatatctattagggaaaaatatgttctgtatctgagcatcatagaaaaaaatcttgggttcattctgattttcctggcttaggttacatgccagtctctgaactgattactaaggctagagaaatatattgtgctgattggcttaggtttgccccagggatcaattccacccaaattccattcttgagtgaggaaatttggggtaaaagagggaggatagcaaggaaaagatgacagacacacaattccagtttattataagaatgacttcaaatgaccttaactgaattgtaatattatttgggaacaagtcaaacattattaacatttaggcccagagatggtagatggcttgcttaagtctcccagcaagctacctcaagaactgagacttgggctgggcgtggtagctcacacctgtaatcccagcactttgggaggcccaaggcgggtggatcatttgaagccaggggttcgaaaccagcctggccaacatggtgaaaccccatttctactacaaatataaaaattagccaggcgtggtggtgggcacctgtaatcccagctactcagcaggctgaggaaggaattgcttgagcccatgaggcagaggttgcagtgagcagagatcatgccattgcactccagcctgggtgacagagagagactccgtctaaaaaaaaaaaaaagaaaaaaaaaaagaactgagactcagaagtgaattatttgactcttgaattgtacttcattcttagaatcaattattggcctctctgtaagactgtctttactgagtttttaaacggagtataataaactcttttgggaatgcggtagatgttcaaaggtttgacttcttaaaaagaggtgtaacaattatattccttaaaactgagaggggaccaattgagggtagagggattgatgtgggggcaggaggatacttttttgttgttattgtgatgaaaatgttccatagttttgtggttatatgactgtatacattgaactggatgcttacaaacggtgataaaaagggtgaaggaaaataaaaaaccaagtagcccaataacactgctcatccttgtttttttgttttgttttgttttttaaataacaagttctaggagtttttgtttgaataagaatatataaatcaggcagagtagtcccagtgaaatcatggttagattttactgtatttgtctgttgatccttcaccttctaagcacttaaaatacttttttattagacttgctttgatcacatatgcaatttaagtgtgaataagtaagtgtattatctttccctcctccactcagctttctttaaatagaaaagggacaaatatctctttattgcatattcagccatagttgctcaatctatggtgttaataagagactgtaattttatcttctaaaaatcattacagattataattataggctgtacctcattctcttaaagaaatattggcatgttagtccattgatattactgatagttgccaaatggtgagaatggtaactggtttggaggcaactgaaagggagggggaatcatcagtaaactggagaccaataaaaaattacacagaaacaaatctttttggataaactagatgaatgtctcttattgagactgatccaacagtattcactggcccatttcttgctgctagatgagcttctgtttaaggcatcacttgtggtggagttctttcttttatttggattggaaccatactgtgatctcttatggaaaacagacttcctccaagtctgttaaatataatttaaaattatatcgtttcttgttgatttgtttgtttttgttttgctttatttcatgttataggcatctgaaatgaatccttatatatataacatacaagtatatgtatgagaagacatgaatataagaagtataggaaacataagacatgaataaaagttttagctagacatttttagatgaaaagatgtgcatttaaatttgtaaaagttacaaatcgttctataaaaagttagcatatatttaaattttttggatacataataagagaattatatcacttctgatatccattgtgaagaccctaccacagtcatttttttgtgaagggtagatagggctcttgcttgtactcttccaggatgtgccacgggctccctaataacattcaggggagtgcatgtgcaggtttgttacatgggtatatcatatgatactgaagtttggttttgtaatgatccccatcgtctaagtagtgaacatagtaaccaataggtagtttttgagcccttgctttcctgtctccctccctgattttggaatctccagtgtcttttgtcccgacatctttgtgtctctgcgtacccagtgtttagcttccacttataagtgaaaacatgtgatatttggctttctgtttctatgttaattcacttaggataattcagctgcatccatattgctgtaaaggacatgatttcgttctttttttatggctgcatagtattccatggtgtatatgtattgaattttctttatccattctaccattgatgggcacctaagttgattccatgtctttgctattgtgaagagtgctgtaataaacatatccctttttggtagaatgattcattttttttcattttttttattttttaggcagagtctcgctctgtcgcccaggctggagcgcagtggcacgatctcgactcactgcaacctccacctcctgggttcaagtgattctcctgcatcagcctcctgagtagctgggactacaggtgctcgccactacacctggctaatttttgtattttttatacagatggggtttcaccttgttggtcaggatggtcttgatctgctgacctcatgatccacccacctcggcctcccaaagtgctgggattacaggtgtgaaccaccgtgcccagcctagaatgattcatttttctttgggtatatacccataatgagattgctgggtcggatggtaattatattttaagttttttgagagatctttaaacttcttttcacaggggctaacctaatttgcattcccatcagcagtttataagtattaccttttctctgcaaccttgacaccatctgtttttttttttttttttttttgactctttagtaatagttattctgggctgggcacagtggctcacacctgtaatcccagcattttgggaggctaaggcaggtggatgtgctgaggtcaggagttcgagaccagcctggccaacatggtgaaaccccatctctactaaaaatacaaaaattagccaggcatggtggcaggcacctttaatcccagctactcaggaggctgaggcaggagaatcacttgaacctgggaggtggaggttgcagtgagctgagattgcaccattgcactccggcctgggcgacaagagcgaaactccgtgtccaaaaaaaaaaaaaaaaaataggtattctcattggtgtgagatggtgtctcattgtagttttgatttgcatctttctctgataatcatctttttttctaaatgtctttatgctacctctaaaatgttctacgtataataggcaaatcaaatgtttaataaactggtgtgttaggtttattttcaggttgaaatgaagatagttatttttattttgtgtaccttttacatatcaacttacttttagaagtatttctaacttgtgttttgtgtttttttagagaaaatattctctttggaatgggaaatcctctgcttgacatctctgctgtagtggacaaagatttccttgataagtaagtattaaactcttcatatgcactatgtggaacttacatttgaagaagaatggatgaaaactttagaagtgaatttaccaccgaatgtcttcaattaaaggaaaactcaggaaatttaagtttggtgatagcaagtgtgctatcattaactattgaataactgagtacagttttccttgggaaaacttatatacattgctatttttacttaaaacttttttgcttattatttggaaggagaaaagtttatataatttacctaattatttaattccccaacttttaaactactgtcagtgagctacgtctataatggtatcataatctacagacattctaccccgaatgtgcccagtctggtttcctctcagaagctataatgggagaagaaagatgattagagaagacaagagaacgtgcaggatataattcagaggatatgaagctctgctgtttccgctttattagtaacttccaatgtttcaacttagctgagaaatcagtttgtttatttacctaagtatttgaggccatttcgtacaatagtccccacttgtgtccttgttttcagtttctgaggtctcagttacccataggacagtgtaataagacattttgagagagagacatgcaccacgtccacataacttttattacagtatattttaatagttgttctatttttagttagttgttgttaatctcttattgtgcctaatttataaatgaaactttatcatagtatgatgtgtaggtatgtatgtgtaggaaaaacagtgtgtgtgtgtttgtgtgtgtgtgtatatgtatgtatgtatgtatgtatgtatgtatgtatctatctatctatctatctatctatctatctatctatctatctatctatctatatatggttcagtactatccatggtttcagatacccactggtcatcttacaatgcatctacctcggataacgggggcactactatatggcaaatttaagtagtaaaaaagattaatgatgagaaagcaagatcccccctctcctcacacaccctgatttctgtacccaagagtaattactttttaaaaaattgaggcaaaatttatatcgcataaaattgatcgttttaaccattataaagtatacaattcagtgactgccagtatattcacaaagttgtacaaccatcaccactatctaattcaggacattttcatcaccccaaaatgaaatcccatacccagtaagtagtcattcgctattccctcctctaacccagtctcctgggaactactagtatacttagtttttctatgaatttgtctattctgagcattttatagaaatggaatcatataataatatatgatcttttgtgtttatatatatgaccttttgtgtttgggcttattttacttatgtaatgctttcaaggttcatccatgttgtagcatgtatcagtccttcattccttttaatagtggactattccattgtgtggatagaccacattttgtttatccattcattggttgatggacacttatgttgtttttattttttgtctattaggaacaatgcttcttatgaatattcatgtataagcttttgtgtaggaatgtgttttcatttctcttgggtatacacataggagtggaactgctgggtcacatggtaattctgtgtttaacttctagagaaaccaccaaactgttttccaaagcagctgcactgttttgcattcctaccggcagtgcataagtgttccagtttctctacgtctttgccaaagcttattttttattttttaaattatagccatatgagtgggtgtgaaatgatgtctcattgtgattttgatttgcatttttctattgaaaacttttgatgttagcatcttttcatatgcttattggatatttgtatatctttgggaaaatgttgaagctctttgcccattttttaattgggtcgttgtctttttgttaagttgtaaaagttctttttatattctggatactagaccctatcagctagcatatgatttgcaaacattttctcccattctggggatttactttaattttttgatagtatcctttgatgcacaaaagttttaaattttgatgatgtccattttatttttcttttgttgcttatgcttttgctgtcatatgtaagaatctattgttaaatccaggatcacaaagatttgtgcctgtgttttcttctaagagttttgtagtttaaggtcttagatttaggcatttgatcaattttgagttaatttttgtataaggtatgaaataagggttcaactttattcttttgtgtgtggaaatccaattgtctcaacatcatttgttgaagagactattcttttccccactgaatgatcttgatactcttgacaaaatcaggtgaccatagatatatgggtaaatttctggactccattctattccattgatacatatgtctgtccttatgccagtatgacattggtgtttttgtgtatgtgtgttttgttttttgttttttttttggagacagggtcttgctctgtcacccaggatggggtgcagtgatgcaatcatagctcactgaaaccttgaactcctgggttcaagtgatccttctatttcagcctcccaagtaactgagactatatgcaggtaccaccatccctagctattttaaatttttttttgtataaacagggtctccttatgatgcccaggctggtctcaaactcaagtctggcttgatcctaggcccaagttgtcttcccaccttggcctcccaaagtgctgggattataggcattagccaccatacctggcctgtacgacactgttttgattactgtagctttgtagtaaattttgaagtcaggaagtgtcagtcctccaactttgtttttcaagattattattattattattattaatttttaatttgagatccctcacaattccatatgaatttttggggatagctttttcatttctgtaaaaaaggcagttggaattttgattggaattacattgaatgtatagataaatacatgattaagtcttccgagttatgaagacagaatgtctttccatttatttaggtcttttttttttttttttttttttggagacagaatcttgctctgttgtccaggctggagtgcagtggcatgatctcagctcactgcaatctccatttcccgggttgaagcgattctactgcctcagcctcctgagtagctgggattacaggtgtgtgccatcatgcctggctaatttttgtatttttagtagagacagggtttcaccatgttggtcaggcttgtctcaaactcctgaccttgtgatccacccgtcttggcctcccaaagttatgggattataggtgtaagccactgtgcctagccttaggtctttttaaaataattttagcagtgtttagtaggttttcagtgcataagtcttatacttctttggttaaatttaattttattatttttgatgccattgtaaattgggattgttttattttcttattgttcattgatagtatgtagaaatataagtaattatgggggacaataatttttttgaaacttttttttatatcctggggattacccctgtaagtatatttggctaaactcaaatgtcaaagggtaaggcaagaatttataaatgtgtaaatttgacttacggtaatataataggaaatgtgctgggggtctaggataaactgggagatgtgttttatcctaagacattcagatagaaactttaaaacacactttcccagtcagaaaatactactatatacagttactttaatgattttagttcttttggttaccttgtacttttaaataatatactatacttacatttcttaaaatttctttttctgtcaaatttcaggctgggcgtggtggctcacgcctgtaattccagcacttttggaggctgaggcaggtgaatcacttgaggtcaggagttcaagtcatgccaacatggcaaaaccctgtgtctactaaaaataccaaaaattagccaggtgtgatggcacgcacctgtagtcccagttactcgggtggctgaggcaggagaattgcttgaacccgggaggcagaggttgcagtgagctgaaattgcaccattgcactccaacctgggtgacagagttgacactctgtctcaaaaaaaaaaaaaaaaaaaaaaaaaaaaattaaaccaagccaaaccacaccaaaacaaaaaaacccaaatttcaatggaatccattgacttctcattatggagaacgagattactggtgcccctattctttcctatgctacttcttctatctttctattctattaactgtgtttttaaggttgatgttttcattctgttatctatctataattgttttcccaactttgaatacaaattcataatgaaagttgaaaatgacttacccacattatcactctgtgtatcatttattgcagaattaagtagtgtaccaggaatgtagagcaggttaacatttgaaatgtaattagaagactgggcgtggtggctcacgcctgtaatcccagcactttgggaggctgaggtggatggatcacttgaggtcaggagtttgagaccagcctggccaatagggcaaaattccgtctctattaaaaatacaaaaattaactgggcatggtggtgtgtgcctgtaatcccagatactcgggaggctgaggcaggagaatcgggtgaacctgggaggcggaggttgcagtaagctgagattgcaccactgcactccagccagtgtgacagcctgagaatctgtctcaaaaaaaaaaaaaaaaaaaagaaatgtaattagagtaattcactatagtaagaaactaacataacagtctaagaaaactccatataattatctcaatagacaaagaaaaaccttttgacaaaatctaatatctattcctgatgaaaaaaaataacttaaagcaacctaggtaactatgtcgataactttcttaaccctataaaggttacgttaggggaaaactggtagtgtgatgcttatatgggtatataacgtatcaaattgtatactttaaatgtctacagtttattgtatgtcagttatatatcaaaggctgtaataaacagaaaataaaatcagttggacatgaattcatgggtttaaaattagatctcttttgtttgtgtagtgtgagatattttgttcaggaagtcaactaattcatggtcactattttaaaaaaatcatgatgtataaaagtaaagagcaacttaaaaatttgaaattttatcgtgtatttcaaaagtaaaataaagtatagagacaaacccataaatgtagaacattttatatgggaagcaagaattgaaatttgggatatacacacagaccaggtggtctttgctatgtctgaagaagaaagataagattggaagttttataaaaaggtgaaatgttttgtattgttttgaaagaaagctcattggcactagttttggggaggtggcaagctttgattggtgagtgactgcagtgagtagaactagtcttttagagtcacagctcattgtttcagtagctactggataaaactgttttcagatgacaacaggcagtttcagcagccaggcttgcagagaattaccttcttggagcaatgttatgtgtgctgagtgctcttccccccagcctgtcacctgttttagtcagatatgacaagaatgacccaatttatatgattagctttcacacatatataatcagtgttgttattttggtgaacatgcctccagatgtttgttaggcatatataacctgaagatgaatgtttatgggctaatactatgtgtagtctttgttagtatgctgtttttcactcaacattatgtttttggatcactgtttttaaaatttcaggcaaatgtgatcagagtgattatgacttggcagctgtgtgatgatgtcacaggatccttagggtgtcgcttttccagccagaagccactgtggttggtggagcctttgcctgaggtttgcttgtgcctgccaggcttgttctgcttgtttggcctggcaggctgcgttcggctcatgctaccagcctggatcccacacctgccaagggcgagccaggtgcagagtggcgtggcaaagagtgtgtgagcaagcgaatatgggatctggccactgtgtacagccactcatgctggctgctgtggtggggtgggcatctccaggcactggcacaggtgctggcttcatgcaagcttgcggctggatctgatgcatctcaagtggcttccactgtaggaacccacgtctggacgaggataatatggtggtgcccagaagcttggagacaccagaaaccacagagccccaaagagagtgtcacagccctggattgggaaccccctaggtctgggctctcagaagggctgcagctcttctttccttcttgttgcctgcaaggtgctgagtggggtgaggcatattttagctctgtttgtgttacagctgtttcagtcctgccacttggtgggtcttcttatcctgcatccatgaacagtgaggtatggggacaactggagggtgagcaaggtggagaggagcttcattgagcaacagaacagctctcaggagacccgaagtgggtagctcctttctgcaggcaggtcgtcctgacaagtgttcacctctcagtgagatgagaccccgagggggtaactcctttccacagttggtagtcccaggtctcttctgtaagtctggctgagtccagggtttttaatgggcttcacaagggagaagtgtgtgctgattggtccatgggcggctatgggtgggtctggaaaaagcaccatgagtctcactcccctcagtggaccccacctggaactgatagcctggcccccatgcttcaggctgtccctggcttgaaggcagggcttcacctgaacccaccccttttttcccaggagagtgtctgcctcctgctgccatcaatcatgttgtccacagtgtgcaggctgttggtgatgagggtacttgctggccccattgagctgccctcagtcccaccttggcctccttcccatgcttctctgcacctaaagtccagagggggctgagggggcagggggctggtatgtcagtgctgccccgagcacatgcacacctgctgggttgtgacagtgcctgggcttggccacgactttgctccaccctggagcaggtgctgggatcgaggagaggccaggcatgggaacaggcacttctgagtctgcaggggaaagggggacttcccgggccccagagagtgcagggatacctgggtccacagccatggctgggtggctgcagctgcactcaggagggtggggctccagccctgccaacttggaagtgggtgtggctcccacctgttcccagctcccatgggctctgtggagcatgcagccctggctgcatctccccaattgtagccagtgtctttgcagcagctgctctagacagcctgctgctgccatcaatgacgctgctgggagctcgagtaacttctttgttttacatgttttactagcagctggtcctaagtggctagctgaagttctattttatatttggaaggttttaatctttaactttgattttcaaataagtacttgaagataaaaaacaagtctttggaccctaacaataaaagagtcttctctattgttactcctggctatttcttccaaatatatttaaaaacttaccttatgatataaacgaatcgtgtttagcctacattttgagccaccattagataagtatttagataagtactatgtatatatatattttttatttttttatttttttattttttatttttgagttggagtcttgctctgtcacccaagctgcagtgcagtggcgcaatctcagctcactgcaacctctgcctcccaggttcaagcgatcctcttgcctcagcttcccgagtagctggaactacaggcatgtgccaccatgcccggctaatttttgcagttttagtagagacagggtttcaccatgttggccagggtggtctcgaactcctgacctctggtgatctgcccacctcggtctcccaaagtgctgggattacaggcatgagccaccgcacccagcatagataagtggtatattgctatggtttgaatgatggtatcctctccaaaaattcatgttgaaacttatccccagtgtagcagtataagaagtgtgactcttgggggttgaccaagttatgaaggctctgctcttatgaatggggttagcacacttgtgaaaggactcaaggttgaagggagagctctcctgcctttacattccttctgtcatgtgaggacacagtgttcctcccctctggaggatgcagcaacaaggttccatgttagaagcagagaaaagcctcgccagacaccaatcttgctggtgccttaaccgtggatttcccagcctccaggaatgtgagaaatatatttctattgtttacaaattaccccaaacaaaataagaaaaataaaacaacaacaaaacataagtaagtaaataaataaatagcctggtctgtggtatttttgttatagcagcacaaggggaccaagacatataccaaatgaatgagatatatactgattagtatcttacactgtgaaagtgagttctaattgtcaaaattcatttgataaaatatttttctgattctgatttttttttttttagagacaagtttttctgtttcccagactggagtgcagtagcacaatcatagcctagtcactcactgcagcctcaaactcctgtccctcccaccaaaaaaagaattgaaagttattaggaacacctgtggcagaaagtacattattgaaaagaatcttttctagtaaactgtagggacacagtgggcatgaggggataggaaatgtggaacatatgaatacctccagttgagccctggtctgtaattatggaggtatgtattaatagggatgaaaaaggcagggaaggaatgtgtaaggtaggtttgccttggtttttcctgacactagataaatatgaaagtaagaggaatgagagaatgaatgaaatggtaattgagaaaggaaaaccatcagtagaaatgaaaatactcagttttggctgggcgcggtggctcacacctgtaatcccagcactttgggaggccgaggtgaacggatcacctgaggtcaggagttagagaccagcctggctaacaaggtgaaaccccatctctattgaaaataaaaaattagctgggtgtggtggcacacgcctgcagtcccagctactcaggaggctgaggcaggagaatcgcttgaacccaggagcggaggttgcagtgaaccgagattgcgccactgcactccagcctgggcgacagagtgagactccatctcaggaaaaaaaaaaaaaaaaaaaaatagaaaatactcagttttatgacaggagtagttgaggagacgtgtttttcttacagatctaaacctttaataaacatacaaaccttacatgagtttttattaatctgagtatgcatgaaagatgttacttaatgttcaaacctaaaatgcccgaagtagctggctgtggtggtgcttgcctgtagtgccagctacttgggaggctttagctgtagtgcatcatgattatgcctgtgaatagccactgcactccatcctaggcaatatagtgagaccctgtctctaaaaattaaaaaaaggaaaatgctcaaagtaattggccataaattttagtgctgattattcagtgccaataatttacaactgaattatttctataaataaaaatttatttcttctacaaatgggtgtatgttagctttgaaagtgaaaaaaatatttagtgtcaagtgagactgcatgtgttaggttaaaagctagacatttaattgttttgctttaaaatgaattgtaaactgctctgacacttttgtagttaattttttttttctttgagatgaagtttcactgtcgctcaggctggagtgcagtggcatgatctcagctcactgcaacctctgcctcccgggttcaagctattcttatgcctcagtctcctgagtagctgagattacaggcatgtgccaccatgcctggctaatttttgtatttttaatacagacggggtttcaccatgttgaccaggctggtctttaactcctgacctcaagtgatccacccacctcagcctcccaaagtgctgggattacaggtgtgagctaccgtgcccggtcttttaattaattctttataaagctattgccatatttttttctacagctttcaacattatgttttgtatatttaggtctttaattgacctgaatattctgtctgggattttgtttagtatttatggattaatttggaaaaaagagatctttaccaacaaattttcttatccttacaaatatttctttctgtattttaggtattcttctattatcttttaataacatgtaaaatttaaatacatttaatatgggttacaaaatggttaggctgatttttttaaaaaacgtatacatcttatggtagtgatcatttgctaaatctgttagattcaaaaattctaaaagtaaatgctttttagaaaaaaattcagaccatgtagaagtcaataaagtacaaatgaaatctggggtcagtatctttgcagcagtgtgtgctgtccactagaatgtttcatgattatggaaatgttgtgtatctgtgctatccaacatggtaaccactagtcacatttggctttgatcatttgaagtgtggctagtgcaactgatgaatttcaacattttatttcatgttaattaaattttaatagatataattagcatatatgatattaaccagtacagcttaggtttattgtaaaattttacatttctttttatatgtttatattttttaaaggtatcttcaaaaaaagttgtatctattgtgtatatgatatatttttctacaacatattctagattattggtggtgtttggaaatgcttcttaagtttgaatattttctcttatttgactaccttgtgacctacattaacagatagtctttggttattctgcttctctccttcaaaattctaaattcttagaatttgaaataaactgctatttgaatctttatgtcatttcacatattgagtgattggtcctgagttgctctggggcttcctcaaaaaacaacctaaattatggatactaaatgaacacagactactttccttcattttgcccaaatagatgctgttctttgggttctttgatgttcaaacttaactttgaatattgaaggaaatggtacttctaaggataagtaaacatagattcttttttaacagttcatttcacagctcaacacacactttttggagcatatgttttatggttactcttttgccaaatactgggaatacaatattaaataactgttttgcctttaagcagcttgtaatctaattgaggagacagatgtggaaagaaatcacttacttcttcacagtggcattatagaatagaggttaagagtgtgctctggagctgtgtgaccttggttatctatggaagctcagtttccttgtgagtaaaataaggttattagggttcttgtgaggattgaatgagattatttgaatgtttggcatatgttagctaatattactggctactgagcttgaaatctctcgtgcctctattattggcaatggagagcacttgagagatttaagcaggcagatgacatggttggattcatattttaggattatgtgaattgctttgtctgtagtggatcaatagatttgaggaggctatagtgataaacctgttgcgagatgatgacttgatcactttagttatgatagaatggttgggaagagagtgcagtaatacttttcgtgttatcaaggtaagacttgattgatttaatgaagagggtaaaaggagttagagataacatttgaatttttggttttggtgactgatggtggtatttacaaatgagttagggagtataggaggaggatatggaagaggggcttgaaagattgaattgagttttgttcaagcttgagatgactatgatatccaggcaggcatattcaggagacagttggatttatgtttttggtgggtagaagagtcatggctggactccttttgtttctggagacagggtcttgctgtgttgcccagtctggagtgcagtgagtggtgctgtcatgcctccctgtagcctcccaggcttaagcgattctcttacctcagcctcccgagtagctgggactacaggcatgtgccctaccatgcccagctaattaaaaaaaaatttgttttttagagatgggtctcactatgttgcccaggctggtcttggaatcctctgacctcattctctcaaagtgctgggattacacatgtgagctacagtgccttgcctggactctttaattgtatttaattttacatagtttgacgcaatattattcaataaatggtagctattactagcactatttttattattatgtggctggtatttaaagcaaccagtagatgaaactttctaaaaaaaaagaaagagtaaaaagtaaaaggagtgggctggaagctagaacatttaatagatggatagataaagaatgagtatagaatgagattaagaaaaagcagaactaagacaagctctgatgaagtatgatgagtttatataagaatagtcaataatacctgatgcaacagagatatctagtaaagtaatgcctaaaagggtcccctgtatttgaatgggatgtcagtggcgccctctgccaggcaaatcacagtgcaaatatggagacagaagccagaaataaaatgtattagcaaataaatgggaggttgatataacatgggccggttttgctgatgtgacccaagagctaagcagtgatatcaatatcttccaattccaaattttaaaatgtcctttaataaaatatgtggctagtcattttgaacaattatcagtaaaatttttaaaataaaaagcataagaaaaattaagaatacaaagagtatagttctattttaggtatttaggtttaaatctagtttaattctttcagctttctctaattgagttttaatcctcgtttactttgctaatgagatttaaaaatattattttcataaaccttgtaactttttgcttttttattctaaccctgtgatttactcttaatctatttctttataagcttcttaaatttcagtccagctttagtctcaaacattgttgtagtgattaatggttttgcccccccattttcttcctttgtaatatattttaatcaacttttttttaaattggaagagccaattaaatatgttgtttaaaatcttgccatatccacactgtctacctgattggttttgccaattctgtaaaactttacttgatactgttgggattctttggactatgtggcaatatttgtagatttatagaaattttactgatttaattcttggaaggcaattttagttccaagtatttatagaatattttattgtcatctgctatgtaccaagtcttaacttgacattaactgtgcaacattaggcatggcacctctcttatgactgtcctatttcagaacttcacagtctgttcctgcgcctttcaaggcactaagctctgtgctatgctgatcttcagaggaggagcacatttgaataaaaagtgtttgtttcagtctcattaaaaggctcttataaaagttatgaacatttaaaagtgccctttcctccctttttgagctaattgaattcttcattttataggggtagaagattccaggaagagggggcagggatgagtatttatcataattgttaaataatgcgctggacactttttgtgtaatgttatttgatctggatagcaaccctgtgacataggcaggtttatcctcattagagaaattaagtggcttgcccagttcagaaaacaagttaatgtcagaatcaggatgatattgcaggttttttgatttgtatctagtgatttttttcactcagttgttctctttgtaggggctagaggcagaataaagaggccccttccctgtgctccctcttgcttccccgtcttctattctttggagtgtatgtcatttttctccagtaatttagggcagaaaaaaatgttgaggactaccactgtaccattttgttgtctctgatttttaggaactatgttcatggtaagaattgattataaaagaatacctatctatgccattagaaaacaaaacatccaaaatataggctgtgctttgcatcattctatgaaagccatggtgggaagttgggttatagctttctactaagttgaaagtaggctctgtcgcctaggttggagtgcagtggcacaatcttggctcacttacaacctccatctcccaggttcaagtgattctcctgcctcagcctccccagtagctgggaccacaggcgcctgccaccacgcctggctaatttttgtatttttagtagagatggggttttgctgatggggtttcgctgtgttggccaggctggtctcaaactcctgacctcaagtgatctgcctgccttggcctcccaaagtgctgggattataagcatgagccactgcgcccagctaatgatttttaataactttatataatactgataaatcactcttttttttttttttttttaagacagagtcttgctctgtcacccaggctagagtgcagtggctcgatctcggctcactgcaagctctgcctcctgggttcaccccattctcctgcctcagcctcccaagcagctgggactacaatgcctggctaatttttttgtattttttttagtagagacggggtttcaccatgttaaccaggatggtctcgatctcctgaccttgtgatccgcccgtctcggcctcccaaagtgctgggattacaggcgtgagccaccgcgcctggcctaaatcactctttttagtggactctaaataccactgtgatttgataccccttttattcatttataaaaatacataaacagcttccttttttgatgtttaaaaattttatagtcctttctgtcttgaatttgcatttctgttatacttttcacaccagattctattcttatatgatgtattttatgcataagttatattttgcctgtaacatgcatacattatgaaggtagtatatttttatgcattacagtctttcatgcatattgattaccctattatatgtctttgcagccagccaaaatgtgtaaattttaaaatatctcttagtcattaaattgtaattagcacacggtaaaataacaaatgtattaaaatgttgctaaattattttttatttattaaaaaaattttttttctccttctctgccttcaaaatgttgcttctctgccttcaaaatgttggtacattattaaacagaagaaaataggccaggtgcagtggctcgcacctgtaatcctagtactttgggaggacaaggtgggcggatcacttgaggtgaggagttggtgaccagcctggccaacgtggtgaaacttcgtttctacttaaaatacgaaaattagccgggcgtgggggtgcatgcctgtagtcccagctattttggggactgaggcacgagaattgcttgaacccagcaggcagaggttgcggtgagccacaatcatgccactgtacttcagcctgggtgacagagtgaaactctgtctcaaaaaaaaaaataaaaaaaaaaaagtttcacagacaaaatatgaatcattccttgtttaacacttaaaaggtttttatactcaggcaatagaatagtgtatagtttcattcacaataggtgaggagtatgtcatcctttttatattaataaaaagtgagaggagcccagatggccgaataggaacagctccggtctacagctcccagcgtgagcgatgcagaagacgggtgatttctgcatttccatctgaggtactgggttcatctcactagagagtgccagacagtgggcgcaggtcagtgcgtgcagcgcaccgtgcatgagccgaagcagggcgaggcattgcctcactcgggaagcacaaggggtcagggagttccctttcctagtcaaagaaaggggtgacagatggcacctggaaaatcgggtcattcccacccgaatactgcacttttccgacgggcttaaaaaacggcacaccaggagattatatcctgcacctggctcggagggtcctacgcccacggagtcttgctgattgctagcacagcagtctcagatcaaactgcaaggcggcagcgaggctgggagaggggcgcccgccattgcccaggcttgcttagctaaacaaagcagccgggaagctccaactgggtggagcccaccacagctcaaggaggccttcctgcctctgtaggttgcacctctgggggcagggcacagacaaacaaaaagacagcagtaacctctgcagacttatatgtccctgtctgacagctttgaagagagcagtggttctcccagcacgcagctggagatctgagaacgggcagactgcctcctcaagtgggtccctgacccctgacccctgagcagcctaactgggaggcaccccccagtaggagcagactgacaactcacatggccgggtactcctctgagacaaaacttccagaggaacgatcagacagcagcattcgcggttcacgaaaaaccactgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggatcgcagttcctcaccagcaatggaacaaagctggacggagaatgactttgacgagttgaaagaagaaggcttcagacgatcaaactacgagctacgggaggaaattcaaaccaaaggcaaagaagttaaaaactttgaaaaaaatttaaacgaatgtataactagaataaccaatacagagaagtgcttaaaggagctgatggagctgaaagccaaggcccgagaactacgtgaagaatgcagaagcctcaggagccgatgtgatcaactggaagaaagggtatcagcaatggaagatgaaatgagtgaaatgaagcgagaagggaagtttagagaaaaaagaataaaaagaaacaatcaaagcttccaagaaatatgggactatgtgaaaagaccaaatctacgtctgattggtgtacctgaaagtgacggggagaatggaaccaagttggaaaacactctgcaggatattatccaggagaacttctgcaatctagcaaggcagccaacattcagattcaggaaatacagagaacgccacaaagatactccttgagaagaccaacaccaagacacataattgtcagattcaccaaagttgaaatgaaggaaaaaatgttaagggcagccagagagaaaggtcgggttacccacaaagggaagcccatcagactaacagcggatctctcggcaaaaactctacaagccagaagagagtgggggccaatattcaacattcttaaagaaaagaattttcaacacagaatttcatatccagccgaactaagcttcataagtgaaggagaaataaaatactttacagacaagcaaatgctaagagattttgtcaccaccaggcctgccctaaaagagctcctgaaggaagcactaaacaaggaaaggaacaaccggtaccagctgctgcaaaatcatgccaaaatgtaaagaccatcaagactaggaagaaactgcatcaactaacgagcaaaataaccagctaacatcataatgacaggttcaaattcacacataacaatattaactttaaatgtaaatggactaaatgctccaattaaaagacacagactggcaaattggataaagagtcaagacccatcagtgtgttgtattcaggaaactcatctcacatgcagagacacacataggctcaaaataaaaggatggaggaagatctaccaagcgaatggaaaacaaaaaaaggcagggcttgcaatcctagtctctgataaaacagactttaaaccaacaaagatcaaaagagacaaagaaggccattacataatggtaaagggatcaattcaacaagaagagctaactatcctaaatatatatgcacccaatacagaagcacccagattcataaagcaagtcctgagtgacctacaaagagacttagactcccacacattaataatgggagactttaacaccccactatcaacattagacagatcaatgagacagaaagtcaacaaggatacccaggaattgaactcagctctgcaccaagcagacctaatagacatctacagaactctccaccgcaaatcaatagaatatacatttttttcagcaccacaccacacctattccaaaattgaacacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaaatagtgtgtagagggaaatttatagcactaaatgcccacaagagaaagcaggaaagatccaaaatttacaccctaacatcacaattaaaagaactagaaaagcaagagcaaacacattcaaaagctagcagaaggcaagaaataactaaaatcagagcagaactgaaggaaatagagacacaaaaaaccgttcaaaaaattaatgaatccaggagctggttttttgaaaggatcaacaaaattgatagaccactagcaagactaataaagaaaaaaagaaagaagaatcaaatagacgcaataaaaaatgataaaggggatatcaccactgatcccacagaaatacaaactaccatcagagaatactacaaatacctctacgcaaataaagtagaaaatctagaagaaatggataaattccttgatacatacaccctcccaagactaaaccaggaagaagttgaatctctgaacagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatacccttgatgaacattaatgcaaaaatcctcaataaaatactggcaaaccgaatccagcagcacatcaaaaagcttatccaccatgatcaagtgggcttcatccctggatgcaaggctggttcaacatacgcaaatcaataaatgtaatccagcatataaacagaaccaaaaacaaaaaccacatgattatctcagtagatgcagaaaaggcctttaacaaaatttaacaacccttcatgctaaaaattctcaataaattaggtattgatgggacatatctcaaaataataagagctatctatgacaaacccatagccagtatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcatttttatacaccaataacagacaaacagagagccaaatcatgagtgaactcccattcacaattgcttcaaagagaataaaatacctaggaatccaccttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttagagatttaatgccatccccatcaagctaccaatgagtttcttcacagaattggaaaaaactactttaaagttcatatggaaccaaaaaagagctcacatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctagccatatggagaaagctgaaactggatcccttccttacaccttatacaaaaatcaattcaagatggattaaagacttaaacgttagacctaaaaccataaaaaccctagaggaaaacctaggcattactattcaggacataggcatgggcaaggacttcatgactaaaacaccaaaagcaatggcaacaaaagccaaaattgacgaattaaactaaagagcttctgcacagcaaaagaaactaccatcagagtgaacaggcaacccacaaaatgggagaaaatttttgcaacctactcatctgacaaagggctaatatccagaatctacaatgaactcaaacaaatttacaagaaaaaacaaacaaccccatcaaaaagtgggtgaaggacatgaacagacacttctcaaaagaagacatttatgcagccaagaaacacatgaaaaaatgctcaccatcactggccatcagagaaatgcaaatcaaaaccacagtgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtgtatacccaaaggactataaatcatgctgctataaagacacatgcacacgtttgtttattgcggcgctattaacaatagcaaagacttggaaccaacccaaatgtccaacaatgatagactggattaagaaaatgtggcacatatacactatggaatactatgcagccataaaaaatgatgagtttatgtcctttttagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaggggggagcgatagcattgggagatatacctaatgctagatgacgagttagtgggtgcagcacaccagcatgtcacatgcatacatatgcaactaacctgcacaatgtgcacatgtaccctaaaacttaaagtataataataaaaaaataaaaataaataaaaagtgaattttaggccattttctgttacttagaatacctgaaactgggtattttataagaaaaggaatttatttcttacagttatggaggttgagaagtccaaggtcaaagggctgcacttggtgagaaccttcttgctgatagtgactctacagattcctgaggtggtgcagggtatcacatggcaaggggcctgaacctgctaatggtagctcaggtctcttctcttcttttaaagccaccagctcccctcccatgataacccattaatccatgaatggattaatccatttatgaaggtggagctctcatgatccaattacttcttaaaggccccagctctcaatattgccccgttggggattaaatttcaacatgagatttgaggggggtcaaatattcaaaccatagcagtgggtttaaaggtacttgtgaaagaggagaccagagaggaaaatcaacatgacctttcaaatggacctatgatccattttcaggcagattaattttaaattttatgaaagggttgagtatgaatgagaattgaagacctgggaattgttgtccattgttgtttatctatttctgtgtacccttcagaaagtctgtttaccttcagcagtacaaatatatggtactgtgaaagatccctgatctagtatttatagcaacctgtattttatgaccagagaaactgagacttaaagatgtagagtacttgcctatggtcacttagctagtaaatggtcaatcaaaaactccaaaacttgaggccgggtacggtgactcatgccagtaatcccagcaatttgggaggctgaggtggttggatcacttgtggtcaggagttccagagcagcctggccaacatgttaaaaccccttctctactaaaaatacaaaaattagccaggcatggtggtgcgtgcctgtaatcccagcttctggggaggctgagacaggagaatcgcttgaacaggttgcactgagtcaagatcgtgccactgcactccagccttggtgacagagtgagactctatctcaacaaataaacaaacaaacaaaaaacacacaaaccctccaaagcttttctttccctcctgtgtcatgctacttagtacatagcctggttcacagtatatgattactatatatttaatgaatgatttacatattatttgtgaagtccaaaatacttaacgttgtagttgttccatcagttttgaactgctgaataagtgtgacattacagatgattcactacagaagaatattgaagatcttcaaagcattgttaaggtgatctcctttcagttcctggagtggtgttcctggaaatgactaatagaacagcaaaaaaccgtctacttgggcattcttggtgttttatcaattaagtcagagacctataacagtgttggagtgcttgttttgaagaggtcagctaacttacgttgacactgtgtgtgtatgaagagtgtaattttcgtttctgttatacaggtattctctgaaaccaaatgaccaaatcttggctgaagacaaacacaaggaactgtaagtgcattaaaccattggttgtaaatagtttactctgtctatgaacttgatatatgtatatgtaaattatctgattttcaaaattatataatgacaaagtataattaacactatgaccttaatcctaacaattatgataacctacactatataatttacactacataaagtttacacaggacataatttctcctgtattcacattaaaagatgtagtgttgtattccatcatctagactaaagtcttactgggaaatatgtcatgctattttctctttccagataaaatattaaattgttcctattttctttctgactgctctaccagaaaaaagtaaaaaataaaaataaattgtcactcttaatttttgggtcttactccggtggatcacccaccttcatggtaatgatagacaaatataattttgtttctgtcactggtttatgcaaaagtaaatgtcaattgtttggtacaaggtaaaacactttattttatttttatttttttgaaacagagtcttgttctgctgcccaggctggaggcgcaatctcggctcattgcaacctctcattcctgggttcaagcaattcccctgccttagcctcccaggtagctgggattacaggtgcccgccaccatgcctggctaaattttgtattttaagtagagatggggttttgccatgttggccaggctggtctcagactcctgacctcaggtgatctgcctgccttggcctcccaaagtgctgggattacaggtgtgagccactatgcctggctgaagacattttattttcacatctaactcaggtcgctcttggtttagtttaatgtaaccttcacttgtactcatttatagggacagtaattttttttcgtagaggacttcaagactattattttcttcttgagattaagtaataatttttttccaagtacttttaaactgctttttaaaaactgtcttgaaccttttgtaaattattttcttctctcctatttaaggtaacataaattgttaattataaaatggcaggaccaatgttcagggaaaggattttcttatgcgttcttaccgtttacacattccactattatgctaacctttcatcagtatttttatatttggcctatccttatttgagtataatctccatagtgggttctcaaatatatatattgtcaagaaatttttttgctctttctttatttcctagtatagtcagtgagggccggtgattgttactgtagcattggttggttattatttataggtctggtaacagagcttcttttgctttgggaattaagtagttggtgagccttaaaagttcctttagtccttagactatgaccaatattaaaaataccagaaatctgcttttaaagaatatgttatttaatatgtaacccattttaatgttttaattcatttgaaagtttttttaactgtccaagatataattcatctctatgggtataacttggcgaactgatacttttttcttacctttttttttgtttttttgagacagactcttgctccgtcacctaggctggagtgtggtggcatgatcttggctcactgcaacctctgcttcctgggttcaagcgattctcctgcctcagcgtcctgagtagcagggattacaggcacccgccaccatgcccagctaatttttatattttagtagagatggggtttcgccatgttggccaggctggtcttgaattcctgacctcaagcgatccacccacctcagcctcccaaagtgctgggattatcacaggcttgagccaccgtgcccagcccctacattttattacgaaaagttttaaacatatgttatgtgttcacccatatatttaccaccaaggttttatcattaacatattactgcacttgttttatctatttattcttctgttcgtgcattacttcatctgttttttggatgcatttcgaagtaaattgtagacatcaatatgcttctctctaaatatttcaacacatataccattaactagagttttatatttcaaagttttttttttttagtttcacctgttctaaaatttcttataaactgagtcatatatatgtcctattttgtataaggcttctgtcactccctgtgtttttgaaattcatcagtgttgttgcatatatcagttaattccttttcatttttgcagattaacattctgttgtttatttgttctattattgctaagtattgccacttgtttgatttgtcattattgatggtcttgatatttttggctgctggctctcttccttgtagtttttgacctacataccaaagaaaactttcagttgaatatggcaccataaaagcagagtattaattttaaaaaattaaaacagttattgaattaatgaatttcatgaattatgaaagctgtttataaataatctcatttgtgtctttgcaactcaaatagccaaaatcttggtagggtggtggtcatggaagtcagagtctgctaaggagtgtataacaactcacctgctgtattaaaaacaaaaaaatctttttgtgttcaagactaagctttaaacaatataagagatatggatataaaacaaaattttatctaatcagtaattccatgctttattctcataaaacattattacaacttcttaatttcagtctgttaaagcttgattaattataaaattgtaaaaatgtgttggcaccatcacattgacctgctctttgaaaattaaccctaattctataagagtaccaataagagagtacagtgatagctctaattatcttgatattaataaataaagagtggcctggcatggtggttcacatgtgtaatcccaacactttgagaggctgaggtggaaggattgcttgaggccagcagtacaagaccagcctgggaaacatagtgagaccccatctctacgaaaaacttaaaaaaggccgggcacggtggctcacgcctgtaatcccagcactttgggaggccgaggtgggtggatcacctgaggtcaggagttcaagaccagcctggccaagatggtgaaaccctgtctctactaaaaatacaaaaattagccaggcatggttgtgggtgcctgtaatcccagctactcaggaggctgaggcaggagaattgcttgaatctgggaggaaaagttgcagtgagccaagatcacgctactgcactccagcctgggtgacagggcgagactctgtctcaaaaaaaagaaaaaaaaattagcctgatgaggtggtgtgtgcctgcagtcccagctgctcaggaagctgaggcaggtagatctcttgggcctaggagatcaaggctgcagtgaaccatgatcattccactgagctctggactggacagcagagtgagaccttgcctttaaaaaaataaaaaaagaataccaataagagagtacaatgatagttctaattatcttgatattaatgaatattaagtatgttttcattaaaacatttttagttcctgaaattttgtgattcagatttcatatacacttagtcactgatgcttcacgagtatacttgtttctctgtctgaggaagattggcatgggaaaacagggaaatattggtcagcagtgacacttgtttttctaagcaaagtggtttttctcaacttcctgtttttcattattctacatactgaagaccttgggggatgattttaagtagagaaagctgagcaattcaagttgtgatgtgatttatctaaaactataggatttatagtttgttctatacatgatccagtaatcaactggtttcattagctttctagtttttttcagttttagttttgtaaatggaataatttaaaataaattaggaaaacatcactattttactaagtattttttcacctactttccattgtgctaggcattaaagaaaagatagtgtgcagctttttatatgtcaattatacttcaataaagcggtttaagaaaaagtaaaagatactgattttatttataaatggaatcttactctccaatagtggcttttcaaaatctttggacacatctgcagttattgaaaatagaaccattttgtttccatgaatatctattttatgaatatataaattttgtattaccttggattatgagatctgatcatatagatttaggtaaggaaagttaaaagttgtctggagttaggggtgaattccaaatgcaaatataaataaattcagaagtatccatactacttaacacagagtaacctggtatctgaagattttttttttgtttgctataaggcaaggggaaaatctctttaaaagggattcacatttatttacttggctttttaagatagctaccaaggtaaacagtgaacttttgtaagcagtgtatactgttctaaatatgaagtgtattttcccttctgatagtgaatgaattccattatgattttttaatgtcaaaaattaaattattttgtcagaataaccccttaaatttttaaatgttgtcttataaaagttaattatattgtgatatttaaatgcttgccaatttacgattatgatgagatggaagaaaataaataaattatgcaataggcatgaaccttcaagggtattaggacgtgctcaggatatgatctttggtgcagtgtaaaaatgtaatttcttagtgaataggtcaatttccaaaccagcaggaaagttataagtatttaaatggaatgtgtagggatatgtcagggaagttagagacaataacatctggtatgctttttttttttttttttttttggtgagatggagtctcgctctgtcgcccaggctggagtgcagtggcgtgatctcggctcactgcaagctccgcctcctgggttcacgccattctcctgcctcagcctccagagtagctgggactacaggcgcccaccaccacgcccggctaattttttgtattcctagtagagaaagggttttgccgtgttagccaggatggtcttgatctcctgacctcgtgatctgcccgtcttggcctcccaaagtgctgggattacgggcgtgagccaccgcgcccggtctggtatgctcttaaattaattgttaatgctgtgacttagcagttctttgaaatcatcaagatcatagactgggcttgtgcctataatcccagcactttgggaggctgaggcaggaggattgcttgagtctacgagttggagaccagcctggacaatatagtgagactcttgtctctacaaaaagttaacaaaagtagccggatgtggtggtgcctgcctgtagtcccagctacttgggagactgaggtgggaggattgcttgagaccaggaggtccaggctgcagtgagctatgatccgtgccactgtgctccagcctgggtgacagaatgagaccctgttaaaagaatcttttttttttttttttttggtaagaatgagctaagaactggatatctgtaaagctaatagaaaaaaatcctgtgaagcaaaaagtcaaaattgaaataagctaggaccgacagcaaggttaaatgcttatttttttttagtgttcataaataaggtacagttttaaaaatatcataaacatttttatgatcctattctcagggcccggttttttttgtatctttaaaattatagtattttgattctagaaatgaacccttgaaccaatatccgtattttatcatgaataaggtgagagtaacattgataaaatgacttgctatagtttacattgctacttaaggacagtactagaccagaaaccaagtctcctgagtcccatttaagtgctgtttttgtcacaccaagcagttctctaagtatatagtcttttttttttttttgaaacagggtctcgctttgtcacccaggctagaaaacagttgcatgatcatggctcactacagtcttgtttttagagatgaggtctccttatgttgctcaggttggtctcaaactcctgacctcaagcagtcctcctgcctctgctcccaaagtgttatgattacaggcatgatctactgcacccagccagtaacttttttttttttttttgagacggagtctcactctgttgccaggctggagtacagtggcgcgatcttggctcactgcaatctccgcctcccaggttcaagtgattcccctgcctcagcctcctgagtagctgggactacaggtgcctgccaccacgtctggctaatttttatatttttagtagagacagggtttcaccatattggtcaggctggtctcaaactcctgacctcaggtgatccgcctgcctcagcctcccaaagtgctgggattataggcgtgagccaccgcgcctggccgccagtaatttttttttttaaagggattaatatccattgcaagacttggtaacggatcacagagaactcattagttaattaaatcagtttcacagtattgtgttttggttttggaaatcacttcagacctataaccaatattgagtgagttgaaaagaattaattacttccaaatacaaggcactttacattcttctaaggagaggatgcaacacaaagctatttggtcagcttgatacaaaagctcttaggtgtgctcatgaagtaagtcaaatgtatacattttacaaccacatattaaatagaattagttttttctttttccttcccatttctttgaacagtcttattcagaatcttcatcattagcaactttgtcatcattggagcccttttctctagaacacatcagcctctttctatgtatgatattttcgctggaaattttatcctgagctataaatgcctctcatgtaagaaaagttttttttttgttttttttttgagacaagatctaactctgttgcccaggttggagtgcagtggcgtgatcatgactcactgcagccttgaccttgtgggcttaagcaatcctcccatcagcctcctgagtatctgggactaccactgtgcaccaccacacctggctaatttttgtattttttgttgagatggggtcttgccatgttgtccaggctggtcttgagctcctgggctcaagtgatatgtctgccttggcctcccaaagggctgggattacaggtgtgagccaccatgcctggccaagaaaagttttttttaaagtttatttttgtatgtagtcataatacttgtaaggtaaccttttcactgtattgctttttaaactaaggtttaaatagttcattgtaataagagttaccgtttgtgcttataaggctgcatctccaggagtaagtactaaatctgtgttagatttctttgctgcttttttttgtttgtctttttttttttcttttactgatatggtcaggtggtcaggttacttccgtaaggatccaaaactagagttgattgagatcatttcaggcttatacataatctacaaatgattctcaaccaattgagatctgagttcacctcttttgctgaacttttaattgtgatcttactgtaaaattctaggatctcataacttctatgaaatttttatacctggattataaaacttcggaaagatttgcttaaatattttgttgcttaaaagaaaataattggccgagtgtggtagctcacgcctgtagtcccagcattttgggaggctgaggcaggtagatcagttgagctcaggagtttgaaaccagccttggcaacgtggcgaaaccctgtctctactaaaagtataaaaaaaattagctgggcatggtggcactcacctgcagtcccagctactcaggaggctgaggtgagaggattgcttgagcccaggaagttgaggctgcagtgagcaaagattgcacaactgcactccagcctgggcaatagagtgagaacccgtctcaaaaaacaaacaaacaacccccccgcaccccccccccccaaaaaaaaacaaacagaaaataattaacactgtcatcaaggaaggtaactcattataaggatttaaaaaaaaaatttttttttgagacggagtcttgctctgtcacccaggctgaagtgcagtggcacaatcttagctcactgcaagctccacctcccgggttcacgccattctcctgcctcagcttcccaagtagctgggactataggcgcacgccgccacacccggctgatttttctatttttagtagaggcagggtttcactgtgttggtgaggctagtctcgaactcctgacctcgtgatccacccgccttgccctcccaaagtgctgagattacaggcgtaagccaccgcgtctggcctataaggaataattttgtgattaaacatggtcttatattcatgaacgataggtgaatgaaaaatgtgtgttattggtggtaaaatcttaaaatccttaaagaattaatttaaattgctaccttctacttatgaagcactatatggtgccctggacttagcattagaagaaacttagtttatgtatgagttttgccataggctgtagtcttggggtattagttagaattcaatgccactatgatattaagaaatttattacaggaattaaatcttattcaatcatgagaaaaactggggatattaaggtccctaaaatgtgagagaaaaatcgctaaactgccttttgatgtaggttaatgaattgcgtgttctgttaatagggaaactgtgaaggaggttcgtgtgttgtgggctctttgcaactaccacctttatgggcctttagtgaaaaatctggtgataggcttggtcctggtagttgtggacgtaaggtagagtggggatgagtaaggacagattacagttctgcccatacctttgtgtctgtccttcctgcctctaaccaatgactgcctttggaatgtaatggctactgcttcaattgcatcccctaaattttttgcaaatttctcttgtgacatatcttaagctgaaaccatataggagaggaaattaggggaagtgtactccttcttgacatagtttaataccttaactttgtttaatcacttagtcttccaaacttaagttcctccgatatcattttgggtttagattagtgcttttctgtcattgtccattaaacaaatgatttctttcattacctacttctcttttagtctgttcagtgatccctctgggtatagcttctgaatttctagcataaaactcttcaacaataacaaaaaaggataatgatctttcctgtcaatttttagggggaaggataaggtgtttcctagaaactttattcagagcactttagtcaaagtgtagttcattgatccttaactgcaatttacttgacaagatatatttatgggatgaaatttattgagggtaacagaatggagagagaaactgctggtgtgatgaattctctttcttcttggtctacaacaaacagaaatattttgagaatgtagctatggcagattttaatgtaagagttatgccaacactatttccccttaagggttgagtcagaccttttgggaatgatatagacttgggggtcttgagtgaacttttagtatttattagcagccaatctaaccttgaaaactctatgttgatttctttttggaaagtgttgaacaattaaataatacatgttaaagaacaaggaagaagggcattgttttaattattttgtgatctaatttaatccccacagcaactctgtgaagcagatattgtaatcattcccattttacagatgaggaagagacttcgtaacttggtttatataagaaaaggatagaactgtttagatctttttgattgctttccattttgtataagttcagtgacttaggaaccttttttaaaaaacttctttggaggagtgatattgttcattatgaacatacctacttgaaaagtatttaaaggtatttttcatggaaattatattttataagttttagtatggttcactagaaatacgtcacaatttgtaggtaatactgtgttttattttgagttggctaattgttaaggtaaaactttagaggataaagtgagctcatattgatgaatggtaatctgatatttccaacagactaggtctttttttgaagttcatgtattataactttattctttgtgatactagctccctctgtagaacttcaataagattgcaactggactttttcaataatttagaaaagtgatctaaacattatctataacatttccctgtaaaattttactttgtattctaatcagttgcaagtgggtttttaaaagtataaatgtaacatttataaaaatgtttcactttgtacacacaaagttttaataacatatacaaaataaaactttcttcaaacattcctataactttaatgcttttttatttaggaaggctagagagaggtgtgatttctaggtctgtaggtctgtgttgagtaaagcctgatggaagccctaggggaaaaataaattttgacgtttagctggatacttgaaattatcccttttttttttttttttctgaaactttccggtttgacttgggtgggaaaatgttcataagggattttttttttttatcttgtagagaaggggaaagcaaacttctacaacaggtagaaagagcaaagagaaaatcttagcaagatccagaaatttagtggagaattgcaggaaaacattcttgacatttacggtttaaaaaaattttcctttttctttttttcttaagaggtggtctcactctgtcgcctagactggagttgagtggcatgatcatagtgatcgttccacctcagcctcctaagtagctgggactacaggtatgtgccaccacgcctggctcctttttgtatttttagtagagatggggttttgccatgttgcccaggctggtcttgagctcctggactcaagtggtctgcctacctcagcctcccaaagtgttaggattacgggcgtgagccactgcaccctgctcacatatatgagttctatgagtttatgctgttgttggaaaatcctttgttatcaaagtctaccaattttcctgtgtgggagtgagcttacttattttaccaccactttttctcctttctttctgctatggtttgaatgtttgtcccctccaaaactaatgttgaaatttaattgccattgtaacagtaataagaggtggaggcctttaagaggtgattagatcatggggctctaccttcatgagtgcattaatgcaggagtgggttagttatctcttagagggttgttataaagtgagtctggcccctcaagcacttgcttgctgtttgccttctgccatgggataatgcagcaagaagttgctgagcagaagctggcaccatactctaggacttcccagccttcagaactgagaaacatattaatgtttctttcctttataaattacccaatctcaggtttctgttaaaagccgtagcaatcaaactaagacactcccctaaaccattttatattaaattgtaagttgtataattagctcttcaaagatgttttctcagacataatgtaagctcaatgaaggcagaggaaatatgattgacttgcaacatggaatttagaaaaatgagcgaactgatttcaaccataaagctagggactaaaacatacaaatgaggataagaaagaactgaagtacatatgctctttcagtttctaaaaatttaactgtattttcttctaagtagattgaaggatgttcttaggattatgcttgagtaggcttttaaacaattttgtgtggataattatctttgaagcctttgttagtactaaacatctttattctgttataatacagtttattcaaacagacgtacagtgtgtattgtggcacaaagaaattcaagaatgattcttattctttttgtttgttggccttgactaaatttgataccagataattgctttaaaggataggccaattttattggtataacaaatctacccttcattatccataaaccacttatatagtaatctggttttcctatacaggcacaccttggagatattgggggtttggttctagactatcacaataaagtgaatatcacaataaagagaaatacatgaagattatattccccagtgcatataaaagttgtggtgatatcacactgtaatctattgtatacaataacattgtgtataaaaaatgtatatgccttaatttaatgtaatctattgtatacaataacattgtatataaaaatgtatattccttaatccataaaaatactttatggatgaaaatgctaacaatcatctgagcctttagcaagttacaatcattttgctggtggagggtcttgcctcagtgttgatggctactgactgatcaggatgttggttgctgaaggttggagtgtctgtggcaatttcttaaaataagacaataatgaagtttgctgtgtcagagccttcctttcatgaaaaatttctctgtaatatgcaatgctgtctgatagcatgttacccacagtagaatttggaaaattggagtcagtcctctcaaaccatgctgttactttatcaacttaagtttatggaatattcaaaattctttgttgtcatttcagcagtgttcacagcatcttcaccaggagtacattccatcttaggaaaccactttttttgctcatctataagaagcaactccctgtccattcaagttttatcatgagattgcaacatttcagtatccatcttcaggctccacttccaattctagttctcttgctatttctaccacatctgcagtgacttcttccctgaagtcttgaagcgctcaaagtcatccacaagggctggaattcacttcttccaaactcctgttaatgttgatgttttgacctcctcccatgaatcacgaatgttcttaatggcatctagaatgatgaatacgttgcaggaggttttcattttagtttgtctgatccatcagaggaatcacggtctatggcagctatagtcttgcaaaatatatttcttaaataataagacttgaaagtcaaaattacttcttgatttgggggttgcagaatgaatgttgtattagcagccatgaaaacagcattcatctccttatacatctccatcagagcacttgggtgactgggtgcatcatcaatgagcagaaatattttaaaaggggccaggcatggtggctcatgtctgtaattccaggactttgggagactgaggcaggcagatcacctgaggtcgggagttcgagaccagcctgaccaacagggagaaaccccgtctctactaagaatagaaaattaggtgtggcagtgcatgcctgtaatcccagctactcgggaggctgaggtaggagaatcgcttgaacccaggaggcggaggtcatggtgagccaagattgcaccattgcactccagcctgggcaacaagagtgaaactccatctcaaaaaaataaaagcctagcctcccaaagtgccaggattacaggcatgagccaccgcgcctgtctgtccgcccgtcttcttttttaagagcaagaaaaggtttcccagaagtactctggtagattcttatcacacacacattcctaaaccagttactggcaaagaaaatagaattatcatgattaattagcatattctgaagtacatgcttccttataactgaacaaaaattagagctccactggcaacgcggaaatggctgttgacttggcaactaatagtgaattgctcacaatgtttaagtgaaatggcctgtcagatttcctgggaacacaggaaccagggccagacttagaaacggcctcagtaagaggttttctaaaactattttctggtatcgtaattattcctaattaccttgtgcactaaaaaaatttaaaaattttaaatttagaattttaaacacatttcctgacagtaaccaagatataaaaatgtgtaaaattgagtgaatatattttaaagcatggaagatttgtgttaccctcagacttgaaagggaacctgcaaagttatggtctcatgggaaatattgtttctttttgccttgacataattttcaggctctttggttttattctaagcaacccagcagggcacctttaaaaagaaacaaacaaaattactgtctctaaaccaaagaagatagaaaaatacattcaggagaatagtatacattgaaaactgccactttagctagtgcttttttttttttttttttttttttaagacggagtctcgctctgttccaggctggagtgtagtggtgcgatctcagctcactgcaacctccaccttccagtttcaaatgatacttatgcctcagcctcctgagtagctgggattacaggggccagccaccatgcccagctaattttttcatatttttagtagagagtactttttaactgagaagagatgctgtaaagttttaggaaatcacagtggggacagtagtcatacttctactttcttctgaatataatattgtttcttttttctcctgcagttacttattttttttttctttttgctttaaggcttggtagttctgagaattttagattcagttataatcgaatgtaactatcaacacatgttatggagtagtataaattgttacttgatgtttggagttgttttactcagtcactcagcaaaggtaagattagatctccgttagatgaaaagtattatctcttatgcaaagagacattggttagctctggatgaagacaatggctatggggtcagtcaaccttgtagaaagaataggctaggcacagtggctcatgcctgtaatcccaccactttggggtggtcgaagccagtggatcacttgagcccagcagttcgagaccaaactcggcaacatagtgagagccccctctctacaaaaaatttgaaaattagccagggcatggtggtgtgtacctctggtactagctatcaggaggctgaggtgggaggatctcttgacctggggaggttgagtctgcatgcagtgagccatgattgcgccactggactccagcctgggtgagaaagtgagaccttgtctcaaaaaaaaaaaaaaaaaaaaaaaaaagacacaataaaagtaaaattgtataatctctggaaaaaacaaaataggctgtcatgttctaatactcaatatgtaaggatgtttagtatattagtgggtataattattaataaaatattctatttagttatctttgaaccagtttgtaataaccaaaccacaaaaattcaatttgctttgtatgtaaaaatcttttaaaatagaaagtcctgccttaactttcataaatctgaatgtgagcatatatttatgcttttcatttctttgcacagctttttttttttttcctctaagacagagtctcactctgtcactcaggctggagtatagtggcacgatctgagctcactgcaacctctacctcccaggttcaagtgattcttgtccatcagcctcccaagtagctgggattacaggtgtgcaacaccatacctggttaatttttgtatttttagcagagacagggtttcgccatgttgtccaggctggtgcacagcattttgttgttgatgtgtgagacttgtaatataacagtaataatgctgtcatttcttaaagatgatatataatcctatcaaaatattcctgggaagtaggtatttgtcagcctgtcagtgttttccttttattttgtgtgtgtgtgtgtgtgtgtgtgtgtgtctgtgtgtgtgtgtgttttagtacattctcccagatgctgaaattttccctttaaactgttactatgatgtatgtcttatttctttctcttttttggtcctaattatgctctcaggagttaagacagtataaaattatgttttttaaaggaaacttcatcaaatacttggaaattagcaaatattttttagaggtagaaactgtcatttatattcctaagacttgtaggccattgtatttgttgactgactgatttgactgagaacctagtgtgtgataacgtgtcactgtttctgtcaacttatataattgagggtctttttaattgttcttaccttagaccactatatacttgtggtcttataaagtatatttgaaaattatatgcattttcatgttttgtctgggcctgggaaaaatatttattttaaaactgtaacatcttaacctttaaaacccattgtcagttatttggaaaaattagtattatatgatatgaagcacttctttttattgctgatttcaggtttcactatctgggaaactccggtgtggagacataggtctgttaactgtcttctttgttttatctggaatgttttattgatactataaaacaaaacttatcagtaagactgatttggaattcatattgtttgacagcattatcactgtcaataattatccattgtcagtatttgtaaagcagaataaaagaagccattatttaagtttaattcctgagatgattcagcatacggtgtaatatcaatctgtgggaattttattttaaactttttcttagtaaagtttactttttagagctgttttaggttcattcacagcaaaattgagcaaagatacagagatttcccataatcctcctgccctcacacatgaatagcctcccccattttcagcatcccccaccagagtggtacatttgatacaattgatgaaccaatattgacacatccaaataaaactattttttggggaggggagacggagtctctctctgttgcccaggctggagtgcagtggcgagatctcagctcactgcaacctctatctcccgggttcaagcaattctcttgtctcagcctcctgagtagctgggactacaggcacacgctaccatgaccggcaaatttttgtatttttagtagagacggggtttcaccatattggtcaggctggtttcaaactcctgacctcaagtgatccacccgcctcggcctcccaaagtgctgggattacaggcatgagacactgcgcccagccgataaaactcttagaacaagattaattgattgattgagacaaggccttgctctgtctcccaggctggagtgcagtgatgcaatcatagttcacagcagcctgcagctcctggcctcaagtgatcctcctgcctgagcctcttgagtagttgggactatagcttgtgctactgctcccagaagtctcttatttaatctgtctcttctaaagtatagatgtatagttcatacctttagaaatttctgagtttttatggtggttctgcaaataaacctgtttgcttcttatttctgccttcccttccttctgagcctttggtttttgattttctcttatatgctggttcagctatccttgtttctgttgctttaaagccttcaacatattatgaacattttccaccaaacatattgttcttatgagtacatcgtaattttagggcaagaagcagagatgaactttgctttaactcttttgtgttgaagtatgctaatggcaagcatgttttttaaatataaaagttgtacaagttgagatgtttaattcctttactttaagaaaaagcatcataattagaagggagaattgctgttatctggaaggtgttcagacagtttggggagaaaaaaacaaccaaaacagctgcagtgtaatttccataagggaatgggcttatatctttgtttatttgtgtttgttttccattgtacactcagtgcctagcacggggtaacacagtatgtgattaaccaacagttattggaaaaatatattttagtgtgttattttagataattaaaagtacatttaggaaatatgcaacctttttgtttggctttattaatcagctttaaaatgctgatgatagaagcaggaggcagagaaattataggcaaataggggtgggtccctggtgaaaccccacctccaaggtgaaaagcttgaaaccagcagcccaaagtgagaacttctattcctgtttgcctgcactgtcctgattggttctttctgaataatgtctttttaccaattgaatgttgccttttccaaagctacctatggcctgccccacccgcatcctgtgcctgtaaagccccggactcagtaggtagagaggagagattctgccagactttcgggaaaagagatggcttgacttcggggaagagactactgctgtacttcagggaagaccacctactcttcccgtcccctctccagctcccctctccactgagagccatttccaccgctcagtaaaattctccaccttcaccatccttcaagtgtctgcatcacttccttcttcttggatactggacaagaactcagaacccacggagtgcaggtacccaaaaaggctgtcatactggccctttgccctcgctggcggagggcagccaccccacgcaatgtggtaagggaccaactgagctgttaacatgcacacagacagacggcagagctaaaagaccactgtaacactttctctggggttttggggtcgtgggcaccctcacctgggtgctgctgtgggacctgcatggagctttctctcgctggctcctggagcagccggccaggtcctgcactctcttgctaacatgctccctcctgcagggggttgagcgctgtggcgtgagtaaactgtcgcccttgttgcaagtccaatgaagggaccaagaaaaatcctgcatcactgatatgaaatgtaccaaattaagtaacatcatcttatttcttctgattttgttttcagtttgtttatattcctttccataggtattatgtgtctgttttagttcataaaattgtggcctaatttatattttgaccattattcagcacactgttagtactcaggactaatttcagttgcttatttagacacatcgaaataaatcacattttaaggctgggcgcagtggctcctgcctgtaatcccagcactttgggaggttgaggccaggagttcgagaccagcctgggcaatatggtgaaatcccgtctctactaacaatacaaaagttagctgggcatggtggtgcacacttgtggtcccagctacttgggactctgaggcacggaaatcgcttgaacccaggagtcagaggttgcagtgagccatcacgccacactgcattccagcctgagtgagattacgtctcaaaaaaaattttttttaaacataaataaagaccacactatcttttttgaagattatgttcacatttcattctctccattgaactgtatagatgtattacctgtatataaagaatgtaaatttttttgtattaaaaatcgacaccttaaaaaaaaactaataccaccacaaggttaagctctgaggagatttcagctttacaataattacattgttacaataatgtttaacttctcaataattaaaaaccaaagcaatgttgcaaccttggttcaatattcaaatatatttttcttggtaaccaagctacttcactatttatagtactttataaatgatttagaattgttatgcagttttttcaaagaagtattcataaggtaaatttagaaaattattttaaaacgaaagtgatgcccaccagatggtgctatttcgcctgttttatctgcgacaataagtaggaaaaatgaatatagaacttcaaaaaagtgtatggaagatctagaatatttgggcattgtattttgggtgtagatgagctcagtggaaggaagcattcaaatattctaaacttgtgtttagtactgtatgtttatcttgataaaggtaaagatgaattcccagagttaatatgccagataaccttttatttagtctaaatgttaagtagattttttgaaaagttgacctatatgcaaattttattaacttcatagctgtatatgcatgaaaaatgaaattatttattagatatgtgttaccaaaatttgtttcaagatttctttatattgttaagtaaacaatattactatctcatttgagttacattgtgatttacaaattaagggaaacattttgatttttttatgtgtttgtaattattacccagaaacttaggcttgaattcactatttttacaaaggaaagagatgactcttctaaattaatttttgtattaggaagagggcaaactatgtggtacagtgttcacttagatgcagccattgaatgacgatccattagagtcaaaatggttagttagctaatgaaatacacttttcagtaaagctggaaagatttagccagctcttaaaagtgtttctaggattttaatgtagtctttttcccgctgattttattatcactctgtattcttctctggtcatgagattgaaccataaaagtcatgtagatgcttgttataagtatttgccaaagtcatcattgtcagtgattttattggcatgtgtgaaattagagattaaacttgcttttaaatcttgcatttgaatttttcttctggaagggtacatgtataactttcaatttaatgttcaattattggtaacagaatgaagcatctctctataggccagtaaatatatatagtagattttattgtattcctgtactgtttttgaatgaatattttactaattatattaacataatcctcatacatacccttaagattaggacctactataatgctttatttgaacttgtttcatagcatttgtcttttttaactttggattatagttttggaatataaatcagatccctcctacaaaaacataaagttcttcatgctttctctcattccacttatcacaatactttacatgtagtagatgaccctatatattttttatataaatgaatagttttgtcatgccaagtattgatattagtattagtgacaacaagtattcctcattccatagtttttgtttttgttttttttttttttgagacagagtcttactctgtcacccagggtggagtgcagtggcagaatttcagctcactgcaatgtctgcctcccaggttcaagcaattctcctgtgtcagccttcttagtagctgggattacaggcatgcaccatcacgcctggctaatttttgtaattttagtagagatggggtttcaccatattggtcaggctggtcttgaactcctgacctcaggtgatccactcacctcagcctcccaaagtgggattacaggcataagctactgcacctggtctctgttctacagttttttatcttatgcttttctgaaatgactttttatagttgggtttaaaaggatcatctcattggaatctcatatcacagttatgatgcattctgtcatgatgaggataagtgtatattcaggttaaaaaaaatcaaaatattattgtcagcctgcatcagtattagagattgtctggtccaggagttctcagattgtgattcaagggcctcttgtgggaggggggggtcaggggtccttaagaccttgacagaagttctgtgagggcagaactatattcaaagtaatactaagactgtgtttacccttttcattctcattctctcatgagcataggtggagttttctagaggttgcataccatgccatactgattgaatgtacaagttatatgaaactctagcagttctgtcaaaagacaaagttacaacaaatttagtttaaagatctcagtcagctttattgtgattctagaatcaggcaatacttcattccataaagtagagtgtgtgttctaatgagttgagcagatggttggttttatagacagaaagggctgaagaaagcagattggtcatttcaaagtgaattctcttgtaaggtctggatggggagacaggacaatagaaagactggttaatatcaggttacttcagattagggattaaaacagaggaaacttcattatcatgcccattgaatacttcattatcatgtgcattgaatattgaaaattgtcctgtttgggatattaggctgttatctgtctctcctgattttttagaaagtcaagataacaactcagtttgggtttggtgagcatgggtgactccattttgatttttagtctggtcttcttttggagcctagtgtaggagttttgttcaaaacagtggcctataattttggcttcataagccagacattaaagagatttgcaaagattataaaacagtgcttctcttgtcactaagatgttttttagtttggaaatagttattttcataaaatgttacattaacatttaatgaatttattcttaaaataataaatatttaaaaaagttatattttaacttctaatatgataactagggctagatattaaagctccttgaattactcgatactctttttaaagtgtaaagtggtcctgagatgaaagtgtctgagaacttatgatcctaattctttatcctcatttcatagatgagaatactatgagcccagagaggttagtttagttaagtacactcatccagtttttggcttagctgattcttggatcactgacatctggctttttttgatttttttttttttaagttttttttttttttttttttttttgagacagagtcttgctgtgtcagctaggctcgggggctggagtgcagtggtgcagtcatggctcactgcagccttcactgcctgggctcaagtgatcctcccacctcagcctcctgagtacctgggactacaggcacgtgccaccatgcctggctaatttttgtgttttttgtagagaagggtattttttgttgcccaggctggtctcaaactcttgggcttaagtgatcagctagccttgacctcccaaaatgttgggatgagccaccttgcctggcctgatatattttattagcagttttgctgtttagatattcttcaacctaataccaaccatcagctcctttaacagtttcttcatttgatattttaactaactttattaagtacatgagtaaattaggaatattgacctactttttcaacaacaataaaatggtgtttttttaaactcaaaaaatgtctagaaaaagggaattgatatatgaaacagtgtaaccttagcgtcagaaagaataatgttgagggcaaagaaataggttcttgtgttttagagactcttttactgtcttttttcctttttttccccccttcttcaacaacaaaacattggttacaagcttccctgggcatttatggcagcccacctacagaagaacaagtgttctgttttaaaattttaaaaattttatcaagaggataataattacacatatgctgcttttttgatggatatgtattatttctcaggttgagcctcatggtgggggtggtagattctaaccccctccttttaattgttgaatgaatttaaaactatgtcataaagaaactgcgtaattttaattcaaagaaagataattaggatatacataatatccctcttcctttgaggggcttccttcgtgtagaagacatggactgagtgatttttgctcaataaaggaaaactttctagtagtaaagaaatacaaaaatagaatcagcttgtttggaagtagtgagttccctttcttatgaggcattaaagcatagaccagattattgactgttagtaggagtactagcaaatgaatcagtagatggagggttaattgggttacatgacctttcagattgcttttttttttgaggtggagtctcgcttgtcaccaggctagagtgcagtggtgcaatctcagctcactgccacctccgcctcctgggttcaagcgattctcatgcctttgcctcccgagtagctgggattacaggcacgtgccaccacacctaattttttgtatttttagtagagacggggtttcatcatgttggccagggtggtcttgatctactgacctcatgatttgcctgccttggcctcccaaagtgctgggactacaggcatgatccaccgtgcccagccttcaaattcttttattaagtgtttgagtatacttgttcaaaataactttttaaacaagtataaaaaggcagttggtttagcagatgtattctacttttatatcagctgctctgttaacctaaagattttatggatctgtggtctcaccatgatcactgacatcaattctccttgaaggaggatgagttttgtttgttcattttattgcaaaccatttgaagagatgatagattggtagcagaaatttggcagagaaaaggatgataaacattagaaaggaggataaagcccactggaagacataaatgaattgatgatattttggtgtatattttctcattgctttatgattataaatattttctgctgctttttgccactatctatttttcatgtcttccaataaagtattccatggccaaaatttgtgtgaaattctcttcggttgttgctggttttacaagttatagggttctttggaatataattactgaaatgatgactacactaaaacatatttcttcttaatttaacaaagtatttagtgggaggaaggctctagcttttcttattttctttaatgttttttaggcatgctagaggaaaatagtgttcttactattagttttgaacattttttatgactatagagttgaaagcccaaaacactagaagtaaatggatcattgcaaaatatttgttttgttttcatttgtgagtggggcattcgtgtgtcactgtgtctatgcttctatttttctctgtatatagtttatatccttaagactttcagaaagaaattgagatgttatgttgttttattgtatatgcatgtacatgcatacacacacacacacacacacacacacacacagttttatttgttcatcatatatttaaggcctgacataggtcttacaaagttcaattactatagggcttaagtaggaaatgaatggtaaaatgagccaatttgaagcaataaatactgattgatagattatcaccttcttccaaataagatatgtggcatcgtagaatcttgctcttagatacacagatatgtgtgatgtttaaatagttgagaaattcaaccagaaatgaatgaaagggttttcccgttatcctgtcatacgcaaattaccagatcattcagttcttcaatttatcaattcatgtatttattcatttaactaatatttgttagttttatactatgtgtaaagccctattttagacactgaatacagtgccagacagtaattttcctgcactcatagtttatactctaatagagaatgtagaattgagctttaaatttcctattcaataagtatttttagtaatatgtgaagtacaagagcttctgaagacttattgcgccactctctccctattcatccatttaccagttgttactgaatgcttactctatgtactagaaatgcagagatgagtaagatacaacctggccctgaaaaaaattcagtctatttggagttatagacaggcagtaactagctattatatagtgtgatgatggctatgatataattacaaataatattctgcaagaacagtaattttctctagctgtgaggtatgcaagaagctatcatagagaactaatatttgaggatgagtagaaatagtcgggtatagggagatcaaaggagaagttactcctattccccaaatagagggttcttcatgaacacacagaagtaggcaaggtctgtttggagaatggtgagatattgtgtagtttgggtaaaacactgggtatgtcatggagggagaggtaaaagaagaagctacaacgtaggttcaggccgaattgtgaaaagttttatatacaaggttaaagttggctttttattttacagttagttggggacctgtggaagatttttcagcaggcaaacatacttagtctgcagtttacaaagatagttgatagaatacaggatgaagtagtgagaagttgaggctatggaaaggcaggtataccagtttgaaaacttcataatagatatgaatgaaataatgagggtctcttatagggtagtagtagtagtgactttagaacacagggatggattaaaaatcaaattcagaggtatttttgttttgcttcatttttttgagacagggtcttgctctgtcacccatgctggagtgcagtgacatgatcacagctcactgcagctagggctacagatgtgtgccaccatggctggccaattttttatttttatttttatttttggtagagacaaggtctcattatgttgcccaggctggtcttaaaatcctgagctcaagcgattcttccatctcagtctcccaaattgctaggattacaagcatgagccaccatgcctggtccagagttagaactgacaggatttagtgagtgatccatatggagagagggcgttgaaaaagattttgaagttttgtgtttagtgtctgcataattaaatgctggtactattaacttcaaaaggaaaagcaatatggttgagggaagcaatgaatttggttttgtaatattgagggcaggagtaaacctaagggaatgttggaggcatttaaattctaagtggaggagatgcctattcaagagaaaggaggaggagtagggggaagagatagctgttcagtgtgtcattaaacctctcaaatcctcagtttgttatttatcatatattggaggtagaatcaataatttttctggttttgaaataacctgtgttttagttatcacaaattctaaattagtagtacaaaaattataataattatagtttatatgttatagactgatgataatatttattgattacttcctgtgaagtttaggtaaaatgctaagcattttgcattcatcatccatttaattctcctagcaatatgagttaaatattattactatctggattttcagaaaagggaagataacttgaccaagattgttacagcaaataagtggtggatgggtattcaaacccaggacaatctgacattaaaactcaagcttttaaccactatattatttgcctgtcttgtagaacataagagttgtaatgaatctaaaacatcatctagccctttcctgtaatcagatttatgtcatagctaaggtctgtaattaatgtcaaaattagctatccaatttacttaataagaagcttactccacagccattcattactgctgttttccttgtggcagatacttttttttttttttttttttttgtcgactcacctctttaccgtgtgatgtgagtaaattctgtatagtctaggccactcatgattatcccatttttcttgctagtcattaattaagacctgaacataggactgatatctgaccaataactcatttgtggccaatgagacatgaggggaggtttggtggaggggcttcttggaaaggtaacacctcctctcccctcatttttggatgtttctatctagatgggttcttggaattgtgagagctatcttggaattatttggggcctaggtcaggataaaaccaaaacactggatggcacagtgaaaagatggtgagaacttggatccttaatgatcttgttgaacttctaaattacccattcctaaagctattgtgcctcaggactaggtcttacatgaaattagagggaatttattaggctgtgtgaaacaaggactttttaaggctactaacagtttttttcttttaaacgatacttatcactgaaagaaacctaactgggatctgcagtgtttatctttgtctgaagtaaatagaaaggcactgtagggcttgcattactgttgagacacaattaaaacaggaatagaagacaatttttgtgtcactgcacctaatttaattggtgtagaagttggagatgatcatgctctagaaaacagatcttatatatgttaaaggtagcaaagtgtcattgaggaaatgagtctgattattctgacagtttctgtaggtaaaaggaatagaaagtaagtgttcagattaggttaggaaatagaaatggatttagtttgtagacagttaacctacgtttcagggtccttccaagactctggaagaatctcaagcaatgtgttaacataatattttgggtgaggcggggtaagatttgcaaaagttaggtatttaatccattaaaactgctattccttttcacttagactttccctgtatcataccctcatattgggtggcattagagtggcctgagctaagggaaaattgagtagaggatacatttagagatagtatatggttagcagttgtttatgtgtccagttattttgtaggcattacttccaggaatgttattactgtccactgtgtctacttccctggccttgtgatacatagatgtagttttgcagggcaggtgagccccaaagtggggctcagcccgtgagggttcttggctttgcccagaaaagaattcaagggcaagccagaggtagaagaaaatagatttattgaacaggcagtgttacagctctggtggtgttatagctcggtgactgctcctgcagagcagggctaccccgtaggcagagagtagcagttcagggcagttattaatacccttttttaataacatgcagattaaggagtggtttatgcagaaatttctagggaagggatagtaacttttgggtcattgggtcattgccatggaaagtggtggtaactcctgggtgttctcatagcagtgttgacatggcacactggtgggtgtgtctgatggaaagcttcttctgcctaatcatctttcagctagtcctcaatttaattgggtgtctgaacctgtctctagagtcaagtcctgcctcctaactcagtaggggcaagggtcttagagcattataaatatgttctttgtggtagaggtagaggaagagaaacatcgtttaagtgtttagagtgagaaactagtctggaaaatttttctaaatcttggaacttgattgtggttttcgtaaatttgataatattcctaagaatgtatatgacattatcagtaataagttataaagaagttataaagctgatataaactctctacactgcctttttttttttttttttttaagatggagtctcctctgtcacccaggctggagtgcaggggtgtgatctctgctcactgcaacctctgcctcccaggttcaggtgattcttttgcctcagcctcctgagcagctgagactacaggcacgcaccatcatgcctaacaaatttttgtatttttagtagagatggggtttcaccatgttggccgggctggtcacgaactgctgacctcaagtgatccgcccgcctcagcctcccaaagtgctgggattacaggtgtgagacaccgtgcctggcctacactgtcagtactaaaaattgatcaaacacagtagtaaaaagataaaattatctttctattctcttaatgttgcaaaattgttatatgaagaggaaatcaagaaatgcagccagaaatgtaagaaaataagagcattatagagatagattaggcaattaataaagatatgctcttctttttgaaattcatgtttttggcatttgttagccttttaaagttagtgtttagttgtaatttattttctcattccagatatttacttcacacctaattttgtattcctttccttaaatagagtcccacaaattgtaaaaaaggaattagctcaccaaaaacaccaaatgcagtatttttaatatttacctttcaggttcggttgctggatctagatatgcctcttttttttatttcctcattttttcttctaaaaagaaaattatgtattttaatgtcagattgcttttgattaaaatgtttcatattaaaattgtatacctgaaaaatattattcaataacacacttcaaaaagttgacagttaaaaaaaaaagaatagcccttgttacttttcttatctaatcacagagtttgtgtagtgaatgtaaaaagaaaaaaaaattgttacaagtttggagcaaagagctctgtgtttaaaaggaatctccttctttttttgtgtgtttttccttttgtaccaatggggaacctaaatctgttttagttgcacagacacaatggacaaatagtcattttgtatttgccaagtgtgataccttcctttgtttatttgctattaaactgttgagagttttatggctagtggataatcattgttcaaactttttaataactacagtgaattgtgttaatataaaattatgctgtacagtattttcttgttatgttgatggtcaaagtgaacatcagatattaaaaatttagatgagtaaaatattaaacagcctatttttgtcatgtaacaaaagaccatgagatccatggaggaaaaaaggacagctttatttttctatagaaaacaatagtaggttggggatatgcagcctgtggtgtaaaatgaaaatgaggtcctagttgggggttggagagttagaaattataaaggcaaaaattgtaggacaggggaggtggggtcaaggaagtaaggaataaagtcttgattagatgacctttaatccccaaatcaccagtgtgtcttagttggttgtttccaggtggttggtcagttggcaccaggtggtcttttggtgatcatttggggaatttccaaatgatcaccaaaaggaactgttctttgacttggtggcagaaaaacaggttttgcaacacttttaaggacacagggtataattgctcccttaccctgtcattgcctcttggttctgcttttacctttgagccacaaggagtctatcttgtcaattaactgggggcataatttgacagtccaatatgtataatgatgacaacagctccactaacatgaatgccattcttagaatttctcatagatcctggcatttggtacatctgagttgaataaataaaagtctggggaatgaatgaaagaaaaattagttcaatgtcctataactttaagttaatttattagaattgccaccaacaaaattagctctagcatttagatactaaaaggaatttgttaagcaaacttacttttgcagttatctctccatggacagtcagaacaggtattcttcatttctaaaacatactgctgttctttaagaccattctttggcactgtggaactttagtcattttctagacatttgttagccactaaatgtctcataccagggactcatatttgtaaataatagtgtctgcctttgagaagctcataactgggtagtcaacgaacagtcacagtgcagatctggaatcagtgttgagggagtacaaaatcctttgggtgttgtaatcagagtcaagaaaagcttcacagtggcgataggcttaagcttagttgaaggaagaggaagctttcaagtggaggtggcagagaaagcattctgacatgtgaaaaggcaggaaagcctgcgtgcagcatatttattagttttgtctcccttggagcattttgtaaattttattgagtattcagagttgacagaaaggcagtcagggatcatttcatggagcgccatgctgagaagattagaggattttaagcaagtgatgtggtcaaatttgcagttttgaaagagtacttaacattatcctggttatatgtttagcagatttggcaagaactgattgttatgatttgatagtcatttaatacaaaaaggaacctggaatgctcttcgtctttagtgaacattatgtaacctatcttcatggccttcttagtgaggtaaacattttttttttgaaattgtaaagatttaaactttttgaagggtaaactttctcagataattatgcttagttgtgagcagaagtaaaataatgtttttacaggccagagcatttaattaccagtgcaagactgtccagactactctttccatttaccatgataactggtaaaatgtgagatggtgattgctccatcatcttgggtactgagatgaaaagatgtggggtggagtcctcaaatgacttatgatgaacagctagtgtaagcaagaaaatgaccttattgttttaagccactgatattttgcagttcttacctgataaatggtacatgaacctaacgtgtttttattgatgcaaccatatatcaaaacagtatttttgaaggaatcattgtagaagtacagacatttatagaaaattttttacctctctgatttagagaaatttttgaaagcacaataacttaggtaacatagtaacataaaagttctcataatatgtgtaaaccaaaatgagttactgcaactaagagtcattttgaaagagactaaaattgacttatctttaatttgttaaataaaagtgtgatattaaatccattacaaaaatgggtaaaaattgaagacaactgcaattttataggttactgaactttatattttacatgatattacagtcatccttcagtatacatgggcgggtggttccaggacccaagtctacaaatatgttaagtcccacagtgggtgctgtgaaacctacataaaggaaaagttggctctctgtatgcgcaagtttcgtatcctgtgaattctgtattttcaatccacatttggttgaaaaatttcagcctgtaggtggacttgcgcagttcaaacccacttcattcaagggtcaactgtattttatagtcagtatttgcataataaggaaatctaaatggtactttgatattcaaagtttcataataatctatatgtatgttttaaagtgagtgtggtgatattaatacttaaatgaaaaatatgagttaataaagcaatttataattttatatcaattgagcatattgtttttgaaatttaatttagaataatcatctatacataatctatagatactttagtctttctatatgacattcttatggtggtttattgattatcataactatgaataatgagtaaaaattatacaactatacaagccaatatatgcttgaaattattatttattgatagtaaattagattttgacatgaaatgatttctgtttaggcaataaatttaaactatagaaaaaaatgcagtgtaacttgtactgtaaataaacgattagcaatgaacattacagtgagagctgatagtttatgaattattcactgcaaacttattgtctctgtgtcattaacatgtaagataatgagcctaattaccatggctttaaactcaggggagttagcaatttatgtgtaaaagtttctgggctgtagttaccacccacaagggtattgagagaactgcagacactacttctgtgttttgtttcagaaatgttctttttcctcacttgcttccttcttaataaattagtttttatttatttttatagtgagaattatgagcttttcctcttgcttgaatacctttttaaaggagttatgagaaatatttaagtatttttttagtgtagtttagtgttgtaagtagacaaaatattattagatgtattcttttatttgcttacataagttggcatcacttactatagtaaatgaccactaatagtgtaatttcttggaaaatctagcctaaaaggtcaatattaataattggttttctcctctaaaaggatttgtactaagatgatttactttcaaagtactcagtattagcctatagccttttttctaatctttaatattgtatctttgatcttaatttaaagttttgatgaacttgttgcttctattttctctcttatagtataaattatctgtaataagccaccttaattaaagttggtaaatctacaactgcttcaattatacactaatcaattatacactaatttaattctacttagcaggatacggtacatcattaatcagttttagacttaatacaacagatttagaagtaatcaaaattgaagcattttatttagctgggaaaaaaatgaagggtcataatctagtaattcacatatcaattctgataaaaatcaaagattctttgctaaaaatgaaggaatgtagctgttatgtttactgttgagtgccatgggctgaagctgtgattatataatatctttagatgttaatagcataatagttttgtgctctacctttttctttaaattgttattcatgttactaaatgggttgttttctgtaacatgattgtttaacgtatacataatataagaattccttgagtgaatatcttttttgttgttgttgtttgtttttgtgttttttttttttttttttttttgagacggagtctccctgtgtcgcccaggctggagtgcagtggcatgatctcggctcattgcaacctctccatcctgggttcaagcgattctcgtgccttagcctcccaagtagctgggattacaggcatgtggcctagctaatttttgtatttttagtagagaagaggtttcgccatgttggccaggctgatttcgaactcctggcctcaagtgatctgcctgcctcagcctcccaaagtgttgggattacaggtgtgagccactgtgcctggcatatagaatatttactagtagtttgttttgaacatgtaagcatgtgcacaaatgtatttttttcagaattatgttaaataagatgattagatataattaactcaaaaatctttagcaaaatgatctttgttttctgtgattgaggtggtgacaaatttgccttagaattcttggggatgtgttataaactcgatgtaatcatttttcttttccttttttttttttttttttgagacggagtcttgctctgtcacccaggctggagtgcagtggcgcgatctcggctcaccgcaagctccacctcctgggttcatgccattctcctgcctcagcctcccaagtagctgggactacaggcacccgccaccatgcctggctattttttttgtatttttagtagagacggggtttcaccatgttagccaggatggtctcgatctcctgacctcgtgatccgtctgccttcgcctcccaaagtgctaggattacaggcgtgagccaccctgcccggcccatttttctcaattatctgctcattgaattaaatgactcagattgaatttcattactcattctttctatacatgttcatattattggaaacacttcttgtcctgctcagctttctttccaataaattagtaattctttgctcactcgtcttgtattcctttataagaatgttctagatagggatattctaagttttgaagactatgtatgttaagtgcattttacccttttgagagagttttagtaacaagtttcagggaacccctaggactctgacccattatagctttggccatttaaaaaaaaaaaccttcaaaggtaatatgtgtacatggttaacaatcaaatagaacagatggtctgtctaataatgaaaaacaagaaaaatcttgccctatgtttctctgttcccactccccccaaaatcagccacttgtaactgattctgttttcagtgcttattgtggttgtctcaacctgtagtagaattatagattcttttgtttgtttgtttgttttgctttttaaattagagacaagttcttgccctctcaccaggttggagtacattggtgtgatcacagctcactgaagccttgaactcctgggctcaagccatcctcctgcctcagcttcctgtgcagctgggactacaggcatgcaccactccacccagctaattttttaatttttttgtagaaacagggttttgctgtgttgtcccttgaatgcctggcctcaagtgatcctcctgccttggcctgtgattataggcgtgagccactgtgcccagccttagaaattatttctcaatgcttttgctcttctgtgttctgtgattaggtgactctttatctcacaccacttctaccttttctccatccttccaagttgtgatcactgttttcgttcctaaattggttatttttaaacttcaaataattcaggtaaatttatattttatgttttgttaactgtgttccctgcttactgtttcttccattaatttaaatatcatcgaagttgataatgctaagaacttgtttgtgttaaggtaattctcacatgtggataaaaactgattagtgccaaaagtttacaataaaatataacagtctcctatcctaccctgggttctccagaagcggcaacttataatactgttagtttgttctttctgatactagcttattcctaaataatatgtgtattcagcttttctgattaaccaattttagatgttatctattgacctttttattggggcctgggatacagatcatattatatacctgtgcacccagttctgaaaagttatataataattttggttcaatctataagcagtctataatcgttatttatattatagtgactatgtaagtattgagtgctgtaatatagcacattacattcatttgcttaaacaaatatttggtccccctttcccaccacattatttatagccttgtttattcatttgcttggtttcctattggctaatttgctaatctcccccctcagtgtttcagcagatctctccagcacctcccattaatttttctttgtttatcataggttcgaaactcaataattttttttcctggaagtttctctccttcagccctctattctactttaccaaggagttgtcttactcttttcagctctgatcctgggacttccctttgttgctcttttgggggacaatttgctttttgattgtttttagtcttattagtttatgcccttgttttgctcaagcacattctccagagcttcctgagaaaagaatatgtgagaaataaaatttttccatacatgtaggtctaaaatgtctttattctacctttacataggttggtatttcaattaagtctggaaatgcagattgaaaataattattcctcagaaacttgaaggccttgctccattagcaaccagtgtttcctatgtgaagtttgatgccacactgattgctgattctttatatgtgacctatttttttctctttggacattcttagaatctcctctttcctcctggtattctggcatttctcaatgtgatttttcttattatggcttttttttttcattgttctgagcatgtaatgggcccttatagtccagagacttaaatgttcttcctgccattcatgcaggtttttgaaatttcttctctactattttctttagagctatgagttatttttattagccagttttctattaatagacactggatttttcaagttttccaccacaaaaaacactcatgggccgggtgtggtggctcacacctgtaatcccagtgctttgggaggccgaggtgtgtggatcacctgaggtcaggagttcaagaccagcctggccaacatggcgaaaccctgtgtctactaaaagtacaaaaattagctgggtatggtggcaggtgcctgtaaatcccagccacgtgggaggctcaggcaggagaatcgcttgaacctgggaggcagaggttgctgtgatcacgccattgcactccagcctggatgacaagagtgagacttcatctcaaaaaaaaaaaaaaaaacaaaaaaactcctcacatatattatcttttttgcatgtacttttatataattgtgccagttcttctgtaagatatacatggcttttatcttattactttctctgagaggtagagggtggggcagggaaggcaaggagaggaagaagctttgagattctcctacctgaacttcagattctggtgtgatacctcaatattgagttagaatggctttatcaagcatgtttatttctagtttttcatattatttttgtcttagtcatgaagcacaacaaaccaacatagaacccatttcatactgatgaataaacaggtagcttcattcatgtattcatttattcattcagtcatgttgtgatactctttgggaatacaaaggtgatactgtacttgctgtcatgggatttacaattctagggataagtaggagtgtaattgataaaacatgtatttgtgcttttcaatagtaatattgactaactcaagaaaacttttggagacaggctttctttgaatggactgtgatgcttgcttgtttatgttttcatgaatacatttactagcttttgattttttatattaggagagaacagagtgtcttgttgtggcagaaatacctaatatgtaatcctctgaattcttcaattgttgcaaaacataaacatttactaaagagttcagcagagtagattaaatgttatttaaaacatatgttatattgacctcatggctaaatggcctggtttaggaatccatgaattatcccacaggtaatagcaaagttttctccctgcctcgtctcccaccccaaatatttgatttccacatatactgcacaggggaattgaatttgatgtcgaaagccataagaaaaagagaaactttgctttttactgcttttactaggaaatagaaaacatttttagtgacaggctatgcttcatcatgaaaatacggttgggtgttttaggccttcacaaatttgatttcattgtacttagtgatggatgttagtaagctgtgtgagatggagagaaattaaagaataaacaggaacctctcaaacttgctagtgatgttctacagtttgtagcatgaattttcttacttttagtttttccttatgaaatactttatgtagaacaaactagcagtactaaaacaaacacccatgtacccaatctgtcaacacttagatttgttgaagatttgggtgggcagagtcttccacccaaatggtaaaaggggaatacattacaagtacatctggggttctctgtatacctgtcttcagcccattttctgtcttatttcaaagttcactggtgttccagttttgtttttagctgtaatgcttttcttagtgcttaaaatatatgtgtatatattcataagcaatatgaagtattgatttgcgtgttctaaaacatattttacagtgcctctccttcggctcgctttttcgtgtaacattgaatttttagatttttccctgttaatgcacgtaatttatatgtaatttattttcacctgtatagacttgtatgaatacatcacaatttattctttggttgaggaattacaggtttttcagtattagaaacactactgtgtttaaggttcttgtactgatctgtttatgcatatgtgaaagattcttgaggactgtattttaaatatgtggatgtttaaatttcaattaattaaaattaactcagttcctcagttacactagcaacatttaaagtgtttaatagccacatgtaactagtgagtaatgtattggatattgtggatatggaatcattccattatcataaaaagttttataggctagtgctccttggggtttatacctgtgtgtggaattgttgtgtcactgggcttgcacatgttgcacttcagtagatgttgctgagttgttctttccagtggtatctgagcattccctttctcaattgtcttgctaagaattggtataaacagaaattctaatttctgttttgtaggtgtgaactgtatctcattgtggttttaattgaattttgaaaatatatagtgaggctgagccttttttcttatacatgtgtttaccttttacagttctcatcttgtgattgcctcttaatgtcctttactcattttttcttttgagatattttaaattactgatttgcatgagttttttttgtattttatggatacaaattctttgattatatttgccatatatctgtgcctagtatgtgacttgtctttcattttgtggtgtcttttgcctcacacaagttttaaaatgaaatgtaatcacattatcaatttttaaaaatgctttatcttcttatgccttatttaagaaattacttcctactctaaggtcagagtttcccatatgtgctttgcagaggtagatctttcatctggtagtatgtaatttttgtgtatggtgtgaggtagagttggagacttgagtttttttgcatatggataaccaattatctttgtataattttctgaaaacttcattgccttaatagttttttgtttgcatgggggtcaatttctgggttctaattctgttccattggtctatttgtccctataccaatgtttcagttgaattttcctttttgtcaaagtacctatttttttctttattttttgtagagacagggtcttgctttgttgggtagactggtcttgaacatcaaatgattctcctgccttggctttccaaagtgctgggattacagttgtgagcaaccacacctggccaaattttcttaaaatgaaaataacagtgataatttaggtccaagccctcttcccaaaattgatttagctgatgataagctataatattggaatttataatataaaatactacaatttttttttttttttgagacggagtcttgctctgtcaccaggctggagtgcagtggtacaatctcagctcactgcaacctctgcttcctgggttcaagcgattcccctgcttcagcctcctgagtagctaggactacaggtgcgcaccaccacgcccagctaattgtttttattttagtagagacggggtttcaccatgttggccaagatggtctcaatctcctgacctcgtgatccacctgccttggcctccaaaagtgctggctgagattacaggcgtgagccaccgtgcctggcctagaaaatgatattataaccagcagatgtgaacaataacatttttttctgtgatgatatttgagaaaagcgcaacttaattacaaaagagtgaaaaacaatcactttatcaaagtcagaacttctatacactttcaagtggtgaattgagcctcacttaaaatctaattttcacttttaatgccatttgttttcttttgagatataactgattcatttaccaccaatttttataaattggatttgtagtttggccattgtatgaaaatatttttttaaaaaagtatatgggtcatatgggtagtaatcaggcaaattggttttagatttgcagtacctgttcaattatctgagatttaggggatctagggcatgtgagtagaggttctattaggtttataaagtgcttgtgatgataatataggttaaggaccaagtacctgggaaagatcaagggcatactaaatagttgttcctaaagtaatgggacaattgcagagagagggatgagagaaggagacttaaggatgatgtgttgatgtgtatgtatatataaatgagacataaatgacttttggaaggattactaaagaaaaacagcaatagaagaagactagcctatgtccagcagcaaaaggaagtagaagacagtgagtcagatagtgaccagtacaggacgctaggtggtgccattagtcttagactgcttatttgaagtctctggaggctcagtaacctcagaatagaaagatcgaaaggcggccgggcacagtggctcacgcctgtaatctcagcaccttgggaggccgaggtgggtggatcacgaggtcagcaattcaagaccagcccggccaacatgatgaaaccccgtctctactaaaaatacaaaaattagcctggcgtggtggcgggcacctgtaatcccagctactcaggaggctgaggcagagaattgcttgaaccggggaaggagaggttgctgtgatcggagatcgcgccactgcactccagcctgggtgacagagcaggactctgcttcaaaaaaaagaaaaaaagaagaaaaaaaaaggcactgcttgtatagtaaatgagcgaattgtcttattgagtataacccatagtatattatagttcttgatattttcttctccagtgatcattttgaaaaattttctggaatttgcattgtaaagaagtttgtccaccaaataaactgtgttttaaaagtaatagttcatttctttctaattttaaaggttgtatataaaaaggtattttcatttaaaattcatattaaaaaagataattgaaattttcatattgaaattatataatcagaaggaacttggtgttttaataagctttagtggccttttcctaggtcaatgtacaattccactgaatttttttgaaatacatatccatgggttccacattggtggattaaaccgtggaaagaaaatattagggaaaaagaaattgcctgtgtacagagcatgtacacatttttccttgtcaatattccctaaacaatatgacaaaagtttacatacatttccattgtattagatattgttagtaatctagagatgatttaaagtttggggaggatgtatgcaggttatatgcaaatacagttgaccctcaaacagcacaggtttgaactgcatgcacctacttatattagtttttttccagtaaatacagttggccctctatatgggttggtttggcatctacaagcaaaaatggatggaaaatacagtattcaaggaatgtgaaagttgtgtatatggagagaagggccaactttttggatctatgggttcaacagggccaactgtggtactttagtatgtgtgcattttggtatccaagttgggtcctggatccctcaaagatactgaggaatgactgtattgaagatgattccttgattcctgttacatttttttttaagattccagattgggaataattaagtgcattatttgatttctggagatgagttacaccattaaatttttgttgatatgtgtatcgtgcaggtgacagaaaccctaactcatactggcttaagtaaatggaaattattggatcacatatctaaaaagatgttggtatggctgattttaggtgaagcttgatgcagaggttcaaataattttatttggaccctcttcacctcatcttctagaggtagggtactgccatcagctattggcttatatccttatttgtgtgtgtgtgtgtgtgtgtgtgtgtgtgtgtgtgtgtctgtctgtctgttttagtggctctaaaaacaggtgtaggattatgtcatattaggcctctttggcttgtttgggttccatatctactctgcaactggagatagagttaacactgctggaaatttatggattaagagtgttgaagggatgattccccaaagaaaatttggatcttattagggaaataaagaatggttgtaaaattgcacttatttctttaaggaagtcatcttaaagctgtttttctttgccaggtatggtggctcacacctgtaatcccagcactttgggaggctgtggtgggaggttcacttgaagccaggagtttgagaccgctctgggcagcataatgagatcccatttctacaaaatatttaaaagttagccagagatagtggcatgaacctgtagttctagctacccaggagactgaggcaggaggattgcttgagcccaggagttcgaggctgcagctcgattgcgccactgcactccagcctaagcaacagagcaagtcaccatatctttaagaaacagcaacaccccccaacacatgaaaaacttttttttttttttggctaagctgttcttacactattgattttatttcactagaatttgtttttactttaatctcatttgtgctacttattagttgtgtgacttctcagagtccatttcctcactggcaaaattgttgatacaactattgatatagttatggtgatgataaaataagataatgtgtgtgaaatacctagcctagtgcctggcatatattagatattacagaaatgttagtccacttgtaagcatggttattacccagacatgtttggattttatcagtctttgctatatgttttaaattagcctataatctgtaagtatcacagatgttgtagaatgatcaattttcagattatcagtttgatttattgattaccgctttcagtgctgaaaatgacagttggtagatattgtccaattcatgacttgccagtatttttatcctagtacttaatgtgcagatttagcttctgtaagatttttacaattaatctatgtggggaaatataaattatctttaaggagtagcagtaagtgtagtgaaattatgataaatggttttattgtttggggaaataatatcaactgcttcatgtgtttgaagaataaaaggaagttggcagcaagggagaaagatgaatgattaagtatggcttaaacttgttttttaattaaagtgcttcattgttgtacacaatattcaaattatatttaaatgtaacattaatttttctattaacattcatctttattagaaaatattgcttgtatttatcataatttttttccccaccaactataacactcttataatctatttgggttaatgcgtgtgtagtctcaagaaaagagcctccttaattgtttttaaactgtttgaacactagagatttagtaacctacatttccaataactaacaatacatatgaaactcttgatagtgatggaatagaactaatcatttccttataatatagtgatacatcattatttgacttatggcatatttaactctggttagctacaagcagctttatactggtgtcttttattcagatttgagaagtatcagtgtaacatataaagaacttatttttactaattttcaccatattttatagacacaaaccacatgagaccaaaaatagtgtatactgacctggctggtcattttatggttggttattgtgtttattattctgtactatgtttgttgtatttgtgctttagttgctatttatttttaagaatattgtgttatataggtgtaaaagtgataagaatgtgccaggtatggtggctcactgtaatcccagcactttgggaggccaaggcaggcagatcacttgagctcaggagttcaagtatatcttttgtaatcccagcactttgggaggctaaggcaggtggatcacttgagctcaggagttcaagaccagcctggccaacatggggaaaccctgtgtctactaaaaatacaaaaaattagctgggcgtggtggcacgtgccagtagtcccagctactcgggaggctgaggcaggagaatcgcttgaacccaggaggtggaaattgcagtgagccaaggtcatgccactccactccagcctgggcaacacagccagacttcatttcaaaaaaataaataaataaataaaagtgataagaatgtgacatgttaatagggagagatattagtccgatggtaattaaaagcagagaaagttttaaataaactaaatggtgaagaattggtttgttcaacaataggagttattttgaagaataaagcaagtgattaaacatgtgaaaagtaatgtgcctatgccccaaagtgctattgcttagtgggttatatctattgataattacaatattagaaattaaaatggaaacggttgaaaatattcaatacatttaaagataactgtaataaacccagtatttgctagcataaacacatttttctggaaaataatgatattttctaaaccagaaaaaaatagttaaaagaatggtattgctttttgcaaatctctttaatgtctgacttagtagaagacagctggattttcatctgcttctgcctgccatctgttgtaatatattgaactgatccagaactcctggtctcaagccattgttccacctcggcctcccaaagagctaggattacaggtgtgagccactgcacccagcaaagcaaatagttttaaccttgttggttccctgaaaagattttgtgggacccttgtagtccttagactatgctttgagaactgctggccttagcaattgaacgtaagtacagtaggagacattggtagaaatgcttttgaatttacagtagagtctgggcatcaatattagatgtctattgatcttttattaaaagactaagagtttgagaatttaaaggctaaaacattataggtcctgctgatcagacttttcatagccagatagttctgtaggcttaaggccctttaaatccagataatgtccaagtaagtggcaaggcagcaatttggattccatagctgctaaaaagttttttacggcatttgtacatagatcattaagaagagaggaattatttctcacaaccaatttttagtgtagacaaaactggaatattttggagaaaaatgtcttaatagaatgcatatagcggtaatgtagtcttctatttggcaggaatatatatagggatggtcactttagattaaagaacaaataaaacttaacctacttataaacagaggcttctgtattgagaatttttcttagtataacatatattcaccttagtatcaagttgtgggggtttttgatacccccaaattgacagttattcagctgaaacttggagataggacagaccttgattaatatttggcaataattgtcagttctaatgttggaatttttgctctaaccttgttgattaagcatttaacttatttacatttttatgcttagggattaaaagtatgtctactttacatttatattcaggtatatatatatttttgttgttgttgttgttttttcttattattattatactttaagttttagggtacatgtgcacaatgtgcgggttagttacacatgtatacatgtgccatgctggtgtgctgcacccattaactcatcatttagcattagtatatctcctaatgactatccctcccccctccccccaccccacaacagtccccagagtgtgatgttccccttcctgtgtccatgtgttctcattgttcaattcccatctatgagtgagaacatgcggtgtttggttttttgtccttgtgatagtttactgagaatgatgatttccaatttcatccatgtccctataaaggacatgaactcatcattttttatggctgcatagtatatattcaggtatattttaaggcagtttttaagtatatcttttttctttaatagtacttacaaaaatgtaattatttgatatgacaaagctgcttcatattttcatattagcttgaactttccattgatatgtcaagcaaataaatacttagtttttttctgagtagaaaccaactgtactgcaaaccccattgatagtaaattaattgcagggatttaacatgtagggaaaccttaattattctgaatatacttatgttatgatgtgtagatgatttgtttactgtctttaatgtgactgagtcaaaatatgtgtagttatttgcataaaagggaagtgttgctaatatattttgcattacttaatgttatatataaaattaattttccttgtaagggatgtgagaaatttttttactcctcatttctgtttattctcatctatttctttgaaaatgtagatttaatttatttaaatactgtgtgatgaaaacattacagatatgttcttgctctctttttttttttgagacagggtctcactctgtcatctaggctgagtgcagtggcataatcatggctccctgcatgtcaacctcctgggctcaggcagtcctcccacctcagcttcctgagtgtttgggactacaggcgcgcactaccatgccgggttaacttttgactttttgtagagatggggtctcactatgttgcccaggctggtctcaaactcctggatgcaagcaatcctcctgcctcagcctcccaaagttctgggattacaggcatgagccaccacagccaatatgcttcattttctacctctgattataaattaaaggatagtattataaatgcttaattttataacctccaaatagtgatattgtattgctccttattgtgatggataaattataagacatatgtgtttaactggtttggtggcaagtctgtttacagaaatttgctgttaatttctcagttgttcacatgaacttatctgatttatagctttggccagcaatttacaaagaaagttcagtctgtagggcttcctgttgctctgagtgggggctccttctacccctgttcaacttcagtcagcccatggtctatagtatacctctcacaaggtccttatactgcagatcctctctgctgcagatgcttgggcttttgccttaagcacactggtgtaattagaagaagtagaaaagaagagaaagggtgaataataagagatgagaggatttaaaaatggttgaaacaggagttgtgaagtttgagtgtggtggatatggagatgtgcagccctgatcctccttcaaggaagaattgtggcccagttgtggggaggtcagtcatcagaaaaccttcagctgtctggcctacagaggacagccagaaaaaaaaaaaaaattgccttaagctgtcagctccttcaggctctacctcagttgcggagagcctccttgcttaaggtcacatcctttccagggcagcacttatcctgcaatcaagcaagacatgtttaaaggcccagccattttgttcaggcctgagacaactctgacaggtgatataccaccagagatctgccaggttgcttgaggctttgttgggcctgaattgcaatttgatttttccctctgcccaattcggctttcttccccaaatctcttcttcttctttttttttttctttgagatgaagtcttgctcttgttccccaggctggagtgtgatggcatgatcttggctcactgcaacctctgcctcccaagttcaagcaattctcctgccttggtcccctgagtagctgggattacaggtgggtgctaccacccctggctaatttttgtatttttagtagagatgaggtttcaccatgttggccaggctggtctcgaactcctgacctcaggtgatccacccgcctcggcctcccaaagtgctgggattacaggcgtgagccactgcgcccggcctctccccgaatttctttcacagggattgactgctaataaacatcatatacccaaaactacttcagtgtccattttcagagaatccagcttgcaacaggcaggcgtatcggcttcatgttgtcctaaaccttacgtaaagttctatgcaattttttttgtgaatttgcatttttcttaggaggtctgtggcttccattatcttctttaagatagacttgaaaattaaaggtttttctcatcaaggacttaagaaggaaaggcttaaacattttttttttgactcaagatcaaactaaatacacttggccattgaacaatatgggggttagtagtgctgaccctttgcacagttgaaaattgacatacgactttttactctcccaaaacttaactattaataatctactgtgtaccagaagtcctaccagtaacatagtctataaacacatattttgtatatgtattaaacactgtattcttacaataaagctagagaaaacaaagtgttattaagaaaatcatggccgggcgtggtagctcacacctgtaatcccagcactttgggaggccgaggtgggtggatcacctgaggtcaggagtttgaggccagcctggccaacatggtaaaaccctgtctctactaaaaatacaaaaattagctcgtggtggtggcaggcgcctgtaattccagctactcaggaggctgaggcgggagaatcgcttgaacctgggaggcagaggttgcagtgagcctgaaattgcgccattgcagctccagcctgggcgacaagagcaagactctgtcttaaaaaaaaagtcataagagaaaacctgtttattattcattgagtggaagtggatcatcataaagatctttatccttgtcatcttcatattgagtaggctaaggaggaggaggggttgctttttaagagggggcagaggtgattagtaggagaaaaattttaatgtgtgtatatatatatatatacacacacacattatatatatataattttttgtagagacagggtcttactttgttgcccaggctggtcttgaactcctgggctcaagtgatcagcctgcctcctaaagtgctgggattaccagcatgagacaccgtacctgactggaggaactacgtttttgatatggtactcagagaactgagtgcagtacagaagcttatacacccccttttttttatagggaagtggggaaatggagaatgtagacagttcttttgagggccagtaaatcatttaggtgggaggcagacattgtgggaaggtgagaggtgaagctgcaggttgtcttaccatgcagatgaaggccccctgggtaatctgttggagctgccctgggaagaatagatgaagtctttctgggcagtaatgatcatgacttccagcttcttctcatgtagtcgacctttcctgatcatttgatgagatccctaggaagggagtttaagacaattgcatttcttttggaaagaagcttttttgggctgataaggaaataccagagagagcccctctctgcgctggggtgggggacacgacaagttagagggatcttgattgtgaggcagcttctaaggcctttaagcatgtctaagtgccagtctttgggggtgtggtttgagagaccaaaatagatgcccctttattaactaggacagatcttaaggttaaggaaacaaagttacctatcggtagaaagttcagggccctgctggtgtggcaaatttctaaattcctatggctacaagaaaaatcactcttattaaactctctaacaataggagctttcagacaaattatcacaattctgatttacagcccagactactacaactctggacagaattcccaacttagaaacattcttttcttttcttttttttcttctttgagacagagtctcactctgtcacccaggctggagtgcagtggcacaatcttggcttactacaacctccacctcccatgttcaagaaattctccagcctcagcctccagtgcggaccactatgcctgggtaatttttgtatttttagtggagatggggtttcgctatgttggccaggctgttctttaactcctgacctcaggtgatctgcctgcctcagccttccaaagtactgggattacaggcatgaaccactgtacccagcccttagaaacattcttttctgataagctttatagaccttgagtttcaaccagctttagaggctgggcacaaattgtctttgcatcgtatagtttttatcttttgatgtaaagagccaaattccaccttattttaatgctaaagccccaccccaaagtgagcataggatgtatattacacatatgtttacccattgcacgtgcgctcagctcttctcgtaaatatgaatagctttcccctaaatctgctgaatatatatgattctgttgtgtaatatgggccctgtgaggcataaaacccaacctatccttcccctgtttgaagacagagcacctttggtttgcactggagactttttcttcgctggttgcaaacccatattcccagtaaagctctcctttctactacgtagcttctggttatcttttggatgacaggggtattgctttctgggccccaacactgggaagcagcacttaaccattgtaagcaaggagaagggtgtattaattttctgtttttcagataacaaattgacacaaatttagcagctttaaaacaatacccttttattatcttatagttctataggccagaaatctgatacagtgtgtctcactcagctggttctcagctccaggttttacaaggcagaaatcaagatgctgggaggatagtgtatgttcctttctggaggctctaggggtgaatgtttccaagctctttctggttgttagctgaattcagttacttgcagttgtaggactgaggttcccatttacttgctggctttttgggaagtggtgtttacctgtttaatctcagtggtgtttacctgtttaatctcagtggtatgtgtagttatatgggattgtgtgttttaaattgatctcttttgtacctttcctttctattcctttgatttttgttctttttcatctccttttactttctttgggtttatctattgttccttttcaaatatctttttttttttgagacggagtctcagtctgttgcacagactgcagtacagtggaacgatctcagctcactgcaaactccacttccccagttcaagcgattctcctgcctcagcctccggagtagctgggattacaggcgcctgccaccacacccagctaattttcctgtttttagttagagacagggtttcaccatttggccaggctgatctcgaactcttgacctcgggtgatccgccctcctcagcctcccaaaatgctgggattacaggcatgagccactacacccagcctttaaatatcttaataagaatacttagctcattcatttacagccttttttcatttctaagatgagcacttaagtctatacatttttctcagaataccttttttgtgtgacctggactgtgtgagatagttttttactttttcattttgaagtgttttaaatttcttttgttttgttttgttttgttttgtttttttgagatggagttctcactctgtcgcccaggctggagtgcagtggtgtgatctcggctcactgcaagctccccctcccgggttcacgccattctcctgcctcagcctcccaagtagctgggactacaggcacccgccaccatgcctgggtaatatttttttgtatttttagtagtgacggggtttcaccatgttagcccggatggtctcgatctcctgacctcgtgatccacctgcctcggcctcccaaagtgctgggattacaggtgtgagccaccgcgcccagctaaatttcttttatggtttctttttgacctgttgattgtttgggaattgtttagaaatacgggtttttaaaaagctattttttctttgattgtacattgtggtcagagaataagttccatgtgatatctatgcttagaaattttttagatttatattttgccagtacatgactacttttgtaatgttttatgtatatttgataaaaatatagattatctaattattggatgcagaaattcatatattccatatatcattatatgatccatacatattcaagcttgttaattattatttcctgaatataatctttgtttatttatatgcttgactggtcagtaatagaaaaatgttgtgtcaaaatctactgggaggggtggcgacgtagctcacccctgtaatcccagcactttgggaggctgaggtgggtggtctgcttgagctcaggagtttgagaccagcctgggcaatatggcaaaaccccatctctactaaaaatacaaaaattagccaggcttagtggcaggcacctgtaaacccagctactcgggaggctgagacaggagaactgcgtgatcctgagaggtggaagttgcagtgagctgagattgcaccactgcactccagtctgggtgacagagtgagaccccatctcaaaaaaaaaaattaaaaaaaaaaaaaaaaaaaacaaccctaaaacaaatctactgtgatgttaggtttgtccatttttttccagatttttttggcttgatatattttgagactattttattagatgcacatacttttaaaattactttgtcttactggtaatgtgaacttaaataattttgttatgatcctttctttcctagttgatcatcttttagtttaaagtttatctgataacaattacatgtagttaaacttctttcttttggtcaacatttgaccaatatgtcctttttccttctttcactttttttatttttatttttagagttggggtctggatatattgcccaggcagaagtacagtgactgtttataggcatgatgatagcacactacatcctctaacttgtggcctcaagcgatcttcccgtcttagcctcctgagtagctgggactacagatgttagccatcacactcagcttctttcacatttatacattaggagtccttttgctttttatatgtcttttataatagccattagttggattctttaatcttataatctttattttttaacataatgatttttgatttttgttcatccctcttgttcttggcttcataaaaaaaattgaggccagctgggcgcggtggctcacgcctgtaatcccagcactttgggaggctgaggcaggtggatcacgagatcaggaattcaagaccagcatggccaagatggtgaaacctcatctctcctaaaaatacaaaaattagccgggcgtagtggtgggcgcctgtaatcccagctactcgggaggctgaggcagggagatttgcttgaatctgggaggcggaggttgcagtgatccgagattgcgccactgcattccagcatgggtgacagagcgagactccatcttaaaaaaataaacaaaaaataaaaattgaggccaggtgcagtggctcacgcctgtaatcccagcactttgggaggctgaggtgggtggatcatggtcaggagtttgagaccagtctggccaatatagtgaaaccccgtctctactaaaaatacaaaaattagctgggcatggtggctcatgcctgtagtcccagctacttgggaggctaaggccagagaatcacttgaacccggaggttgcagtgagccgagatcgtaccactgcactccagcttgggtgacagagtgagacttcatctcaaaaaaaaaaaaaaaaattgagtgccttttacccagagcctcaccaacagaattgccaaacttttgattttttctttttttgccagtttgatcactaaatagtgatgtttcatcttacctcgaatttttttttttcatgagtgaagttgagcatcttgtttaaaaacatttgtggccaagtgaagtgctcaggtctgtaatcccagcaagttgggaggctgaggcagaggattgcttgaaaccaggaatttgagatcagcccaggcaatgtagggagaccccgtctctaaaaaagaaaaattaaactggtgtggtattatgtacttgtagtcccagctattcagaaggctcagggaggaggatcacttgagcccaggagtttaaggctgcaatgagttattattgcaccactgcacccaacctgggtgacagagttagactagatctcttaaaacaaacaaaaagtttacttttctcttttctgtaaaatgtctgttcatatcgtctctaccacacttatttttttggtgggattgtgtctttttagtgatatctgtgtttttttgttttttgttttttgttttggagccagggtcttgctcactgcaacctccaccttcctcaagcgattctcctgcctcagcctcccaagtagctgggactacaggcatgtgccaccatgcccggctaattttttgtatttttagtagagatggggtttcactgtgttagccaggatggtatggatctcctgaccttgtgatctacccgccttggcctcccaaagtgctgggattacaggtgtgagccaccgcgcccggccttaaacaagtttaaacacacacacacacacacacacacacacacacgttttttagagttggggcttgccttgtagcccaggctggtgtctaacttctggcctcaagtatttctcccaccttggccttccagatagtttggattatgggtgtttacccctatgcccagctctaaataagttttaatgccaaccatcacttctatttgtagagattcctaatgccacccagtgtaatgcttttggggctatggcagtgtaaatttggttttctcactgctgtttataattcagctttcttgggtctattgagttgatcactgcacctcactctgctttccactgtccaaaattttgtcaccattatttttttgtttttcttgtctttcagagttttagtgaggtttcaggaggaatcagaagttcatgcatgtattaagtcctttggttttactgaaagtttgacacatattttgaattgtagttattttgtctttcctaatttagatgcaaaattaagttgtctagtgagatactcagttaatcaagttgagatattaagggttacaaaaaggtttaccacactggtttatatacaggttaagtatccataatttgaaaatttgaaattcataatgctccaaaatctgaaacattttgtgagccgacaagagactcaaaagaaattttgaataaggtatactcaacttggataatattcatttgaagcatgtaaaggaaataatggctgttatgtgttatacacaaatgtgaagatagtgttgatttgatgctttacttttgataatgttgatctgatgccctggttttgatcacttaacagatacccatgtgctttatgggaagttgagttcttcttatgctcatgggctgagcccgaattaatccaaatcagtaatggtaattttatgccctctcccattgatttgatagtgagtggccttgagagccagttcattgggggaagttccccacttttttggtaaagaaacataagcaaggggaaggcagtctctcttatgatcctagacattaaattgttacttgcaactagtgtagctactttgaaaccgttaggggacaaaaagtcatcacactaaagatgacacaggaaaaacaaggaaagaacttaggtccatgatcttgatgaggcatcataaattacctatccctggagctgctgtagctctggactttttgttatatgagataataattcctcagattgacttagaataccaatcaaaataactattattttagctagctaagaaaaaaaatctgagtaaataccataaggttcagattacataaatatgaagatcaaaactgcaagttttctgagaagttagttattattgttttttactaatatgagctgcattggaaatttattttctttttaaaaaattattgctgtctttgtccataacttttatggacctgacattttagttgtttggaaaaattggtaattttaatcttttgttttggtatgattcaggttgacctgacattttaatacatctggctcctaggactgattaaagagacattttatttgttgaaatatgcacattttcttcatgaaattggttttcttttttatgtgtgacttttcttgcaaaagcttacaaggcacatgcttttgatagcagtgttacatttttaattaatattttagatgtaaaaggtgacagtttaaaagattgttttattagtgggttatccttaaaagcaagtggcatttggttttattttacaatagagtttaatcttacatgttttttgttaaagtaatgttaccaaaaaatctcttattgaactatttgtggtgaactttttaaggatgtttaagatttcacatgcagtttaactgatcacagatgaagttgtaaattaatacctcatgagcgtatttgactgcagggcattgttgtgaatcaaaaccgctttgttcctgtaaactgtgaaaggggtttaagcatatggattaaaattgcatggtgataccgaagtacttatgaaaagacactgtagttggatcatttaaaatgtactaaaatattacgaatagccataaaatataataattccctgaagcttttaagagtggtaagatttagttttatttctttgttggatttaactactttaataagaaattgttttgttgcttttggaactatgcatagtaatgagaataaccatgatgatgagaacactggaagcttcccagaaaacatgtatttcttcagaaatgttcttggttgtgacaaatatatatatgaagcttttccttgttcccatctgagtcattcccttaccagaacctttagaatgaaaggtttaatgatatcttctagtataagattatgaaatgagcattgtttagtgtaaaatcatatttttcttttgctgttaattttgtcttatagtatatgaaaatcacctggtgtagaatgtatttttcctgccataagaaactgtcaagaatctattgaaaaaataccatgagagtagttgttctggatgacaatggtaggttctgatttactgacgtagaagcaagcttcagttagccactttagtcataggtaaacactagattagcctaaggaaaaattgttgggaagcttttggagttctcatctgtgtcactgttttagatctcttcaagttctttgaaaattttggtacctccctgtttaacaaatattctgttttctgctatctaattagttctcatgtagatgacgtttctaatactaattaccacactttcttggactcctcttttataacgacctttatctccattccatttgatcaactgttttttaggactatgttctgaacctacttcctacccaggactgctttaaaaaaagtaatctatgttagcttcctgtttggcttcttcctagtttgactttactctctatatacagcctgagtggcatgctcggttatttcagctacatcttaccattactcagttctctctcccttttgaccttgctggtttctaaatctgggtcaatttgtgtgccttgcttcttgacttgatattacaattaacttattttgtcatactagatgttttcagccatctttgatccccaggttgctcaccaactcttattatcctttgaaatgactctcaaatcttacccctctttttgacttttatgtttgttgccctcatcttcatcttttttttttttttaatgagacggagtttcgctcttgttttctttctttcttttttttttttttttgagacagagtctcgctcttgcccaggctggagtgcagtggcgccatctctgctcactgcaagatccgcctcctgagttcacgccattctcctgcctcagcctcctgagtagctgggactacaggtgcccgccaccacgcctggctaattttttgtatttttagtagagatggggtttcaccgtgttagcctggatagtcttgatctcctgaccttgtgatccgcctgcctaggcctcccaaagtgctgggattacaggcatgagccactgcgcccagctcgctcttgttttcttgttgcccaggctggagtgcaatggtttgatcttggctcactgcaacctccgcctcctgcgttcaagagattctcctgcttcagccttctgagtagttggcattacaggcgtgtgccaccatgcccggctaattttttgtatttttagtagagacagggtttctccatgttggccaggctggtctcgaactcccgaactcaggtgatccgccagtcttggcctcccaaagtgctaggattacaggcatgagccaccacgcctggcaaattctattttttttttttttttttgagacggaattttgctcttgctgcctaggctgtgcaatggcacgatctcggctcaccgtggcctctccctcccaggttcaagtgagtctcctgcctcagcctcccaagtagctgggattacagacgtgtgtcaccatgcccggctaattttgtatttttagtagagacggggtttctccacgttggtcaggctggcctggaactcccaacctcagatgatctgtctgcttcggcctcgccaagtgctgggattacaggcgtgagccactgctcccagcccttcatctcttacattaggtgccatagcactcacctctgtggctctgtttcttctatcccaacagcacatgagggattgggtccccttccatctctccaactccctactcctactaccacataaattaacagaaactccctttagtagtaattctcaaatgaggtgccaaatcttggtctgtatggaatgtgtatttggttttaaaaaaattctaaaagtgattctcttctgaggtcctaaagggtcttttgcaggacttcctcaaattcgtcttttacaatgctataggagtcatctttgtcaaacatagatttactcattttacaactgtgtaacaacttattttttgccaagtattgggatagctactggagttagtaaagtgaatattagggtgcttacttttgagaaaaatgctaataatatagtatagccatcatttactggaacttttttaagtgctaggcacttcatgtatttatccttataatagtccttcagtgtagatattattagccactgtacagatgagcagccattctcagaattctgaggactcacatagtaattcattaggcaagtgataagctttatgataaatacttgaaagggacctctaagagcatagaggagggatatctagtttagagttggaagattaacagaataggcttcacagagaagatgatgtattaagctgagtatttaaagacaagtaggaacttagacaaaatgatagattggaaaatgagtgtgtggcatggttatatttgtgaatagtctttgtacagagatataagagaagcattttatgagaacacctggtgctcacttaggcaacacatatactaaagttggagaacagctcaatatgactgaagcatagtatgtgagatggggaatttagagtggtttagatataaagacattaaactaggttgtattttatatatttatacatctatatctatatatctatatctatatgcatctgtggtcccagctactaaggaggctgaggtgggaggatcgcctgagcctgggagatcaaggctccactgagccgagattgcaccattgcactccagcctgggtgacagagtgagaccctgtctcaaacaaaacaaaacaaaacaaaaacccagttagactgctggaatagtccaaataagaaatcaggaggccttgaaacgtgtcagtgggattaaagaggagagaggtggaattgaaggttatctggtaggtgcaatcaacagacttagtggtttaaaaagtgagtgagaggttatagtcaggttgggactatgtattaatcctttatttttttaatttactgtactgtactatgtattattgttaatatcctttatttcagattgacatatacccttaaatattcttaagatcatatccttaaggtcttaatagtctctgaataaatattggtataagctgcttcctaaatgatttcccatttatttactggtgtttttatatatctatttagagactgaatctcactatgttgcccaggctagagtgcaggagcatgatcatagcttactgtaacctcacactcttgggttcaagtgattctcctgcctcagcttcccaagcagctaggactacaagtgtgtgccaccacacctggctcattttttaatttttgcagaaacagactcttgctatgttgctcagactggtctcaaactcctggcctaaagcgatccttcagtccctgcctcccaaagcagtgggactgcaggtgcgagtcaccatggctggcttgaggagtgttttttaaaacatcctggccaactgtgagcattgagacatcaatttatcaaggctttactgagtgctcaagggcccaggcacattctaagtcctggaagagggagcacagtggaagttctaggacttagctatctagttaaatatcttcagtttaaacagatttactcattttacaactgtgtaacaatttattttttggcagtttctgaacttccagttttcacgttctctagtattgacaacaagctgataatcttgctagacacaacagactcttgaggaaggaattattcattgtggtttatagacaatgatatttgaagttaacttgccccagggcaggagtatggttcttatataatgtaggaaaaggccagtcaacaccagacctcagagctaccatttaatgcattgtggcaaatgattcgcatgtattatcacacttaatgctcacaagaatactaccatgaaatagttaatatttaaaacaaatttttttattttttaaggagactgggtctcactatgttgcccaggcttgtctcgaacccctgggctcaagtgatcctcccacctcagcctcttaaagttctgggattacaagcatgagccaccgcgagtggtctttatcattattatcgctgttttacagatgagaaaactgaggcacagagacctgcttatggtgacacaagtaggaattgaaaagatgagatttgaatctagctggtctaatttatcctgaagttcaagatagcaatacaagaattatgaacatataaatggagtgagtggatatgatcgctcaagataaatctcttggccgggcgcagtggctcacacctgtaatcccagcactttgggagactgaggcgggcagatcacgtggtcaggagatcaagaccatcctggctaacatggtgaaaccccctgtctactaaaaatacaaaaaattagtggggcgtggtggtgcacgcctgtaatcccagctactcaggaggctgaggcacgagaatcacttgaacccaggaggcggaggttgcagtgagccaagattgcgccactgcactccagcctgggtgatagagtgagactccgtctcaaaaaaaaaaaaaaatctcttggatgagaaaactagacttaggatttaaggaaatctacgttaatggactggccagaaaaacaagtcataaaggaaaattaggaagtaatcatgagagagggggatgttatgtcctattacctgaagcagaaatataaatggaaaacatatcagtgttattaactgaagggaaaagaaaatataaaaatatatctgttataaaatatattctgtataaaactcgaataccagattgttgtttgcattgacgttgcctgtaatcccagcattttgggagggtgaggtgggagagctcaggagttcaagaccagcctgggcaacatgatgaaactccatctctacaaaaaattagctgggcatggtggtacatgcttgtaatcccagctactcaggaagctatagtgggaggatcacttgagcccgggaggttgaggctgcagtgagccataatggtgccactacactcctgcctggggcgatgtactgagaccctgtctcaaaaaaaaaaaaaaaaaaagagaaaaaaaaatttttaagtacttttttacttagaacctttcaaatgccatgttatgtgtctttatatacagaaaccctgggcaaagacagtatggctctttttttaagaattaggagacatgagtgtaaagcatatttgtaaataacgggcaataaaattaatgcggaaggtttggcttacattatttggggagggaacatataaaattcaatattcaaattgttacatcaacttgaagtacagtgaatcatgactcagaaaatgtatgaagatgagacaaggtagttgcctattggaatcttaaatgatacttttagtagagatcatgtaaatctgtgttgatgttaaagaaaagtgaacataggctgagcgcagtggctcatgcctgtaatcccagcacttcgggaggctgaggcaggcggatcagctgagatcaggagttcgagaccagcctggccaacatagcgaaaccccatctctaccaaaaatacaaaaattagccaggcgtggtggcgggcacctataatcccagctactctggaggctgaggcaggagaatagcttgaacccgggaggtggagattgtagtgagccgagatcacaccactgcactccagcctgggtgacaagagcgagactccatctcaaaaagaaaagtgaacataaacttttaaaacttcattacagagtaaaaagtcttattacgtttttctggccaaaatttataaacttttaaaatatttcagtgaagttgagctatattagaggtatctctttatgtacctctggaatggaactttgataactgtttattacagtagaaaataggatctaaaatgggtaagttcattatttcactttgctttcttaatattcatggaaggtattttgccgaaattatttttggagagtatatgaaaagtaagtaatattttataaaactgtattgcagctgatttggagaatgagtggctactttgaaaattgtcagtagataggaaataaaaataacagaatgaagcagctcacacacttcagagtttattctcaatattgttgaattgggccataatgaagcataatgcctggttaaactttattgcaattcaaacatcccaccagaaagaaatttttaaaaactatatcaacaaataaattcactgaagtctgtctatagcttcttctaggaactacaatttatttatttgtttattttaatattgttttttgtagagacaaggtctcactttgttgcccaggctggtcttgaactcctgggctcaagtgatcagcccgcctctgaaagtgctgggattacaggcatgagccaccgtacctggctgaaggaactacatttttgatatggtactctgctttaaacgcagtaggtactctgctgaattgggctaaataaacatttcacctctcaaaactatgtgaatatttggcttaagcaaagatagcctgggaccatgaagaaagctaaaacacttaaaaaaaatgtacccttatttaaaaagtagcatgtttctttctgatttggagtgttatgtttttgttgaaaaattggaaattacataaaaccaaaatgaaaaatatagagatgatcagtaatttcaccatgaatataatactcctcttatcattttgtattcccttccaactaatttttctcttaaaagtggcactatgtttttgaaaaagctgactactttaagaaaatttctctcagtttactttcttaatcgtgtgcttttctgaagagttggctctgacgttgactactatagtaaatccaattttgatgagtttttcttttttagtgggccaaaaaaaaaaaaaggaaagaaaattctcctttgtagaaaaaggagggaggatggaatgtatattgtagtacacctgaaaatccataccttttcttagccatatacacaattagtttactctttctcaagataatatttttatagtaaattaggattctttgttacaagtgatgggaaaccaaactagtgctatgctaggttaaaaaaaggaatttagggactcaagtcactaaactactcacgcgcacacacacacacacacacacactcacacacactcacataggggttcaattgggccttaggaatggctaaatctaaggtctcaaaagctgtcagtttttttccttcggttcgttctttgtctctgagagttagcttcactttgtcagcctgcttctttatactcttcctgtttttcactctgacttactgtgtttataattatcttgggttagtttttcttattgctcatttggaaaaactatcagtacttctgattagtaatttcagatgtttttatattttaattttgtatgcaaaataagtatccgtgatattttaaaaatatttactaagtatttccctagtctttctctaaagggtaatctcaaatgaaacaactggaactggattctcatttgtttaatgactgaagaagtcttccaattactctacaaaccattgataacttttgttatttgtgaccagtattcatctagtaagatgttaaatgcttttatgaaagagacaagtgttttacctaaagaatgagaaaaaaaaaaccctaattttttgtgaagttttctccttttttgctgagtgcttaaagaaaaaaagtttatgttgttttaggtttttcttcttgcttatcaccctaggaactaattgtgttactttttaaatgtttaaatttaatttttcctgtcccttccccatgcttgctaattatgttttttaaaggtgaccctttaagatggctcttatagaataaagagagacactgaattttctaatcttgtggaagaggttatatttagccattggtattttaagttggagcacttcattctactgtgcctttagtttatgagtcatctggagaaaatgggctgcttcttgcttttaggaagagtctgtagcaaataataataataagtgctatgggagattttttgccaaataatttaaaatggaaaatgttttgtaatatattttattgcccatatgtaaaatacgtactaaagaatataggagtttttggctcattattatctttagctcataaaaataaacaaaagaggctgggtgcggtggctcacgcctgtaatccagcactttgggaggctgaggtgggcggatcacgaggtcaggaaatcaagaccatcctggctaacacggtgaaaccctgtctctaataaaaaatacaaaaaattagccgggtgtggtggcaggcacctgtagtcccagctactcgggaggctgaggcaggagaatggcgtgaacccaggaggtggagcttgcagtgagctgagaccgcaccattgcactccagcctgggtgacagagtgagactccgtctcaaaaacaacaacaacaacaacaacaataacaacaaaaccctaatgtcacatataacaaaaagaaagcattttctaccaaaacattatatagattgttatgagttataggtaagtggaaagcaagcataaaccatatgaaattattttatatgcaggatgtacagcagtggtcaaatcttaatgataattgtcagtaactggggagaatattgtgattattgaagtattgattttttttcaaatatttttatattacatgtggtaactttttataatcttgttttatatctactttagtatgatagctttaccatactagatattctatgaggggtagacagttggcaaaggatgtgatattgattctaattttggctacctttgtattatgtgtatcataatgatttcacgcttcagttttctcatctgtacagtattttgttcttcgtgacttttcttgcaggaatgaaaggaggtagcatggaacaaagaaaaaagtgtatcatattgtaaaacaggaaattttaaagtcctagagttcagattttaaatccaagatgtcatttttgaggtaaatttgtcaggtctccctgggacacagaatgactgcatcactagaatcatgagcccgtgggattgtttttttctttttctcaaatgtatttatttaacatctctctccctctctacttacctacctgcctacctacctacttacctctgttgtgaaacttttgggagctcagtattgtctactataccaagaataccagtcctttactcatttttttgcattacaaagatcatatggaatatactggaggggaatttaggtcttttggttctgtgttagaagagcccattttgtttttccctgcatgtggtagtcggtgtataggcctgtttctgtgatgggaagatgacaccttttgtcaaatctctatcctttttgtatgtcaaggaatcatttctttgcagtgaagtagagtgtgccctgtagtatagcactctgtgtccttagtcatagcaatattggaggattggagagttaatcatgtttgagaagttaggggacttgttctttcagcatctatttaatgaatctgcttgtatttttgatatcctaatgtgtcccaacactgaactcctaatctttcctctaaaacctgttccacctgcagccctctctatttcacttgatggcagttttatccttctcgttattcaggataaaaacctgagactcattcttgtttttcctctttctcttatatcccacatctaatccttaaggaaattatactggcaccacttgtgaaatatatcctgaaatctgatcacttataccatctaaatcgctaaagtcatctgtacccccacctctcttttgtgccaccatcatcctttgcctagatttttgcagtagcttcttagttactttctttccacctttgctgccttcaatatcttgtcagcacaacagattggcggacattttaaaaacgtaagtcagataatgacactctaataaaaatgagaaaggtttaaaaatagtaaagataggaagcctggacaacatggtgaaacaccatctctacaaaactagctgagtgtggtggtgcatgcttgtggtcagctactcaggaggctgaggcaggaagattgattgaacctggaaggttgaggctgcagtgagctgtgattgtatcacttcactccagcccccgtgactgattgaaaccctgtctcaaaaaaaaaaaaaaaaaaaaaaaaaaaaggaaatattatttgcaggtgaaatggttgtatttagaaacaagaacatttaagtggcaggtagttacagaattgatacacacaaatatattttttatacttttgtatgtttaaaaaagccacaaattacaaattatgttaacagcaatataaaaagaatgaaacatgagtggggtttattctaagctgagttgttcaaaattagggtatctattaacataatttacgatgcttctcagagggtttctgttgttcactcagtgactgcagacccactagtactaatgaactactctcttaacttgttattgaactacaccttctccaatgagtctgagtctttaacattgcatactcttttaatctgccttggggtactatatagagctttcttatatcttatagttactcttttattagagttaaaatacttctttatgttaaacttctgtttaccttactctgtgatttatatcttttgattagaaaagactaatgtaccatattagtaggtttttggataaatttttatattattttcatagatgctagaagagcatttgccaaaattcatcattgattcttttattaactttttgtgaattaaagtataacatacatagaaaggtataaaaatcataagtgtacagctgaaagaattactgcaaagtaaacatacttgcttaactaccatttagttctagaaatagaacttggccagcagcccagaagcacccctcacccccaccttcttccccaaaggtatcttctgtcctgacttctaacattggagattacctttgctgttttaaactttaaatatatggaatcatatagtgtgtactttttgtctctggcttctttggctcatcattataagctttatccacattgttgaacatagcagtgcttttgttcattttcttttccatgtcctattccatcatatgaatttatctcagtttatttttatattctactgttgatgatgaatatttgggttgttactagtttggccatattacaaataatgttggtatgtgaacattcttgggtgtgtcttttggtgctcatatgcacatatttcttttctttctttttttttttttttgagatgaagtcttgctcttgttgcccaggctggagtgcaatggcacagtctcggctcattgcaacctccacctcccgggttcaagtgattctcctatctcagcctcccaagtagctgggattacaggcacacgccaccatgcccagataatttttgtatttctggtagaaatggggtttcaccgtgttggccaggctagtcttgaactcctgacctcaggtgatctgcctgccttggcctcccaaagtactggaattataggtgtgagccaccacccctggcccaaagtgttatctttagaacagcagaaatgggagttccagtttttccactgttattttctatcttcagacaaacaactgtttagttatactggtaaactggcagtggtatatcattgtagttttaattgtatttccttgaccatgaccactaataaagttaagcttttaaaaatttatttatatgttgatcaattagatatacttctttgtgaattacttaagttttttacccagttttctattgggtgtttaagaatattttatatttatttatgtatttatttttgagacagggtcttgctccgttgctcaggctggagtgcagtgatgtgatctcggctcactgcagcctccgcctcctgggttcaagtgattctcccacctcagcctcctcagcagctaggactacaggcgtatgccatcatgcctggctgatttttgtattttttgatagagctggggtttcaccctgttggccatgctggtctcgaactcctgaactcaggtgatctgcgtgcctcagcctcccaaagttctggtattcatctgcaagccaccacgtccggcctgtttaagaatttttaatgaatttggctggatgtggtggctcacacccgtaatcccagcactttgggaggccaaagcgggcagatcacctgaggtcaggagttcgagaccagcctggccaacatggtgaaaccccgtttctactaaaaatacaaaaattagccgggcatggtggcacgtgcttgtaatcccagctgcttgggaggctgaggtgggagaatcacttgaacctgagaggcggaggtggcagtgagccaagatcactttattgcactccagactgggcgacaagagcaagactctgtctcaaaaaaaaaaaaaatttttttaaatgaaaaatctctgtactcagggctatgacactttttggttggcatatgtctttttggacttgttctttcattctttaaatggtgtctttgatgaaccgatgttcttcattttaatatggaccctctttttggtgttcctccctttttttagttttcagaagatattgtctatgattggttttacttctattggttttatttcttaaatgtttggtggaattcactggtgatacccttgaagcctggagttttctttgtaggaatgttccattaaaaaaaaaatacttaaagggctttttagattttttttcacttcttaaatcaactttggtaaaatttctttttctaagtatttgtacattttgtcttaagtgttaaaatgcgttagcataaccttttccctacagtatctttctgtgatttttaaatatgcatatgacctatcatttctgctaatgattatttgtgccttctttgtaagagttcatcaattttattagcgtttcaaagaactaactttggctttgttggttctctgtagatcatgatgtatgttttctatttccacgtatttagctccttttttttttttttttactttctttgggtttcatttgcagtttttttccttaccctaaccctacagttgtttttaaaaaaagattcttgagatggatacaggaccatataaaaaattttttttatgcatggcaagaagtttgcataaagtcagaagacaaattacaaacttgtaaaaaaattatttaataccaattacatcaaagtccaaggcctacttctttaatatgtagtgagtttctaaaagtcaataagaaggaaataattatgtattaaaaatgagcaatgtttgtgaagagttgatgtgtagaaaagttaatattaatggcagtaaaacatatgaaaggatgttcatcgtctcatgaggaattcaaaataaaccttctattattaaattggcaagtattttaaaaatcagtaataagtagtatgggcaaagttatagagaataggcgctttcataagctatcataaggatataaattgctacaacctctttgaaggagaagtttacattatttatcaaaattttaagtattcttttttttttttttctttttttttgagatggagtcttgctctgtcacccaggctggagtgcagtggcgccatcttggctcactgcaagccccgcctcccaggttcacaccattcgcctgcctcagcctccggagtagctgggactagaggctcccgtcaccacgctgggctaatttttttttgtatttttagtagagacggggtttctccgtgttagccaggatggtcttgatctcctgacctcattaaccgcccctctcggcctcccaaagtgctgggattacaggcgtgagtcatcgcgcccggcccttaagtattctttaattcacgaactatgtgtataaagatgtttatttccatattacctataaaagccaaaaaactagacataacctaaatgtttattctagagactaggttgtagctacccaatggaaaactatgtagccactaaaaggcaatagactgttggtactggttgttacagaacaagctccaggaaagtttttttgcagaaatacacattttattaaacgagtttgtgggtgaagtgtttgtattttgtgtgtgcatagtaagtttctgaagtgcataactttgtgtatctcactaggtaaatttgagtgttgtatttatggagttggatttacaacatctggtatttactattcagtatcactttaggttatgtttcgttttctcacttatattgtaagctcatagaaaatggaagatatggactgtgttttatgcttcataattttctccacattgcctagcatagtatattgagtgtgaaacagacttggtttttaaaaaacaatttaagaacaaatttaacactaaatatttgttttccagtttcagaacctgttcacattatctttggtgagctgtattgtagctctctgtagtagataggtataatactcattaatttattcatatgttaccatagggcgaactgagcccaagtgaataagtgagttatttaaagtaggggttggcaaactatgagctgtgggctaaatttgtcccacctcttgttctttatggcctagaagttaagaaaggtttttatatgttttaatgtttgggagaagaaagcatattttatgacacatgaatgttatatgaaatttaaattttagtgttcataattaaagtttattagaagacactgatgcatattcctttatgtattgtctatggctgccttcccaccactatggcagaattgagtcgttgcaacacagattggagttggcattttcattgcttcacactgctgcttggcatactacacatctcagtaatgcagttataattcaacagtgtttcaagtgccatatgtattgctgtgctataacactgtattttttttttattactagggcatacctatatgtcaaaacaagaaaaggagaaaatctcatggttttaaagcacagtggactggggattattttatccaattagatggtaaagcattaggtttattatgcccttctaaagaaatagaatatatattgccattaccaggctaagcacttacagtgttccaaattcataggaacataattctcataaaaattcaaaaatttgaaatgtaatatgttacaacagcagaatttttcatgcactcactttttctctcactcactctcacactgaaaaggaggctggacttaatataagattttgaatgacccatttgttagcaaagcaaggagagctatttactaatggtaagttagtaaattttcattgtagcagctaaagaatattttcagaaaaaaattacatttttaaaaatatcattagccatttggtgaccatagttgctttaagaattgaggacattaggctcgttgcagtggctcacacctgtaaccccagcattttgggagtctgaagcaagaggatcacatgagcccaggcgttcaagaccagcctgcgcaacatagtgagaccctatcttttcaaaaataaaaataaaaagagtattgaggattttaggccaggtgtggtggctcatgcctgtaatctcagcactttgagaggtgaaggtgggagaatccacttgagccctggagtttaaattcagcctggacaaatggcaagaccctatctctaccaaaaaaaccccccaaaaaaacaaaaacaaaaacaaaccagaattgaggacattagccaggcatggtggtgtgcacttgtagtcttagcttcttgggaggctgagatgggaggatccgtttgatcccaggagtttgagttcagcctggggagcatagcaagaccccatctctaaaataaaaacaaaaaagtgaattgaggacattgggtgtaacatcggtagtcagttaaagaagatagtggttttacttggctctgatgaaccaacagatgttactgacactgatcagttattcaaagagccaatgctgagtttgaagtgactgaaaaattagctttcatgaaaagtcgatgaaacatctgcagacgtgaatattttcaaaaaatttgagaaaacactaattcagcataatctgaagtagaatctgttaagatgtgttgctactgatagtagtaaaaatatatgtggaggccgggcacagtggctcaagcctgtaatcccagcactttgggaggctgaggtgggcagatcacttgaggtcaggagttcgagaccagcctggccaacatggtgaaaccccatctctacttaaaaaaaaaaaaaaaaattagcagcgtgtggtggcatatgcctgtaattccagctactttaggaggctgaggcaggagaactgctcgaacctgggaggtggaggatacagtgagctgagatgatgccattgcactccagcctgggtgacacagcaagactctgtctcaaaaaaaaaaaaagaaatatatatatatatataaaatatattaaaatacatatttatatcataaactttgtagatttctccacttaacctttttgctccatatatattttaaatatacattatacatatatatggatcagaaaaaagggttaattggagaaatctacaaagtttgtgaaactataaggttgtaaagcctatggctattcattgtattatttattagcagctattttgtagacaacatttgaatctatgatttattatttgaatatcatttattattgaaccagtattatcaacagtgaacttcatttgctgtatgaagagatagttctgtaagtttttatcagaaatttaagctgtatatttgacttgcctgaccacccatcagtttgattactgcagttgtttgagcttatggtcaagattcaaatttttctaaacaaggagaagctccttcaactactgttattgcatatgaaatggctttgaaaattagcttttactgaagactttatattgtttcttttctttcttcttcttcgtcttcttttttttttttttagaaacaggatcttgctatgttctccaggttggtcttgaactcctggactcatgtgatcctcctgcctcaagctcccaaagtgttgggattataggtgtgagccatcatgtccctggctaatacattatttcttaatgatactgatattgttgttgtttgtttctttctttctctctctctctctctccttgtttccttccttccttccttccttccttccttccttccttccttccttccttctttccttccttccttccttccttccttccttccttccttccttccttcctttctttctttcttctttgtctcttttctcttttctcaacagggtttcactctgtcacgcaggctggagtgcggtggtgctgtcttggctcactgcaacttccacctccctggttcaagcaattctcctacctcagcctcccaagtagctgggactacagcctcatgccaccatgcccagctaagctttttgtatttttagtagagacaggatttcaccatgttgaccagcctggtctcaaactcctaatgtcaagctatccactcactttggcttcccatagtgctgggattacaggtgtgagccactgtggcagcctttatatggtttcttaattttgaggcataccagtgcttatatgtaaaacttatactatggtaaagttatttgacagcagctaatgtagtttgaatcacaagtaatgtcaagctgctttatatacaatgtcccattctgtcaaaagttaaaacaagaagtgatacttctatttccacacacatttgtagcagatgtttgtgggctcaaactatagttttagcaatattgatgccagagcagagataacttctttatttcaaaatccatctaacactgcaatcacggagcttctaccttatgttacattagaagtgattaatctgcaatctacatgctaaaggggaaatatcaagaaaaagctctgatagaattctataaatgctttctaagtgataaatatgcttaatttaaatcatatgctattggatttatatcagtatttgggagtatctatttgtatatagagacattcaaagttgaaatatgtgaaattattatagatcaatgttaacagatgaatatttgcgatcaattttgattgataacagtaactttggccaggcacagtggctcacacctgtaatctcagcactttgggaggccgaggcaggtggatcatgaggtcaggagttcaagaccagtctggccaatatggttaatccccatctctactaaaaatacaaaaaattagctgggcgtggtggcgtgcgcctgtagtctcagcttctcgggaggctaagacaggagaaacgcttgaacccgggaggcggaggttgcggtgagcccagattgcaccactgcactccagcctgggtgacagaatgagactctgtctcaaaaaaaaaaaaaaaaaaaaagtaactttaaacaccaattaaatgaaatgttatttcccctaaaagaattacattcttctcattactaaacctgataaacaaaaaattttattgttattaatattcctaaatttgtcagtaaaagttttttgttttataagtacctagataatgtccttggtttttttctcattacccatagagcccaaactatttactacctggccttttacaaagaaagctttctgaccctcatcttcttctaaaagaataatagatgtctaattagaaaccagttatgcattgggttgagtatcctttattagcattttaaagttcttgcatttcgaaaatactaaaaatactcaaatttagaaaagttagttgtcttcataatgtaatttaaatgtttgaagtgttacaaaagagattcacctgcaattaaatatcagcagagtgtgtcctgtacccttatcctgcaacacttttctcctatagtaactgaatgactttggaattcagggctttgtatttttacctttttttaaagcttatttttgctttcttttcttttctgttttttttttgtttgtttgtttttttttttttttttttttttttttttttttttttgagatggagtcttgctctgtcgaccaggctggggtgcagtggcgtgatcttggctcgctgcaacccctacctcccgggttcaagcgattcttccacctcagcctcctgagtagttacaggtgggaccaccatgcctggctaattttttgtattttagtagagatggggtttcaccatgttccctgggctagtttcaaactcctgagctcaggcaatcagcccacctcagcctcccaaagtgctaggattataggcatgagccactgcccccagcctgtttttgctttcaaatggactgttgatggttttctcagagtgctttacttttgaagtccagtttgtactggaaagaatttatattccaggctgggcacagtggctcatgcctataatctcagcactttgggaggccaaggcagatggctcacttgagtccaggagttcaaaaccagccggagcaacttggcaaaacctcgtctcttaacaaaaatattttaaaatgagctggttatagtgctgcatgcctatggtcccagctacttgtggcactgaggtaggaggttggcttgagcctgggaggcggaagttgcagtgaacccaaatcgtgccactgcactccagcctccattacagagggagagcctgtctcaaaaaaaggaaacgaatttatattccacattttactgagtctagtgtgagtttttgtttaaaaaaaaacaacccaggaataatttcttcaaattcataagcatggcaggcagttttattttaaattctgtgggaaatatgaatttaaggatctcatgtaccatgccttgataatcatttctctgtaatgtatattttggcaaatgatattgttatgaaacatacttttgcattaatattaactttatgcataataaagatgcatcttcagttttttgtttgtcctatgagagtttacagctggggacatcttttacaaaagtatatttataacctgttcagaagatatgaaacacaataatgagataatcacctatgtatttttcagttagcagttacaaaaggattattgacacttatagttgttaatatctcagtaaaaacatactcttgtgcttattttaaaattgaacgctagtctatatttttaaagtttccttttatggaatattttgtcttttggcactttgcatctggattatagttcccccatttaagaaagaaacctgtttctattcaataggattaaaaacacactttcagttttagagcagatttatcatctacccttcaggctattctttaatatggagctcttaaaaatgagtatattaagatattccccagatgttttaaacttcagcaaacttgtggttttctttatttgtagtatttggaagatgaaagaaagtatctccagtatctaaacacttttcatattggttttaatgttgttttttttttttttttttttttttttgctagaaaggcatgcacaagataaagcttctacactgataaattttcaaagtccttgcttttaaaatatcaagctgggtgcagtggctaacgcctgtaatcccagcactttgggaggctgaggcgggtggatcacctgaagtcaggagttcgagaccagcctggccaacatagtgaaaacccgtctctactaaaaatataaaaaattagctgggtgtggtggctggtgcctgtaatctcagctattagggaggctgaggcaggagaatcgcttgaacccgggaggtggaggttgcagtgagctgagatcgcaccattgcactccagcctgggcaacaagagtgaaactcttgtctcaaaaaaaaaaaaaggtattgtcaaaatgagagttgtattagcagtaatgtaaaagtaatattgtatgtctgtatacttttgaatttacattgttatgtgattcatatttgttttgtatagctgtaacatttggttaattgtttagtgggttattgaatagattattttcttcattacttagtacagtggggattgagaatgctttgtatcaagtgtcttacaagtattgggaagttcgaattaaaaatattaaagatgtcagtcatttacttctttttttttttaaggtggtagcccaattgaaaattttctgcaaaatcagtaactaagttatttttccacaattataaacttagttgatggcatttattgagtgcttactacgttcaaggtaaatgaaatgaaagagtggaatagtgcattatacacgcacacactcaagggaagcaagtataaacaccttatttcatctcacttgtttagaaatttgattttgttttttcttgctgggtaacatatctgtgttaatcgaaaatttatgacttagagtggaatttctctaaaaagcagtaggtgacagggatacaagataaataatttcatcagagaatagaaattcttttttacaatggataaaattgtgcttgtaacagggatacaagcacaaaccaaatcaatgtttaattattttaaaaatattcaagggaaatctagttttgttaaaatttgtataggttggtagtgtgcatgttcttaaaaatccaagaacaatagcagcagcaattcttatttaatctttctttagtgtgtccattcaaccattcattcatcaatttttttttctgtgtacccattattcatcaggcactatgcttaaatatcgtggaacacaaaaagaaatagtctttaatgctgtgttttacaaatgaggaaacctaatctcggagaacttaaattacagttgtcctttggtattcatgggggattggttccgggaacttcctcagataccaaaatccaaggattctcaagtccctgatataaaattctgtggtatttgtatataacatatgcatatcctcccatgtactttaatttctagattacttataatacctaatataatgtaaatgctgtgtaagtagttgttatactctcttgtttagggaataatgtcaaggaaaaacactctttacatgttcagtacatatttttccaaatattttcaatctgtggttggttgaatccatggatgtggaacatacggatatggagggccagccgtacttgccccatgtcatataattagatgaatatagaattaaagccaggtccgtctgacagagcgtttgcttctaaccattgaggaatgttgcctaccctgatgactctactataggaaatcatatattgatatcaaattgatcttatatgtctgtagtgaggaacttggccatgttggacctatccccttccctccttgctcctctcctttcttcctcccttacccccacagcttcacccctcccttagctcttttttctgacaggtggctgtttccatccctgtttgctggcaccttctccacttaaattttggtatatcccttggttccactctctgtgttcttctcttgtgtatgagtgtggattttgtgtttgcttatcctgtgtggagtttctgagcttgaatctgttaagagtatgtcattaatcaaatttggaaatttttaagccatttttttttctttctttcctttccttttccttttttagaagcaggttcttgctttgtggttcaggctgcagtgcagtggcacaatctcagttcactacagcatcaaactcttggactgaagtgatcgtcctgcctcaacctcctgagtagctgggactacaggcatgcatcactatgcctggctatttttatttttttgtagaagtagggtctcactatgttgcccaggctggtttcaaactcgtgggttcaagcagtcctcctgctttggcctcccaaaatgctgagattatagttgtgagccaccatgcctggtcaagccattattttttcaatttttttttttctgcaccgcacttcttttcttctgttactcatgcacaaatttagatcttttagtattgtcctataggtctgagtcttttttcattttttaaaaaaatcctttttctgtcctgcagattggaaaatttttattgatttatttttaagtatactgattaacagtcttcttcattttactattaagcccatctagttagttttaaatttctagttattgaatttttaaattctaatatttttattttatcttctttatcttctgtttctttgctgagtcttttcactttttctagctgtctgaagagtcctagtagtttgtggttccctggagctctccgccttggtaatccagccagagaactggggctttattttctcagctctgcacatacttcctgtgactgtaaccatgtctgggtctaagtagtaggcagatactcttctcttgcttttttctttcttgtgttttagtcaaattattttacctcttattataactttgtttattattatttaccaacactttatatgcaaattgtagattattcagattgtatcttctaccagagtgttcactcttttctgtatgaggctgatacggagtgaggggagagcttattaccttaataaaaattaagggttaagctaggtcaaagttgatttttcagtgttgacagttcagttgagcctgtttgcttctgttcctagagcctgaacctctaggacttttaattgataccagtggtctccgctctgaaacagtccaccagaatgagggtaccaaactgacctcagaggtttccaggttaatgcagaggtttctagcttaatttctttctgccttcaaaatttggcaattatgtcaaaggggaaaatgatcttttgttttaggttttcagtttccaatgttactacttcagccttatgtaattgctaaaatccctactgttttccccctattgcccccttccttatcattatcttctgctaagcacaaagtgtgaattttcaggttccacatgtaaccagtataagtatatccttccccccaaaccccagtggaaatgtgccacggatccttatttttattctccactccttctagggctttcatttcttgcctattatgtttttagttgctcttttcttgttctgtctttgtaagcacagctagagtcagagaactttctgcttttggaactattttggttaacctctttaacttagcattcagtttcagaattcagcaaatgtgttttggggcaaactagctgtgtgttttaggtttgggaaatgtcaaattttgtttctctgtcttcatgcttctggctgcaaatgttggcaggtggaacaaaaagctgccagttctggcctgcccctgtgaacaggtctcacctctccggaaatttatccactttgtccttgttgcttcagagctctttggtaccattaacaatgtgacttatgatttatatggccttcctaggtgtcatcagtaggaatgttggctgtgatgcagtatatgctacccagaatcggaagttccatatattatgttttgataagagattttaggtgtttgagtatttctgatgagtgacattttttgaagtttgctagagagaaataattagctagttattgcttaactactctctctccatatctattacatatgtttctggaatatttctatggtcagagaaactcaggcccattataaaccatggactctggtagaaatagaagctgaaagcaaaccagtaagggaggtggagtgtataatttgtgttttggaagtacctgccggtggacttgggggtgatgctctaggtttaccatgagattactcatctaattttgagaaccactgtcctgcagtatttttcttttgcttacatatgactttttctttttatgatttaaaactaaatgtcaaccagttactatttaatgaaaatcataaattggtttagtgaaattttgttgtgttcttacaatgggtagaaacctaatgcacttatcatgcatctaaatttaggaataattcattttattttaatcatctatacttatatacaaaatgcttttcagcagtatatttgattatcttaggtacaatgatcttcatgttcagagttataaatgggaataattaaacctttaaacatattagagttgaataagggcttatctaagcaatacatgcttaaaattgctttcttatcaaaaaaataaaattggaggttcaagaagtgtctttaaattacaatccttatgaactaatagcttaaccttagttttgaataactgttactttttccgtcttttaaaaagatgcttaaaaataaacgcatgtcgaaaatgttattttggcttttagcaaactgacatttgagttttttaaaacctcactaaacatttgtggtaaaagatttcaaagctttgaattttacaatttgcctgtcgattccccccctgtgttattctattaacatttgatcttaataagtataacctgtttagaatgacttatgtttttaattatttgtttagatgagaagtttaaggaataacttcatcagaaattctacttggcagttatgaatgctttcttaaggaagttaaatttttggaatttcactgtaaagattttaatcacatgtcctattcttcatacatcaatctataaatgttcaaaaattgttaatgttgtttttatgctgtgctgatgttaacacaacgtgaggtcttctttcttctcctgataatatgctgagcgcacacacactctcatatgctcactcgctctctctctctctccttccctcccacccctgagtttgaaataagttagtggctttagtttctttgaaaatggaaagcaattgcccttaggtagaactggaaattgtaaagtgttggttttgtggacattttcctgttcataattcttgttatatcttatttataagtacttttattcatataggaataaatgattctatgttgaagggtataatcatgaagtcttttttattttttcgtgttagataaggagaaaaatgacacattaaaaattacagtgctatttgtgttttaaaatttcttctgtcgcttttgtattccttattgttctcttcactttttctattgtttttctagcttttcaggatacattttctaaatgcatcctaaatataacttacaatagttgccttttatttaaaagtaatacatttagtttccaaccacaaagtgtttaattctacatatttctatttttattttacatgatcttaatatatccttgattactgtgttgatcttctagtttttaggctgccacttataccatcaaaagccatttaaactggacttagaggataatgaatctaaattttcttatcttcctcaaaacaacagatacaattaaagtcacaaataagctgtaccttcagaattgctaggagacagaacatagtaagaattcaaatctcttataagcagagttataaacatcatattccaatattgattctgctgctttgtctgtacatttggagagcagaggtagcagggaggtttaagagactgaaaaaagggagaggggtgtatgaagtgtagatcagtaacaaacaccatcactcttgaaaagaaaaagtccaacagaggtcctagacctgtgttttagacaggtgggaggacagtaaattaatttttaaagacaaaataattatattgaatgaatttattgatcattttgttgaacagttagtataaggacatcccgtattatatttcagctttcataaactataagtgtttatgtcttatattttgtgttctttcaactttatcttaatttgcttctgttatttttaatgccatttttgtacatttgtttaatattactatattcatctttgttgtaattttttcctgtaataatgtaacataaataattataatattacaaagtttattaaatttcttccaatgataattaatatagtaggcttgtggtggaaaaatggatcaggtactgtccttccaattctgtcaggcttttgattgaggtgtttatatggccaccccgttcagacaaagaatgtcaaccaaaaggagaaagtaagaaggaatctataaattactaaaattcccatactttatttcctatggaaaaagtcatgtaaggaaaatatatagaagtttcccgtaaaatgtaataatatcataaactctttcatccttaaacacctgttagtcttgccacagcacaatcagttccctaaagataaatatttcttggtttgttagttggctacttaggagttccttttccttcttatgagttttcttctctcctgtatttcttttctaacaccatccaactggttatccaaactagcaacctcagaattttcatccctcttccacatcttacatttctttatcacatcctgtgtcttcaacttcggaatgattccttactttggtctcgtctctctatcctgtctttcgtatgagctattctaaaggcaggtggtctgcttctctttactctgtccagtgttatcatcatttttaaaaagtctgcttttcacactgttgctaaatagagtttaataatttctagtagccttcagaataatgtctacacttattagcctgatagttaccttttctttgtcagtttttactactttgattttgacctgcattttagtctgtgtttaactggtttttctgaatacgtcatgtttattgttttagcctcaaccctgaattttttttttctcccttaagtgtcaaatttcaattcagatgttaaactttccctgcctttttcattcagaatcacttctttctttgctcttgttttttattcagctttgttctatatatggttctttaaaaataattgtatggaaaattgctatgttcttttattataaaatgaagttgatttttcattacaaaacagtttatatgcttattgcacaatctaaacagatgtataaaagagccataattgttcctaatttggcgataactactgttaataccttggttgtattcttccaggttcttttcagtagacatgtatattgggtaattttgtttacacaaaaagattacattgtgcatcagttttcataaattagcacttctcatttgaaataacatggaaaatacctatcaatagatgtaaatctattttaaatctgtaacatttaaaaatgtttaacacttaagtagaagcaacacatacacatagtaaaactacatcaaggtggaaaattaaacgcttatttgaagacttctaattttgggaaattgactaattctgctattcttcaggatttctcaggccaaaattcagaacaaggctaaatttgcccatttccacctactattatttattctttctttatattatgctagagcttgtaggctctgtactaacacaagaaaggggaagaaaaaaattgtccttattcacaaatgataattatgtttaatttattaaaaacacataaatcattggagttaattaaatattagaaacttggctggaaaaaattgatataaagaatgtttctaaatatcagccacaaataaagattaaacaatatcataatagtattaaaacataggaagtatgaagtagtgatcagaataaaagatgtggaggctttgtggcaaacattatgaaactttgagagatactgtaatcatggattagatgatttaatattggaaatatatcacttttcccagcatagatatagataagtagtgcaatcactgttaaaatcctaacaagttgggctgggcatggtggctcacacctgtaataccagcactttgggagtccgaggcaggcagatcacgaggtcaagagatggagaccatcctggccaacatggtgaaaccccatctctactaaaaatagaaaaattagctgggcatggtgggatgcgcctgtagtcccagctacttgggaggctgaggcaggagaatcacttgaaccagggagtcagaggctgcagtgagccgagatcgcgccagtgcactccagcctggcaacagagcgagattctgtctcaaaaaaagaatcctaacaagttggtttttggagtttgacaactagttgtaaatttatatggagtgcaaaaaaccaagaacggccaaagcactcatgaagaacaacagggtaaggacacttgtagatagagtgtgtgtgtgtgtatgtatatatatgtgtgtatatatattatatatgagagatagttataagatactggggtttctaagtcagtccagtgtgttttttcttaacctgggtagtggttacacagacattcactttttttttttttttagaacagaaagtttctaagaatttatagcaccaagacattcattttttaaaaattgcacatttattttacttatcctagagaaatttataaaaaacaaaagtaaactataaacaccagttaaaaaaatccttttatattaactccatagagatgcaaatactgttaacagttaatgttttcaggggcctggctccatggcttgcacctgtaatcctagcactttgggaggctgaggtgggaggatcgcctgagctcaggagttcgagatctgctgggcaacatggtgaagcctgtctctaaaaaaaaaaaaaatacaaaaaaaattagccaagtgtggtggtgcatgcctgtattcccagctatttaggagactgaggcgggaggatcccttgagcccaggaggtggaggctgcattgagctatgtttgcaccactgcactccagcctggatgaaaaaggaagattctgtctccaaaaaaaaaaaaaaaaaaaaaaaaaagttaatgtttttagcttaccattataagtctaaataatgaatttgtgcttatttttaattaacaaacttatacaatgtctgtaaactctatactggaagatgaagaatgtagtgcacttacactgttttgcctttttattcttccttatatttgctttagtttgattttttattgattgactttatgacttcaacaatatatttaaaacctttttaaaaacttgatttttaacatttgagatatttatggagtcttctccatgaaagggagaattttgcatgcaatagtgtatgatgggcacttttaacttttttatggctttctttttcaaagtcatacaccactttacttttcttttaacctaattccatctttcttctgttttttttgggggggagaggttggaacatctccttagtaattttttccacataggaaaaaggattattaaatattactttgccttattaacctgataatttgagtacatattgaaaatttctagtttcaaaaatttcctcccttctcagcatagaatacattactccattatatttttagcatccggtattctttgagaagttaagtattagtctgatttttattccttttaaggtaattattatttttcacattatatgctttaaaggttttatcttaatatgagagattaaacaagatgtgtccaagtatggggtcctagtccctaatcccttgtaaaactgcttgatgtttggaaaaatctgaccatatttatgtttcaccttttttttttccaacatttctctcttactcttcataatctctattttccctttctgtatttcctgttaaacagatctcagaccacctaataaattctctacaccttttaatttttatttcatatttttaatttcttatattttctatctacttttttggtctttttaaaaatttcaacttttctatttttatcttagtttttacccatgcatattttgattgctcaggtaatccatccaactattgatttttcaaaaatttttcaataattgttagtgtacagaaactgtgtcattctctagctgcatcttttcatataattagataggtctgtttgtggcatctttctttccttgctttacaggcagtactgttatacttttgtttatttttatacataaaacatattttttgacgtttagtaagatgtggaagaggaaatgaacatatacttcatctcttttgaagtgtaaggtcttataattttcatacttcttgaactgattccaagggtaacattaagtgaaattttgtttagtttctatagaaaactctgttagttgtctggaatgaggagaaatacatgctgatttctgtatgtttgtagtaacaagtgattctgagactgggattctgattttgacttaaccagtttgccacgtgacctccatttggcaatctattaattattacttttactttctgtttagtttaatggccaattatggacagtctgttttaaattcttaaattcttatagttgtacacttatggaaaacatttcttaaatgtggaaatttagtatttttgttataagatatttcaattcatttattcaacatacttaaacaataaaaacattttactatttgtgttttaatactcttctgctcagaaaagtttactttgttgcaactcacagaaggtaacttacttttttctactgtgatttccttataggtttgatgaacttgtgaaaaaattcaaagtcgaatatcatgctggtggctctacccagaattcaattaaagtggctcaggttggttaattattttaaaagttaaaaggattcaaaatgattctagacccatgtctattttgcataattgtttccttttatattgtgttgctgtagaatagttttgttcatttgaattgggattttagtagtcattgcacatctaatcaaaagttattttaattggtatttctttggttattggtaagcttgaacttttaatgtttattgttcatttgtgtttcttcttaaattgtttcctttcactatcattttataatttttcatgttacagatttgtagaaacttcatattttatagatagtattcctttttattttataagttgaaagtatttattttttgttatgtgtacattaactcttacagtgtcttttactgtgccttagttcttaatgtaactttcaaagtttttaacgtaattaaactttatggcttcttcatttcctgcatgtcccccttacgaaggacgtttctgccacaagatagtagaaattgctctgtattatatatagatatctatatacataaatgtacattcatatattcatacctaaatatctatgtatagacatatatgttggtagatatgtatatgcatctatatatctataccggtgtatatcttttataaatctatatatctgtctctattcccatatcttccaatgagtaattgaataaacccattaggcatatactctttgagttaccagcttaacctaatcttgattgagagagttagtgatctgtttaatcttccagctttgaaagatatgaacaagttttacatacctctggttcttacctctgcagtttgaagttaactcaaaattctgctcattgcaatcatgtgtcagttctgcctacactagatttctttttcttttttattgattaatgctttccccttgaattctgattaacttcaagaactggggaagtggaaaattgacaaataaaatccagaatgatttcttttcaagtaactcttagttgattgagacatatagtatgattattccacatacttccaagctcagatttaatcatagttttcaaatattttgtaaaaatgaatctttaaggcggtcattaatatgaagtggcctgagtctttgtattggtcaattgatttgtattgtttttggtaaaacatcctggtggtcactttatgaacttccagagtaatagaaaaaggatgatttacggccaggcacggtggctcacgcctgtaatcccagcactttgggaagccgaggtggacggatcacttgaggtcaggagatccagatcagcctggccaacatggtgaaaccccgtctctcctaaaaaaatacaaaaattagccaggtgtggtggcatatgtctctaatcccagctacttgggaggctgaggccagagaatcggttgaacctgggcggtataggttgcagtgagctgagatcatgccactgcactccagcctgggcaacagagtgagactccatctcaaaaaaaaaaaagagagaaaaaaaggatgatttacttaagccttaatttatcaaggcacgttttgcattttgcagttttcagtcttttctcctgctagaactgggggtgatatggttaggctttgtgtccccacccaaatctaatcttgaattgtaatctgtataatccccacatgccaaggaagagaccaggtggaggtaattgagtcatgggtgcagtttccttcatgctattctcctgatagtgagtgagttctcacaagatctgatggctttataaggggctcttacccctttgctcggcatttcccattcttgctgccttgtaaagaagatgcctttcttctcctttgccttctgccatgattataagttttcagaggcctttccagacatgctgaactgtgagtcaactaaaacttttttctttataaattacccagtctcaggcagttctttacagtagtgtgaaaatgaactaataccgggaggctattagctgttcactaataaattgtctcctttcttggggatcttcatcagtttctgccttctaaaagtttattaattatataattaagttctccctcagctttctccctgatattagtctcataataaaacagtcattgcctacttttattcttttgcacttttttttttacaatatttcacattcattctaacaacgtattctagtagtggtttatttgttcctgtctttagcaaggtaataaaaggaatttgaagctttgggtaacttattctgtcagatcttactagtaatcatactttcatgtatcaagtgatatggcaaattatgtcaacaagaaaatgtccccaaagctcttaggtattttgatatgtcaaatcatgtttttgaagattttaatgaaaccataggcaacaaaaacaagtatggttgatatcttgtccaaacacaattctagatttatttgatacacagcacaaatgtaaattttggtaaatttcatttggtctgaacttcttcctaatgaaagtgaaaagttcttatctgctcaatatcctgcacagcatgtatataacactgctaaaaaggggtataacttgcttaagtttgataattgatgctttcttaatgaacacttttggttactttgtcagtttttaaaaaatttgtagaagcacttaatgtgagttttgacttgaaagaaatggaaaaacgttggcattgtgactcatgcctgtaatcccagcattttgagaggctaagttaggagaatcgcttgagtccagtagtttgagaccagcctggacaacatagtgagaccctgtctctaggaaaaaaaaaaaaaaaaagaaatggaagaaaatgacttccttggatatgtgcctaaaagatggctattattgttgctggacatagatgccctgcagtacaatattaacaaaatatgggaccaaaggaatgcccatctctgatttggcagtacattgagaatgagaatggaaaaagaagattatagtaaaacaaatatttttatgctgtttctggtttttttgtttgtttgtttgtttcaagacggagtctcactctgttgccaggctggagtgcagtggcgcgatctctgctcactgcaacctctgcctcccgggttcaagtgattcttttgcctcagcctcccaagtagctgggactataggtgtatgccacaaagcccagctaatttttgtatttttagtagagatggggtttcaccatgttggccaggatggtcttgatctcttgaccttgtgatccacccgcctcggcttcccaaagtgctgggattacaggcatgagccaccgtgcctggcctgtttctgtttttgaagaggccacaagtgggctagaaaaaacacataccaaaaaaatactcaaataattttatttgttcattatttattaatttttttgagacagaatctcttgctctgttgcctagactggaatgtagtggtgtgatcatagctcactccagccttgaactgctgcgctcacagggtcctccttcctccatctccacctccatctcctaggactacaggcacaccctaccatacctggctaatttatttgttgtagagacagggtctctgtgtgttgctcagattggtcttgaacttttggcctcaagtgattctcctgtgttggcctcccaaagtgcgaggattacaggtgcgaaccattttacctggctcaaatggctcatttttatatattaagagtgcttcagaactcaagtaaaaaagtcacagaaaagagcaatgaggttaaataaaactttttttcagtttctttactaaaactgtaacttacttggaatccagttttgacatcagaaattcaaattcaggtgttttaaaaccatttctgcaagaaagaaatttaagttaggatgatagccaatgtctttcagagtgttttaaagtgatggacattttgaacattgataagcctatataatgaatctgtaaacacaagggatatgattcataaagagctggaatgccaaaacctgcatttagctaaaagatagatggatatttttatagaactataaactaattcctatatctaaacacctattattgatagtaattaaaatcctaagtattctatgtttacatgcttttgttgagaggatatttagcttaatgtcattgcactggactgacatcaagaatgtgggcttgatgcatcagaggtataagtcacagtgaattttacctttgactgtattacgttttaccacacatacaagaaggattgacctaatggctctagtcaagtatagaaaggaaacataaaagtaaaaatattttattatttcttaggcaaaaagaagcatgcctttattctttttaattaaatattggtaaaatgtttaatccaactgtggttacgttatttttttaaaaagtgtgatagaaataaacaacagaataatatatgattttgaataagttcaatattagtttgctagggcagtcttagcaatttcagagactaggtggcttaaacaacaaagatttattttctcacagtgttggagtcccagatcaaagtgttgacaccttgattccttcagaggcctcgcttcttagcctgcagatggctaccctctttctgcctctttgcgtggtggtttctgtgtacatatgtacctctggagtgtctctgtgtgtcctaatgtcttcttataaggacaccagtcagattggattaaggcctaccttactgccctcattaatttaattaccttgttaaagaccctatcttcaaatgtagtcacattgtgagatactggggtttagggcttcaacatatgcatagtggcaggagggtctgtggaggggtgtttataattcagccgataacaactatgtgtttttaaatttttgtgtctaagtaataaaacatgaataagttaatttttggtagtgttcttttttgataccttcttccttttctttcctgtatatgttttagttacttttattatttaccatttgaattacaatgaacattctaaactcataacaacctaatttgaataataccaatgtagtttcaataatatacaaacactctgctcctttacatctccatcctcttcttatatattattacgctcattgattacgtctttatatattgcatgcccattaacatagatttgtaactattcttttattcatttgtcttttaaatcatataaaaataaaaggaattacaaaccaaaagttcagtgatagtggcatttatatttactatgtagctacttttaccagagttctttacttcttcatatggcttctggttactatcaaatgtcctttcatttcagcctgaaggactctctttagcattttgtgtagggcaggtctattgttaacaaactgtcttagcttgtgtttatctgggaatgtcttaaatagcccctttattataggatagttttgttggatatagaattcttggttaacggtgcttttcttttagtatgttaaatatgtcaactcactgctttttggcctacatggtttctgatgagaattagttcttattcttactgagaatcctgacttgtgaccagttgcttttctctcactgatttcaaaattctttccttgtctttgtctttcagcagtttgactataatgtgtcttggtgtgaatctttttgtgtttatcatgtttagagcttattaaattcatgcttcaagttcatgcttggatgtgtagattcattcattttatgaaagtcaggaagttttggaccattatatcttcaaaaatttttttcttttattttctctttgttttccttctggcattctcataattaatatgttggtctgtggtgattgtttagtgataaggattctgattaaataagatagaaaaaaacaccatggtgagtaagcaaagcagaaatagaaccccactgttttaactagtaacctcagcttgctttttttaccggagatttttctctcatcctgagaaaacttcaatttttacttctctaaatgttagagattttgagtagtgtttcacatgctttcttcacttcttactgtcttcttcaatttgggagtaattgtaggttgtcagagagagtgtcgaatatgcatcactttaaatacagttatcagtaaatggactctttcattcatgcttcccagagatgacagttttccttggtgcctagatacctttttgttccttggagattcatagtattatgtgactcattgaatttttcagaagcctgatggtgagcttcgtgaggtatttctatttaagttgtaagttcgcttgtttttaagcttcctgcaatttaacttacctatagtatttttaaatttattttaaaaatgccatcttggggtatattctaggcatctcaaaaattttaaataccatcttatcctttgttaactggaatataagcaggtaatcatttgaatcattttttttcctgtaattattataacattgaggctatatggatttttttttctttttttaatttgaggcagagtcttgctctgtcacccaggctggagtgcagtggtgcgatcacagctcactgcatccttgacctcctgggctcaaggaattctcctgcctcagcctcctgagtagttgggactataggtgcacaccaccacacccaccttatttttaacttttttgtagagattgggttttgccatattaaccgggctggtcttgaactcctgggctcaaatgatcctcaagacattagcttggtctcttctcaaattagcagatccttatttctgtcttataatttctaatctgcttttataattattgacttacattcaatcttccagtttttcatgtctcttccaattagataagcctccatatttgtatttaacttccagtaaaattttaaccatgttgtttcatttttaattaaaatttaagaggactgcctaaatgccagtgtgtttatgttgtatacatctcggggcatgcttttaagtgttttcttgatgtaaaacatcacataataaactagtgttcataattgtattttaaagctttccaaaattctatgtaaaatgagtttctaaaaacactaaacaaaagaagttttaggaattatgtttgaatgaaatagaaacattgaactcaaaattgtaaagctgatatttcaagaactaccaattagtgtaacattactaattgagttacagtatttagaagttaaaactgatgtaaatcaaaggactcatgttgtttatctattttgaatccttttttgaaaaaagttaatctttaaagtttttctgtattaaaaaaatctgattatctcttgtgacctattttacctagaaaagctagttagaggttaaaaggttttttatgagacatacttctgtgcatcggaacagtccagatgtaaatttaaaaagaagaaatgacaatgaagtgatcaaagagaattctgtgttcaaatgctttcacctggagcagttgtagaaatgtcagtagcacaactgtatttataattatagcaggatgtggcagatggtgatgcaacaccgtctcgtcaattctttgtgtcattgaagaaagtagtaagtattaattctgccaattttatgattaatgaataattttaagtaacacaggccctacgaataaggttgactgttcaaattgtgatacctcattatagtttttaaagtttaaatatgaattaatactcctctttgcctttctgttctctttccttttcaaattaggttgttaagttttcatagctaaaataagatgaaggaagcagtggcttgctgtcctcaattatatttttgatgtgtttgtgaaattattataacttagatcagattctttaaagaaaaatcagtatttcattttttcctttcctcccttttctccctctctcctttccttgtctctctcctttcctttctctctcttcttccctttacccctcctctccccttcccttctttctcctcctcctcccttcctcacatctctttcccttctcctcctacccttcctcttccctcccctcttcttcctttcttcctactttgttttatgcattatgttaagaaattgttttactgctattagtgataacatgcttttagttctgtcttagcagttatggttgtgctctccaggataaatctacacatatcacagttatccacttcataaaagaatgacatatctctactcttgtgggccttaatgtcatgcagtgtttctgggtatgacattaaacatgggtacaatttgaaattgtatttttctgtctaaaagcaaaacaaagcttcatcaagaaatactacaagcagtgggacctaatttcatcaaggggataaaactctattcctttttattctattttggaattggaattcagaaacatttttttttggtcctatggatggtatattcacttatttgaaatgaaaattgaactcagacttttctgaaagagtctcatttgttaattggttgacaaggatggtctttgccatttaaatgatacagtggtactgtcagctgtcattgttcttgaaagcaaagaaaatatttaattgtattgattttctgacttacgttcgaattaatacacatttccttcttctttaagcaactttattggaatatagttcacgtacaattcacctgtttaaaatgtataatcttgtggcttttagtgtgttcacagatctagctagctgtgcaaccatcaccacagtcagtttcacaatattttcttttcttttcttttttttttttttgagatggagtctcgcactgtcgtccaggctggagtgcagtggcgcgatcttggctcactgtaatctccacctcccggggtcacaccattctcctgcctcagcctcccgagtagctgggactacaggcacccgccactgcacccggctaattttttgcatttttagtagagacgaggtttcaccgtgttagccaggatggtctctatctcctgaccttgtgatccgcccgccttggcctcccaaagtgctgggattacaggtgtgagccaccgctcccggccccacaatattttcattatcaaatgaagaaactctataaccattagtagtcattccccatttctctctcaccccctcatcttctgtccattcaaccccttggccccagacagtcacttatccagttttgtttctataggtttgcctattctagacaattatttttatttttggagatggcatcttgctctgtcttcgaggctggagtgcagtggcacaatcatggctcactgcagcttccaactcctaggcacaagtgatcctcccacctctgcctcccgagtagctgggtctataggtatgtgccaccatgctcagctaatttttaacttttaaattttctgtggaaatggaatcttgctttgttgcacaggctgatgttgaattcctgacctcaagcaaccctcctgcctctgcctcccaaagtgctgggattacagttgtgagccactgtgcacagcctttcaccaattgtcaaaaacttattcatgtatgtgattgtagattctttgaccaacatctctccatccttctacccctctaattacccaagcctctgataaacaccattttactttctccttctatgagatcagctttgttatagttcacatatgagttgagattatgtagcatttgtctttttgtacctggattatttctgttaacaagttattctccaggttcctccatgttatcacaaatgagaagattttgttccttttttttgtggatgaatagtattccattgtgtatatatatcgcattttatttattcattcattcattgcctgataaactcttaggttgattacatatcttggctgttgtgaataatgaagcagtaaatatggacgtgcagatatatcttaatcatttccactgaatatgtacccagaagtgggattgctggatcacatgttgtaccgttaatttcttaaggaacctccatacctgttttccataatggctgtgctagtttacattcccatcagcagtgtacagggttcccttaatatttcgggtactatagccttttgtaatatattttgaagtcagatagcatgatgtgtctttgtcatttttgctcaagattgcttttgctatttgggatcttttgtggttctatatgaattttagaattttttttctatttctatgaagattatcattgtcatttgagagggtttactttgaatctgtagatcactttggatagtatgggcattttaatgatattctttaattacatgaatgcaggctgtcttttatttgtgtcttctttaatttctttcatcagcgttttatacttttcatcttagagatcttttatctccttggttgaatttatcactaggtattttagctatttttatagctattttaagaggaattgtttacttgatttttgtttttttcagatagtttgtggttgatatatagaaatgcttttgtatgtttattttgtgtcctacaactttactgaatgtgattattagttctgacagtattttggtacattctttagggttttctgtgtatgagatcttgttgtcttcaaacaagaacaatttaatttctacctttccaatttgtatgccttttatttctttctcttgcctaattgttctggctgggtcttctagactatgatgaatagaaatggtgaaagtatacatccttgtcttgttccagatttcagaggaaaagctttcaatttttccccattcagaataatagctttggatttttcatatatggcctttattgtgctgagctgcattccttctatacccaatttgttgataatttctaacatgaaagaatgttgaattttgtcaaatgcattttctgcatctattgaaatatggttttttcctgcatttaatgtgatatatcacagttattgatttgtgtatgttgaaccattcatatatccatgggatgaatccacttgatcctggtgaattatcttgttaatgtgctggcttttttttttcttttttaagacagagtctctctctgtcacccaggctgaggtgcagaggtgctctacctcctggattcaagtgattcttccgcctcagcctccctagtagctgggattacaggcaccaaccaccatgcctggctaatttttgtatttttagtagagaggggtttcaccatgttggccagggtggtcttgaactcctgacttcaagttatttacttggcctcccaaaattaatgtgctattgaatttggtttgctggtattttgttcaggatttttcttctatgttcatcggagacattggcctatagttttcttatttttgttgtgtccttgttaggttttggtatcagggtaatgctgattttgtagaatgagtttagaagaattctttcctctttattttttaaaaataatttgagaagaattcgtattagtttcgctttgaatatttggtagggtgtgttggcttacgccagtaccccagcactttgggaggctgaggcagaacttcaagaggccaggaatttgaggtcaacctggacaacatagtgagaccttgtttctacaaaaaaaaaaaaaaaaaattagcttggtgtggtggtacacacctgtagtctgagctacttgggaggcctcttgggaggctgaggcaggaggattgcttgagcttaggaggtggaggctgcagtgaactatgatcatgccactgtactccagcctgggcaacagagcaagaccctgtctctttaaaaaaacagaacaaaaattttggtaaaatacagcagtgaagccatcaggtcctaggcattttttcttttttctttgatgggagactttttatcactgatttaatctctttacttattggtctgttctaattttctatatcttcgtaattaaattttggtagattatatatattcagaaacttatttcttctaggttttctagtttgttggtgtataattgttaatgagagtctcttataattctttatatttctctgggatcaattgtagtgtctccttttttgtttctcactttattatttgtgtcttctcctttttttcttagtctagctaaaggtttgttgcttttggctatcttttcaaaaacctaattctttgttgtatttatcttttgtatgttttttaggtctctatttcatttatttcttctctttattatttatttttttctgctaatttggagtttggcttgttcttgtttttctagtcccttgaggcgcaacattaggtttatatctttcctctttggggatttatgtgttaattactataaacatcacttttagacctgcttttgctgtatctgataggttatgctttttttccattggcattgtttcaaaaaatctttttgtttctctttaattttttcattgaccatgttgtttaatttccatgtatttgtagagtttttgattttcctcttattattgacttctagtttatgccattgtgatcggaaaatataatctatgattttgaactgaaacttgttaagacttatgttgtggcttaatatgtactctatcctgaagcatgtttcatgttcaattgagaagaatgtgtaatcttcagccgctggatagaatgttctgtaaatgtctgttaggcctatttggtcaagagtgcagtttaaacctaatgtttcttttttggttttctgtctggataatgtttctgttgcttaagtggggtgctgaagtttcctactaggtagaggatcagaaaaaataaatattacatactcagcttagtatctgggtgatgaaataatctgtacaacaaacccccatgacacaacctgtacatgtaacaaacctgcacatgtaccgctgaacctaaaataaaagttaaaaaaaaaagttgtctactatgattgttttgtactctatctttccctttagatttattgatatttgcttatatcaggttattttaatctagtaacaacttaactttgattgctaaaaatgtttaataaacactgtgtactttaactcctctttttctctcacattttgaatttttttctgagatacagtctcactctgtcacccaggctggagtgcagtggtatgatctcagctcactgcaacctccacctcccgggttcaagcgattctcatgcctcagccacccaagtagctgggattacaggtgtgcaccaccttgctcaggcaatttttgtatttttagtagagacggggtttcaccatgttgcccaggctggtcttgaactcctgacctcaagtgatctgcctgcctcggcctcccgaagtgctgggattataagcatgagccaacttgtccagccacatattttgaatttttgatgttacaacttacaacttttaaaactgcatatcccactatcaattgttgtagttataattatttttaatagttttatctttaatcttcatattaaagatataagaggtttacatactatgcttacaataggccgaatagccacttcccactcattttttccaccatagaaaacttgcatccaggggacttctgcatatgtgggcttaggggaagggtgttgcagtcaaagcaccatttcccttactgtctgatatggtttggctctgtgtccccacccaaacctcatctctagttgtaatccccataatccccacatgttgagggagggatctggtgggaggtgattggatcatgggggtggtttcccccatgctgttctcatgatagtgagtaagttcttacaaatctgatggttttataagtgtttggcagttcctccttcactctctgtctttttctcctgccaccatgtgaagaaggtctttacttcccctttgcgttccagcgtgattgtaagttttccaaggcctccccagtcatacagaactgtgagtcagttaaacctcttttctttataaattactcagtcttggatatttctttatagcagcgtgaaaatggactaatacactgttctcagatttttctcagctctgtggtacaatgagacaccatcctgagttccaagagatccagggtagtcgtcttgccactgagaagatactaattgtgacaagttaatgggtgcagcacaccagcatggcacatgtatacatatgtaactaacctgcacattgtgtacatgtaccctagaacttaaagtataataataataaaataaaataaaaataaaataaaatctaatcttctgtgcaggcaaaaaaaaaaaaaaaaaaaaaaaagaaattctatagggtgtggagaaccagacaacaattcctacccttccattttgcaagcatcactctgccatattttttaaagaataatgtttttagagtatttgtgttctttggtacttttgctgctgagattcttgggataacaaagtaaaaaaccaaatagtctagattgtaacataccacagtgatttggggcaagaaggatgtgcagtagaattaagccaagctgggcaagtatgaacttgggactgtcaccaaactctgtctcattcttttctccttatttaattctttccatatcaagcatttacaacccactatgtagaggtccatacaccttggcttatagacttcacttggtagttactgttgcccacctatctattaaccagaattttcatttaaaaatctctacataaaaattagcagttatgcagtggagttttcaaataaggaagaagattggttggatggatggatgttaggtgaccactgggaaactatggttttagaacgagtagctggtaggttgcaggtggcatgtattttaatacatgtagcagaaaactgaaaatttatgagcattttagaaattagagctctgtcaaaataagagaaaaacttagatttaattttataaaagcagtactaatgactttatgaagatggcatatgatttatgtatgtatgaacaattatatgtatcattaaatagatcagataaattttttgttcttttaagaataataggccagatgtgatggctcacgcttataatcccagcactttgagaagccaaggccagaggatcagttgagctcaggagttcaagaccagcctgggcaacatgacaaaaccctgtctctacaaataataaaaaaaaaaaaattagccaggcacggtggtacatgcctgtcatcccagctagtcaggaagctgaggtgcaagaattgcttgagcctgggaggttgaagctgtagtgagccatgattctgccactgcattccagcctaggcaacagagctagaccctgtctcaaaaccaaataataattttttaaatatttattatctaatgtgggtttttgctttatgttacagttgtcacctactccaatatgaaaaatgagaagaaagccaggtgtggtggtgcatacctgtagtccctgctactcaggaggttgagatgggaagatcacttgaggccaggagtttgaggttgcagtatgctatgattgctcctgtgaatagccattttactctatcctgggaaacacagtggcatcctgtctcttaaaaaaaatttttttttaaagcatgttcacaagttctttaatacttctccattgaaaaggtagaacctaatttcccttctcttgaatatggcccagacttagcgacttgtttctaataagtagaatgtatgtaatgatggtgtgctatttctgaggctagatcattaaaggcatcattacttccatattattttttcttgggacacccataatggggaattcaactgctatgttcttgaggatacgcagtcagcctttgaagacacccacatgggcaggaacataagccttccagcggcaaccagcaccaatatgttggccttgtgagtgcagccagctccagtcaaatcaccagattactggagccctgccttacttaaccgactacaacctgatgagacaccccaagagagaactgttccactaagctgctcccaaattcctgacccaccaaaactatgtgagatagtatttcttatttatagccaccatgttttgaagcaacaatgactattaaaataataaaataactttcagacattgtttttaatccctcttttctgtagtccctgtactttcccaccccaatttatatttcctgtttctatttgaacttttttcttttttgttttcatttcttttatacataatcgttttgagctataagaataatttatgccaaaaattatgcagctaatattttacacccgtattgtaaccagtatactggtataaaactagataataaactactatggctgtgttttgcttcttacagatggaaggaaatgcctaaaatttaattttatataccacaatgtgttttgaaagttttgaataattttctggttttgaaaacctgttttgatttttttttctcacaaacacgatattcttaagtaaaatagagtgatttatgattaatagaaataatgaagattatgcaagttattttacttcaattgaaatagcaaggccagaataatttaatcatgttttccagaagaataataaaatagaatcagtggcaatactagtaaacattagtctacatttctatttatttatttatttttttagacggagttttgcctttttacccaggctggagtgcagtggcacgatctcagctcactgcaacttccgcctcctgggttcaagtgattctcctgcttcaggcctcccaagtagctggtattacaggcgcctgccaccacacccagctaattctttgtatttttaatagagacgggatttcatcatgttggcaaggttggtctcaaactcctgacttcaggtgatccacctgccttggcctcccaaagtgcagggattataggcgtgagccactgcacccagccaacatttatatttctttaacttcatatcatttgctgtagttagctggatcatatttcttaaattttactttatttatttatttttgagacaaagtcacgctttgtcacccaggctgaagctcagtgtttgcgatcttggctcactgcaaactctgccttctgggttcaaggaatcctcctgcttcagtctcctgagtagctgggattacaggcttctgccaccatgcccaacaaatttttttttgtattttttgtagagacagaatttcaccctgttgaccaggctggtattaaactcctgacctcaagtgatccacccacctaggcctcccaaagtgctgggattatggccatgggccactgtgcccagacaaattttactttcatagtaacattttgcaaatgtaaaaattttataatttgattagtaatgtcagactctatcaaggtgatgctctcttaaaagttgttgatgataatattagatgagagatgtatgtagttatgaaagaccctgaaatgattgtatttttttatttctgtacaaagtttactcacatttctatgtctagccatagctattctaagccatagcacaaagaactgtattgtgatggtgagactataaaaaggtaaatttagagaaagcttccagatctgctctagaatttattaccatctggtctctttggagactagtataattattcatgggaatgttttcaacacagaaaagcatggtttgtgtattggcagaaagtaaaaagtaccagtggtttaaaccatatgtagcttttttagagttaggcaagggaaatgaactgaagacctaattgagagtcatcagtagtgatgcaatttgtgtcaattttgtcagaatctgttcataatgaacaaaatattgcacaacaagaaaaactgaaggtattagaaatataactccatttgaagagtattactttatcttaatttaaccaatgaaatgtaagatggtgtcagctaagtatttgtgtaaatctctgaaataacataaggaatatatgtcaaattttgatgacttttaaaaatgaaaacactcatgttaaaataattttaagcttgaacactggaagaatgtcttattaaggttatttttcttaaattgaatatgaatgtattattttagatcattttagatgtggcatggacttactactgttcctcttaagaagcagaaatattttacagtctttcttaagcttaaattgattttatagaaaaaggaaaaaaaaactaaatatcttttcactttccattctaacagttacttggagtctataaaaaatgagatgacaaatcaaaaaattgaaatcgtctattttttcagctattttaaaagaaaaatgcctagtgggctgggaatacacaagaaatttaaatttgtgattgagaataagaaatgcatttgtggttttaaaaaagaaataccagcatgtcacattaaaaatatggcatctacagtattgtacaaaggaaaatgtattacattaggagggggtatgttgtactttatttagagaactagtgcagggatacgaatgagaagtataacgccatagaaggcatgagcattagtaatccagtcagagaggaagaattttgctgcctcccatgtaacataaaacagatgttccattctattagaaccttactaaaatgagagtttagatcattggtcaataggagaaacatgaacaatggcaatttaataattttgagggtttatcttatttgtgagttaatatccatggtggggagtatgaagggatgcctgccaaatgttattttatttttgatatcttgattgagagagctgaaaggcaacagtaagctatactaatttttaatttattgttttgcaaatttaatctatttttttctcaaaaactgttgtaagaaaaaaagatttcaaaattataagtcctgatttaatgcttgaataggtattgaagcatatctgaaagtataattaattaacctcaaatgaatactgtaaacattaagtagttggcaactgaaagtagacgtatgcagaaagggacaccagggatggtaccacagggtcctgggtatatttttgtttttttaagggaagatttacttttttctagaaaagaaattcttttcaaataaatttatttttcaaaaaatactttttttcaaaagtattttttccattttaaaattaagttataatttatatacaaaaaagtgatctttgtagtgtatgtttctgcaagttatgacacatgcacagtctagcaaccagtatcagaaataagatagagaatagtttcatcacctcaaaactttccctgtgtcccctttgtagtcttcctttcccctacttcagcccttggcaatccctgctctgtttttgttgacagagacagttctcctcacttgtttgtgaagactgtaaggttctgactgccctttttcctgggacatttctcagggttatatatgcagctgataaacttgagacatgagataacatctgttcccagacaaaaagcaagcttatttactgcttgctataaaattggtggattccctgagttcagtgcttctcatttgctgatgcaaactcactacaagcatagcatccatctgagcatccccaaaggacttgggatgaagggaactgatgcaaatgtgctgatgttcttctgttttgtcataagtaatgaagtgttttttctttgactgaggagtcttgtgtcttctgcctgcatccatgaattagttaagaggcttttgtgttagcttttattaaatagggtaaaatcaaatcccagtctccataattttctgtttgtatagttttgccttttccggtgacttgtattgagggttcctgcttctggccaacaacctatgagtgattttttaggtctgatcataaggcatttacagaggttttcctggcaggcttcatagggggagggctggtctccagagcagacttggtgcaaagcttttatagtctctgaggggaattgcagtcaaggacccagccatcctcttatacatatctgcgttcctagcctaggtgccttcattcagaggcctctttatgtggggcttttggggaggctttccttaagtgtctctgtcaagactttattggggaaaagaggggaagacacttaccaactctttctctactatgacttgtacttttctgtttctaacccttccctctctagccttcactcgactcctgggtctgtaaaactgccagaatcttttgttgggggttccctttggcaatgatgcaaccctcacatttgtgctggtctacctgccctgtgaccaatgtgccatgccacaggggaaaatggaatggggggtagctggcactttctccaatttagcctcttatactgtcacagtgattacagacctattctttattttattttattttatttatttatttttttggcttgttgccattggctgtgccaaaacgtggcagcccagctttctccagctctcctgaggtactgatacacacaaatggaatcatgttgtgcatagcctttgaatctgactttcttcagttgacgtaagttcatcttagattcatccatttgctttgtcaatagtttttaaattttaatggctgagtagttttctatcatcgtgatgtactgcaccttgtgtctctatccactctagagggatatttgaattgtttctggtgattatgaataaagctgctaaaaatatttatacgtttttgtgttaacataaattttcattttactagatgtattgccaaactcctttccaaagtggctgtgccatttcacattcccactagtaatatatgagaggtctagtggtttcacatcctttcagcacttgatattgtcagcttttattactacatcaattgtaagggggagaggagcatctcattgtttgtttctacttccctaattatgtgaagcacatttttatatgcttatttgctatctgtatatgttctttgaagaagtatctcttcaaactctttgccttttttttaaaaaaaattgtgtttatttttgttacagagttttgagaattctttatctgttctgcagacaagacttatcagatgtgtgatttgcaaatattttctcctagtgagtggcttgtgttttcattttcctaacaatgtctttcagtgagcagaagttcttacaaatttatgtacttttaaaatggattatgcttttgtgtcatataagaactctttgcctaatccagggtgagaaagatttactcctatattttctactagaaatttcatagttttactttttacatgtagatctgtgatccattttgagttaagttttgtgtatattgggtgaggtctgtaacagagtttttgattattgttttttgctattgttttttgctttggcatatggatatccaattgatccattactcttccctgaagtctatttaaatctctttaattgccattgtacttttttgaaaatcaattatgtggttgtatatctatgttccatattctgtttcattgatctatatgtctcttctttctccaatatcatacttctctgattactgtagcttaatgtgtttgttttttttgctgtctaatcatggaagttgaatttattgcattttacaggtcaatattttttgtagttgtagacgtctgtaattttgcactgttaattttaatgtaatggacatattagaaattaggttttcaatatgcaggggaaatgctgttaatttacaattgaagagagttatgaaataataataaatagaaaaagtaaatagagaaaggaaagtacagtcatcccttagtgcccataagggattggttctaggaccctctgtggataccaaatccatggatactcaagtcccttaaatggcataatatttgcacataacctatgcatatcctcccatatactttaaataatccccagattgcttataatacctaatacactataaatgctaagtaaatacttgttatactgtgttatttagggaataatgacaagaaaaaagtctgtacctgttcagtacagactcaacaactatccatttcccccacttccaagtatttttgatctgctgttggttggttggtctgcagatgcagatcccatggatatggtgggcctatatatatgtcttatttattgtcactaccttttgcttccaagtattttttatttttaatgagagttattttgttgtggtgggtggtttaacatacataagttttcccagcagcagaaccctgaagcaaggattttagaacaaagtctactttggagacgtatgtaacaggcaagaattgatgcaaggaaagcaaggcagctaatgaagacttactaactaaactaacacaataggttgctggagctttatcttgtgggataattctgggaaagtcagtgtcaaatttagtttcgggactaactcacctgaagtgtgagagagtgagtatatttcctgttactggttgtggactgccatacagaagacattgcacctgcctggtgctgtggtgggcagagtagcattcagccattcagaggaaagccctgagggatacagaggaagatactggctattggaagtaatttggaatggtgggaaagggttaggtccaaaggatactgtacagacactgacattatctgactcatgccttgtgaattttaagtgcctttcctgggttatcaaagtgaatagctttaatcaaatcatctctataaagacatttctaagtaaattttctatacttacactcctctactttttattactacagctggcttcattagctttttgtatattaatctgtgttgtcctactattagctagaagagcttactaactgtgagcttgaagatattgtatattccctcttcggatgatttttttttttttttttttgagtcagagtcttgctcttgtagcccaggctggagtgcagtgatgcaatctcggctcaccgcagcctccgcctcccgggttcaagtgattgtcatgcctcagcctcccgagtaactgggattacaggcacctgccaccacgctgggctacaaatgtatttaagaatcttaaatgagctgtgattgcaccactacactccagtctgggtgacagagcgagaccctggcttcaagcagtcctcctgcctcagcttcctaaagtgctgggattacaggcatgagccactacccctggcctaaattccttttctagcctctatacagaatttctaggataacaacaacaacaacaacaacaaaaacttaaatgataaaaatgaatatataaaatagcaagtaagccatgtaaaatattttcaatattcttagccattagagaagtgcaaattaaaactataagatactgctgcatacatatgtggatagcgaaagtaaaaactggtgagaatacagaatgaatggatttctcatctgttgctgataggaaaatgacacagccactctggaaaacagtttggcatttttaataaaattaaagataaatattccatatgactcagcaatcatattcctgagtatttaacatagaaaaatggaaatttatgtatatgtaaaaacttgctacacaaatatttacatcagcttaatttgtaattgcctcaaactggaaagaatccagataactttcaacaggtgaatagataaacaaactgtgatatatctatcgaatggaataccaagctttgtaaaagaataaattactggtacagtcaacagtttccgtagatcttaagttcatcacacgaagtaaaaaaaaagctaaactcaaagtgttacatactgtatgattccaattatatagtattacttaaatgaaaaaaaattagtgttggaaaattaacctgtcattccaggagttagagataatgtgggagaaggggataggtatgactataagggagttgcaggagagggcttctttgtggtgatggaatagttctgtgtcttaattgtgctggtgagtacatgaatctttacagctgataagattttatagaatagtacacacacactaagaacaatgcatgtaatgtctactttggggagctttttttaaaaaaatttcttttaagagacagtgtcttgttccatttcccaggctggagtgcagtggcacaatcatagctcactgtagcctcaaacacctgggctcaagggattctcctgcttccagcctcccaggtagctaggactataggtgcatgccaccatggctcgctaatttttttatttttattttttgtagagatgggggtctcaccatgttgcccaggctggtctcagtctcctggcttcaagcagtccttctgccttggccttctaaagtgctgggattacaggggtgagccactgccctggcctaaattccttttttagcctcttcacagaatttctaggataaccaatataagtaaagtagatgttatttttaaaatgatccactttatacactaaattaaaagacagtcttgatttcttcaaaattctttgctgtgaagtgaaacgtttggtaatcatatatcttgttgacataaacatacagattcctctgcatgtaacattcttttccttcactttaccaatttgtgcccatttcacgtatctcagcctatatccctttttcatgatcatcttacctctgacataactctttcacccaccaaatctgtgtttggtgtcatttctatgatggtcccatacaaagctggactcattttacagatgcaaaaagtgatgaaataatgaacaagttaatggcccaactgaaactgtggtgttggacataaactttagaataaatcctaaatcttaagtgtgcaaataaattattcaaaacatgagattacctaacctattctagtgatatttaacagagatatgtttgtaactggtggaagaagaatcactccctaggtacaagatcaattactgttcattttattcacctgaagataaatcactttcacagattttgcagactacttcttttcctgaaaaaatgatttattaaagtggaggtttctttactatatcaacactggcttactcttttctttataatacttctatactgaaagaagccagaggccaaaagtagtcttgtttgtgctgctctttatttcattgttatttttaaaccagatgatgaaattcccttccattttgaagggccatttttcatgtacataggagggaatttaaactgtttgagttaatattaacatattctattactataaattggttttagtttgattttaaaatagcatattaatttacatttaattttagtattcaactctgatcagaaaaatagtattttggatgtaggggtaaggaaaaggtgtgaaattccagttaaaaatctaaagtactgtgtttattgtttcattgtgtgtctgcatttagtattgtttgtatgagaaaaagtcagttgtttccttatattcccatataatttttgagtagtatgacaatcttcatttatatacctgatgacttttaatttttaaaatgttgtctaaaccaggtttcaggtgatatatcttgcttcctaatttgacaactctgaatattactattgaaacttgtaagcaagtagaaattaaaatgaagccatacatagcatttgctttgattaaaaagaatagaaacctagactgttttggaaaattcagtgtatatttcagtgtatatatattatgtgtttatatattgacagatctgggcatcagaatagagtcaagaaataacataaatagaaattcagtaagaacacatatgaaactggaaaccagtggaggaaaactgaggaattgctgtttgtgagagacttatttttcactcagtatacttttttttactgttttaattgtctatatagcatgctgcatattaccaattttaaatacttaattttgaaagattaaaatggctggcaaatttattgcccatttgcaaagtacatttatatcaggcatagtacaatatgtagaatgttattggaacattggaacattgtgtctgaaatacttttttaaaaacctcataaaatatgaaaatacttcttaatgatttcaatattaactctattcattagacatctatcattatcctttatgtcagaaacttagagtgaaatcttattagcttgattgaagaacacttgttctcatttcattgtgctatagttaacattcaaagttaaagttatttttcttctccttgatagtatactataataagtatattcaaagtgatgctctagatttgtttccttcacatttagacttgcatttttacaatgtttatactaaggtttcttacacttgccatagtatatctgtgcggtggcttactcctgttaatcccagcaattagggaggcccaggcaggtggattatgaggtcaggagtttgagaccagcctggccaacatggtgaaaccctgtctctactaaaaatacaaaaaaaaaaaattagctgggtgtgttggcgggtgcctgtaatcctagctactcgggaggctgaggcaggagaatcacttgaacctgggaaggtggaggttgcagtgagccgagatcctgccactgcactgcagcctggacaacaagagcgagactccgtctcaaaaaaaaaaaaaaaaaaggatttttgcaatcattaacttacttcttgctgtctgtttttattgtctttggctgtccttcttaacttcttcaaagatttctagtatatttacactccttaatcctaaatccagtgtatgttggctctcatggtagttttccatttcatgtacttgcttgtataatataaatccctgttcttggtgttttgtgtatttatttatttggctgccattgtattgaaaattgtcttgacaattcatttatgaacatcattagtacagcaatatgtaattcaaaaccagcatgctcaaatttgtactattctggttagttattgctatgtgtgtattttcaaatttttaaagacttagagaatagtaaaacatatacttagcacaaatgatatcacttcttggtacctttctgtgagtccttcttcccataaggaaattaaattgttctttgttttcatgctaagtagcatgaaaaaaaagctttattgagataaatcaaatttagagcatttttatcacctcaaaaagagcccatatacattagctctcacccactcaattatccctccttggctattttgggtccattgcaattccaagtgaattttagagtcagtttgtcaatttacacaatgagtatagcttggattctgatagggattgtgttgaatctctacatccataatgggtaatattgccaatcttaataaaattttccatgaatgtgggatgtttttccatttatttggatcatctttaatttgttgcaacaatgttttgtagttttcagagtataaattttacactgtaaagaaaacttattcccaaatattattttctttttgatgctattgtaagtggaattcttttcttaattttatgttcagattattcattgcagatggcttagagatacaattgtgtgtggtttttgttgttttgtttttgagacaggctcatgctctgttgcccaggctgaagtgcagtggcacaaacatggctcactgcagccacaatctcctaggcccacctgattctcctccctcagcctcccaagtagctgagaccactagacatgcaccaccatgcctggctaatttttaattttttttgtagagacagagtcttgccatgttgcccaggctggtctcgaactcttgggctcaagcaatcctctggccttagcctcccaaagttttgggattataggcatgagccgctgtgcctagctcagtttgtgtgtgtgtgtgtgtgtgtgtgtgtgtgtgtgtgttttaatattgatcttgtatcctacagcctttctgaacttacttagctctaatattttttagtgggttctttatgattttctataaacaaaaccatgtcatctgtgactatagttgtgtttccttctttctttctaatttggaagcctttaactattttcccccttccttaattgctgtgactagtagttgtaatgtaacagtgaacagaagtggcaagaagagatgtccctagtcttgtttctcatatagggggaaaatatctaatcattcaccattaagtttgatgtttctctgcagttttcttagatgccctttatcagattgaggaagttactttctatttctgtttttttttagcgtttttatcttgaaacagtacagttgacccttgcacaacatggcgattgtgggtgctgacccactgcatagtctaaaatccatgtataacttttgattctcccaaaacttgtcaattaatagcctactgttaaccagaagccttaccagtaacataaagtcaattaccacatattttatatatgtatcatataaagaatatattattaagaaaatcatgagagaaaatgtatgtactatttattaagtggaaatgtttcgtgagaaaagtcatcattgtcttcatgttgggttggctgaggaggcagaggaggaactggttttgctgtcttaagggtggcagaggtggaagaaaatactggtgtaagtggatttgtgaagttcaaaccagtgttgttctggagtcaattgtagtggattttgccaaatgctttttgtttgtttgttttttgagacggagtttcgctcttgttgcccaggttagcgtgcaatggcatgatcttggctcactgcaacttctgcctcccaggttcaagcaattctcctgcctcagcctcctgagtagctgggatttcaggtgcccagcaccacgcctaacttatttttgtatttttagtagagatggggtttcaccatgttggccaggctggtctctaattcctgacctcttgtgatccacccgccttggcctcccaaaatgcgagattacaggcgtgagcaaccatgcctggctgccagatgctttttctatgtgtgttgagatgatcatgtaattttgttttctattctattgatatgatgcattgaattaattgatttttggatcttaaaccaaccttgcattcctgagacaaactccacttggttatgttatatataatttttaaatgttgctggatttgttttgctagtattttgttgaggatttttgcatcattctcatatgagtatcagtctgtagttttattttcttgtgactttgtctgattttagagtatcatagtaatactggcctcataacatgaattgggagatgtcttccctcttctaatttttagaagagtttgtggagaattggtattaatttttttaaaagaagcagcaattgcttatttttctaatcaggtgtctatgctgctgaatcttaaggcctcaacaaatgttgcaccttattatttcattgaacaataagaccttctattctgattattcccggtaaataggaataatcactggtttctccagtggtttccacttgccaaaaactcatgacagatgacttaacaaggtggcacctgctttcaggggattgtatcagatgcatactcatttccagtgcagcagctgttggcaatctaggacttctctatcatggttggccaagtagtcctgctttggctgccagagcttcattctgctgaatattacattcctgaagtctcatggatattctttttgtcatttaaaaatatttccataaagtgttctgaacaggctggtctcttcaggttttacatctgttgtgcagtcttaacacagtccaaaaagcagatttctgcaagtttattgtcagtcccaagaaattccttcaactgtttaatctgatcagattctggtatttgtgcacccatattcttttggtacatttattagtcatcttctctgatgcatgagtttcctttctgttcttgtaaagtagtgttccaacctttgtttgaatgtcttcagtgagacgtgatttcttacctaagcacaggctctcacatctgacgtcagtacaaggctggaggcctacactgccagtcgagtctgaggatggaggatcaggatcagggcaagcattgcagccgctttatctaattcttctttaaacgttcattagaattcaatagtgaagccattcagggctaggcttttctttgtgggtagtttcttgattactaatttaatctcttgttatataggtctgttcaagttacctattttttcttgaaatttttttagtcatttgtgcctttctaagtatttgtccatttcatctaataaataatctaatttgtttaatggctattctttctgacattaatatagccactttgtctttcttgtgggtgttgtttgcatcacgtatcttttttttttttcccagacagggtcttgctttgttgcccaggctggagtgcactggcaagcagaggttgccactcactggaacctctgattcccaggtttaagtgatcctcccacctcagtctcctgagtagctgggattacaggtgcataccatcatgcttggctaatttttaaattttttgcagagacgaggtctcactgtattgtccaggctggtcttgaactcctggctcaaagtgaaacccctgccttggcatctcaaagtgctgggtttacagatgtgagccaccacatccagcctgcatgatatatttttccacccgtactttcaatctgttagtaactttctatctacagtgtgtctcctgttgacccacataactgtcttttatgtatagttattagaactattgataagaaaatgtgaaagtatagtcccattatcttatttgagtggaatcagtagactatttcataaaatgtattctagtttatagtttagaatagtttgtttttcatggcttttgagaaaaacatttgaatgagcttacattttgttgcatttaaaatttctgggtttttgttgttgttgttgttgttgttttgagatgcagtctctctctgttgcccaggctgaagtgcagtggtgtgatcttggctcactgcaacctctacctcccaggttcaaatgattcttgtgcctcagccccctgagtaactgggactgcaggtacatgccacgacctggctaattttgtatttttagtagagatggggtttcgccctgttgggcaagctggtctcaaactcctgacctcaggtgatctacctgactcagcctcccaaagtgctggaagtacaagtatgagccactgcgcctggccaaaatttctgttttttaatgaatccaaagttcatgtttttttttcttcccaatgccatggtacatatcatcaccaaaaaaagtagtgattttgcttcagtgaacactgaattttaatattattgatagaatggctatatcgatcagggttttacacttatagtacagtatacttgcaatgtaggtaggcctcatcctttgtaattaattaattagcttgtaattatgtaagctaatctaaattttcatattttcagttttaacatttgggcttttgagttacatttcttatattttgatttttttctataaattttaaaaccagaaagacaacactagaatcaattaaatgcaagattgaaagggtttcataatgtaaaagagcaatcttgtttttgaaatgttcagtttacagtaaggatcgagtagctctgcagctaccgatttgggaaatacctgaggttttttttccccttgcacttacaggctgttttagccctgaaggtggctagtaaggacacagactttagagtgccacgacagttccataacaggaatgaattgaagaagagaagcagtggagtcaggagcctcacaaattaaagacaactggtgaagagaaaaaccatttattttcgatacttaagatggctgagcctgtaattccagcagtgctttgggaggctgaggcaggtggatcacgaggtcaggagattgagaccatcctggctaacacggtgaaaccctgtctctactaaaaatacaaaaaattagccgggcatggtgggcacctgtagtcccagctactcaggaggctgaggcaggagaatggtgtgaacccgggaggtggagcttgcaatgagcagagatcgcaccactgcactccagcctgggcgacagagcgacactctgtctcaaaaaaaaaaaaaaaaaaaaaaaaaaaaaaaaaaaagatggccgaataggaagagctccagtctgcagctcccagcaagaccaacacagaaggtgggtgatttctgcatttccaactaaggtacccagttcatctcattgggactaattaggcagtggttgcagcccacagagggtgagcagaagcagggtggggtatcacctcacctgggaggtgcaaggagctgggggacctccttcccccagccaagggaagccatgagggactgtgctatctggcccagataccatgattttcctatggtttttgcaatccgcagatcaggagattccgtcgtgtgcctacaccaccagggccttgggtttcaaacacaaaactgggcggctgtttaggcagacacttagctagttgcaggagttttttttcgtaccccagtggcacccggaaccccagcgagacagaactgttaactcccctggaaagggggctgaagccagggagccacgtggtcttgcttagagggtcccactcccacggagcccagtaagctaagaaccactggcttaacattctcactgccagcacaacagtctgaaattgaccttggaccattgggcttggtagggggaggggcatctgcaattactgaggcttgagtaggtggtttttccctgacagtactaaggtggcggggaggtttgaaccaggtggaattcaccacagtgcagcaaagcagctgtggccagactccctgtctagattcctcctcactggacagggtatttgtgaaagaaaggtagcagacctagtcaggggcttatggataaaactcccatctccctgggacagagcacctgagggaaggggcggctgtgggcgcagcttcagaggacataaactttcctgcctggtggctctgaagagaacagctgatactgacaaggaggattctcccagaacagtgcttgagctctgcttagggacagactgcctcctcaagtgagttgaggagactccgtgccttctcactgggagagaactgccaacaggggccaacagacacctcaaacaggagagctctggctggcatcaggctggtgcccctctgggacgaagcttctagaggaaggaccaggcaacaatctttgctgttctgcagcctccattggtgatactcaggcaaacagggtctggagtggacttaaagcaaactgcagcagacctgcagaagaggtgcctgactgttaggagaaaaactagcaaacagaaagcaacaaactcaacatcaacaaaaaggacccccacacaaaaaccccatccaaaggtcatcagcctcaaagatcaaaggtagataaatccatgatgatgaggaaaaaccagcgcaaaaacggtgaaaattccaaaaaccagaatgcctctttgcctccaaataattgcagctcctctccagcaagggcacaaaactggacggagcaaccccaagacacctaatagtcagattctcctctgagctgaaggaccatgttctaacccagtgcaaggaagctaagaaccttgataaaaggttataggaactgctaactagaataaccagtttagagaggaacataaatgacctgatggggctgaaaaacacagcacgagcacttcatgaagcatacacaagtatcaatagccaaatcgatcaagcagaagaaaggctatcacagattgaatatcaacttattgaaataaagtgtgaagacaagattagagaaaaaaaaaataaaatggaatgaacaaaacctccaagacatatgagactatgtgaaaagaccaaacctatgattgattggtgtacctgaaagtgacagggagaatggaaccaagttggaaaacacacttcaggatattatccaggagaacttccccaacctagcaagacaggccaacactcaaatttgggaaatatggagaacactgcaaagatactccttgagaagagcaaccccaagacacctaatcatcagattctccaaggttgaaatgaaggaaaaaatgttaagggcagccatagagaaaggtcaggttacctacaaaaggaagcccatcagaccaatagcagatctctctgcagaaaccctacaagccagaagagagtgggggccattattcaacattcttaaagaaaagaattttcaacccagaatttcatatccagccaaactaagcttcataagctaaggagaaataaaatccttttcagagaaggaaatgctgagggattttgtcaccaccaggcctgccttacaagagctcctgaaggaagcactaaatgtggaaaggaaaaagtggtactagccactgcacaaacacaccaaaatataaagaccaatgacactatgaagaaactgcttcaattagtgtgtaaaataacctgctaacatcatgatgacaggatcaaattcatgtataataatattaaccttagctgtacatggcctaaatgccccaattaaaagacacggactggcaaattggatgaagagtcaagatccatcggtgtgctgtattcaggagacccatctcacttgcaaagacacacataggctcaaaataaagggatggaggaatgtttaccaagcaaatggaaagcaaaaaaaaaagcaggggttgcacttctagtctctgataaaacaggctttaaactaacaaagatcaaaaaagacaaagaagggcattacataatggtaaagggatcaatgcaacaagaagagctatcgtaaatatatatgcacccactacaggagcacccagattcataaaacaagttctcagagacctacaaagatacttagacttccacacaataatagtgggagactttaacaccccactgtcaatatgagatcaatgagacagaaaattaacaaggttattcaggacttgaactaagctctggaccaagcggacctaatagacatggggttgctacagaactgtctaccccaaatcaacagaatatacattcttctcagcagcacatggcacttattctcaaatcaaccacataattcaaagtaaaacactcctcagcaaatgcaaaagaatggaaatcataacaaacagtctctcagaccacagtgcaatcaaattagaactgaggattaagaaactcactcaaaaccacccaactacatggaaattcaacaacctgctcctgaatgaatattgggtaaataatgaaattaaggcagaaataaagaagttatttgaaaccaatgagaacaaagagaaaacgtaccaaaatctaggacacaccaaaagcagtgttaagagggatatttatagcactaagtgcccacttcagacagctggaaagatctgaaatcaacaccccaacatcacaattaaaagaactagagaagcaacagcaaacaaattcaaaagctagcagaagacaagaaataactaagatcacagcagaactgaaggaggtacagacatgaaaaacccttgaaaaaaatcagtgaatccaggaggtggttttttgaaaagattaaccaaatagatagactactagctagactattaaagaagaaaagagagaagaatcaaatggacacaataaaaaattataaagtggatatcaccactattctcagagaaatacaaactaccaacagagaatactataaacacctctatgcaaataaaccagaaaatctagaagaaatggatacattcctggatacattcctggacacatacaccctcccaagactaatccagggagaagttgaatccctgaatagaccaataacaagttctgaaattgaggcagtaattaatagtctaccaaccaaaaaaagcccaggaccatacagattcacatccgaattctaccagaggttcaaagaggagctggtaccattccttctgaaactattccaaacaattgaaaaagagggagtcctccctaactcattttatgaagccagcatcatcctgattccaaaacttgacagagacacaacaaaaaaagaaaatttcaggccaatatccctgatgaacatccatgtgaaaatcctcaataaaatgctggcaaacgaatccagcgacatgtcaaaaagcttatccaccacaatcaagtcggcttgacatgtaaggctggttcaacatacgcaaatcaataaacgtaatctatcacataaacagaaccaatgacaaaaaccatatgattatctcaatagatgcagagaagtcctttgataaaattaaacatccttcatgctaaaaactctcaaaaaactaggtattgatggaacatatctcaaaatataagggctatttatgacaaatccatagccaatatcatactgaacaggcaaaagctggaagcattccctttgaaaaccagcacagacaaggatgccctctctcaccactcctattcaacatagttttggaagttctgactagagcaatctggcaagagaaagaaataaagcgtatttaaataggaatagaggaagtcagattgtctctgtttgcagatgacatgattgtatatttagaaaaccccatcgtctcagcccaaaacctccttaagctgataagcagcttcagcagtctcaggatacaaaatcaatatgcagaaatcacaagcatttctatacatcaataatagacaagcagagagccaaatcatgagtgaactcccattcacaattgctacaagagaataaaatacctaggaatacaacttataagggatgtgaaggacctcttcaaggagaaccagaaaccactgcccaagaaaataagagaggatgcaaacaaatggaaaaaaaattcagtgttcatggataggaagaatcaatattgtgaaaatggccatattgcccaaaataatgtatagatccaatgctattcccatcaagcttccattgactttcttcgcagagttaaaaaaaaaaaagaaacaaaccttaaatttcatatggaaccaaaaaggagcctgtgtagctaagacaatcctaagcaaaaataacaaagctggaggcatcatgctacctgacttcaaactgtactacaaggcaacaataaccaaacagcatggtactggtaccaaaacagatatatagaccaatgaaacagaacagaggcctcagaaataataccacacatctacaaccatctgatctttgacaaatctgacaaaaacaagcaatggggaaaggattccctgtttaataaatggtgttgggaaaactggctagccatatgcagaaaattgaacctggatcactgccttacacattatacaaaaagtaaccaagatggattaaggacttaaatgtaaaaccgaaaaccataaaaaccctagaagaaaacctaggcaataccattcaggacataggcatgggcaaagacttcatgactaaaacacccaatgcaattgcagcaaaagccaaaattgacaaatgggatctaattaaactaaagagcttctacacagcgaaagaaactatcatcagagtgaacaggcagcatacagaatgggagaaaatttttgcaatctatccatctgacaaaggtctaatatccagaatctacaggaacttaaacaaatttgcaagaaaataacaaccctatcaaaaattgggcaaaggatatgaatggacacttctcaaaagaagacgtgcaaccaacaaacatgaaaaattgctcatcatcattggtcattagagaaatgcaaatcaaaaccacaatgagataccatctcatgccagttagaatggcgatcattaaaaagtcaggaaacaacagttgctgttgaggttgtggagcaataggaatgcttttacactgttggtgggagtgtaaattagttcaaccgctgtagaagacagtgtagcaattcctcaaggatctagaaccagacataccatttgaccgagcaatcccattactgggtatgtacccaagggattataaatcattctcctataaagacacatgcacacatgtgtttattgtagcgctatttacaatagcaaaggcttagaaccaacctgatgcccgtcaatgatagatagagaaaatgttgcacagagacaccatggaatactatgcagccataaaaaaggatgagttcatgtcctttgcagggacatgatgaagctggaaaccatcatttttagcaaagtaacacagaaacagaaaaccaaacaccacatgttctcattaataagtgggagttgaacaatgagaacacatggacacagggaatggagcataacatacctgggccagctggtgggtaggggtcaaggggagggagaggattaggacaaatacctattgcatgcagagcttaaaacttagatgatgggttgataggtgcaccaaaccaccatggcacatgtataccaacgtaacaaacctgcacgttctgcacatatatcccagaacttaaagttaaaaaaaaaaaaaaaaagccaggcgcagtggctcacgcctgtaatcccagcactttgggaggctgaggcaggtggatcacaaggtcaggagatcgagaccatcctggctaaaatggtgaaaccctgtttctactaaaaatacaaaaaattagccaggcgtggtggcgggcatctgtagtcccagctacttgggaggctgaggcaggagaatggcatgaacacaggaggtggagcttgcagtgagctgagattgcgccactgcactccagctctggcgacagagcgagactctgtttcaaagaaaaaaaaacttcagtttacttgattttgcttatagagttctttgagaatttaaatcatcctttctgaattacagaaagtcatagattagaagtgtagctttaaaatgctctagatcactctgaattaagaaaaagggtttcctttgtccagaataagcatcaatttaaaacagcatttaaaaacaagtattcaacaaattggtatacgaattataacacaagcaactaaatcactgactttgattagtctctctactgattactactgttgaacagaagttgtgtgtaagaataggagaaggtgaactcattgtcttgagcatgtggaattagttcttgtctgaggccagatagcaatttttatcttattttcagtatagcagatcctatgctgccctgataagaatcacctgcacagcctcattgactctcacggaagtattccagtaactctttgaattttttcctagaaaaattggcatctgttacccctacacaattccttcataaacagtagaaatttcccccatgaaacctttcctttaaccttaacattcttcgataattatttatgaagtccttaaataattattacaacaagtattggttttgaatacgtaccagctttggaatactgcttaaggaaaccatgataaactccaactcctttatgattatttagaggaatatatctatttgttatagtcttaaggaaaaccttgtcaacatattagatgatagaaacagtcataaccagcgaccaccaggtttggtgggaactcatgatgtgaagggtctactccatgttctgccaaccaagtaactaagtcattttgggcaaatgattcagctgacttgatctgttacatgattcctaaggtctgttatagctccaatatttcatggcatcactccactttaatgtattatctatcttaaaaaagttaaacagaaagatcaattagcacttatattaaatttgagttgctgaatattttattttttctcacttccactcactgcttccactatttgggtaatgattgttggagctgtatgcatttataatgcattaagtacagtgtggtatatcagtaaaacttcattacaaatattcattccatacatttgtctgtactggggtcagtttttttccccttcttcttctttttaaagacagggtcttgctctgtctcctcctgtcttggtctcccaatgtgctagaactacgggcatgagacactgcacctgctcttttctagttttatttgtctatctgaagagtttattatttggctaagctcacatggcaaggtaggtatcatgaagtgttaaaacccagcttttctgctaatgttcttgtgagataaaccaactattagtaaagatacttgcttcctaatcaagattacttggaattgttaagagagtatgtatgtatgtataagttaactttttaaaaacttctctgctgcctggaggaataatgaaatgacccaaagggatagaagcaaaatatttcagatagtacataacgtatatacttagccttgtgcaatcaagaattaatgatataatgtgtatggagtaatatttaactttatttcgttataagcccttttgggatagtggttgttccacataacttttatcttctttaatgcttagtatctgctagaaatgtagtctgtgggatcataagagttggggaagatttacagatagcattttcagagactgaacagaaaagcatattgtcatttggaaaaattttaaaagtgtctaacttttattcaggaccatttgcttttattttcctgttgttatttatttctattatcttgtttacagttgaaatttggacaattggtctgtatcttttctaattttcattatatataaagacttaggtttcctctttccttatgtgtttgttggtaaacattaggtgctatttttaagttttcaattctcaggcatagtgctacttatccatgttatttatataagcaaatgagcatatttgccaatcaatccacggtaagaaacacaatttaagttcctaccaaggatacctctgtgtgtgtgtatgtgtgtgtatgtatctgaaatatttcactaaataattcatttttttttttttttttttttttttttgagacggagtctcgctctgtcgcccaggccggactgcggactgcagtggcgcaatctcggctcactgcaagctccccttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaataattcatattgttaatacctcaaccatatcttgatattctgttagctttttaaatgatggttgtgaccaactacagttcacatttttcactagtggatcacactctgcagcattaaaatcaccgtgaaatagattaattagaataaatgaagtgttcttttttcattctgtttgtacagtagatattattggattattttataaaatacccattttataaattggatggtatgttataaatggatagtaggatttttcctttcttcattttgtaccaagagaataaaaaacactcctgttcagtacatctctagcaagcctatttcaacatccaatgtctcaaataattaatttttctatactttagtcacccttacacctaaacgttacagtgcttcagtataacttctatgtaaacattattaatcccatttacagatgggaaccagagtgttgggagacaggtcatggatttctcatgttcctgcacagtctaagtgttctaaggagaggcatttacagtgccaattgtataaggagaaatttcaggacagtaaaactactgacatgtccctccctggagacgtccaaggataataaaaataaaagaccttctcttccccttcccagaggagatttgcttatatttgagtgtaatgagcaatctttctgggcagagcagggtggcaaaccaatagaagatcagagttccttcatttgggggttactctcctgtgatgctctctactgtatgcactagtaacatccatcccttactgcattgcctcatggagattggagctcagggaactggtctaaatatattgttctaggtgctgcttttgctacgagtaataaattgtctttgtttctgatccacagttcttgtgtccttatgtcattgtgtgtgtgtgcatatgtgtatgcaggagaacgaatgcggcagattgaagagcagttgaatatcagacctttgtagtgtggtggtggtgattatggtgttgagacagaattttgctgtgttacccagtctggtgtgcagtggcgcaaggctcatttcagccttcgaactttcaaactccatgggctcaggtgaccctcccagctggtactgaaggcacaccccaccatacccagtgattttttttttttttttttttttaagagacagggttttgtcatgttgccgaggctggtctcaaactcttgggctcaagcaatccacccacctcagcctcccaaagtgctggggttacgggcataagccaccatgcctagccctttgtgatttttttaacttaactctggctcacacaatttaactgtaggtctgtttgtaaacctgaagcgctttctatgctttcttccttacatagaccgataaaataagtagaaaatatggtgctaatgactagtatttggtataagtagataaatgttttgtatcacatttgcatgcttataatctgtgatcaatgagcagtctgaatatttttccctccatcctcataagttaaactaaaaaaaagttatagattgaggctgggatatctggtggcgaaattatatttatttgaacagagtttgtgtatatacatacatatttcagaatatattgaaaaataaaagtgtaatgaccttgataaaaatgaaatattcacttaaaaactccatttaataatgcccacaggaaagaaatgcttctagaattttttaactaatcatttttctcagtacttttgattgtcatgcaaactaaagaaatggacttaatgaacaatttagttacaataataaagtttcaaaaattctaaatttacctcataattgcaacagatgcaaaattatttcatatctttatactcgttatgaaattacctcatatccaaaaatatttatgtcaagtgacaggctttttgcagcatttttgatattattacccttgtaatatataattaactttgtaagttaaccttgtggaacttttaagggaaatgcattaacttagcattaatatagacttctaaaatttactgtgatgtagaacatttgatttaatgttgtctgtgtctaatacaaaataactgtggtccacttacttatttcaaattttattctcaaaggtacctactagattatgtgtgaagaagtttgtgaccaaagtaatataactgattctgttttgaaaatctagaataaagtttatgcaaaagcatatggattatttctttatgaatgcagttttatactaaaaactcctccatacccacgtaagtagatatattctcatagtgatgtagaaaactgacaaaacttttcatcctcagagctaggaattcttgtgtttggccacaagggaaagacaaaggtattagaattttaaataagctatcatcaacaaatactacatctctccagctccattcataaatatagcaacattttggaagtgcagatgaatcgaacatagttaagtgagaaaaatttttagtaacatacataatttgtaaatattgaatcgttttttaaatgatactctgagtcataattatttcaaattgtacataatgctagaagaaactaggataatagcagaataagttacagtgactaaaatcataggtttttttaagagattggggagtctctgtggtgcccagtctggagtgcattggtgcaatcatagctcactgtaaccttgactcctggcttcaagcaatcctcctgtctctgccttccttttgtagtttcaggtcttaacatttaagtctttcatccattttgagttgatttttatacatggtataagatgaggatctagtttgattcttctccatatggatatctttggtctatatatttatttatatgacagtaccatgctgttttggttactgtagcttggtaatataatttgaatttgtgtagtgtgatgccgcagctttctctttttgctcaggattattttagctatttggggtcttctgtggttccatatgaattttaggatttgttttttctatttctgtgaagaatgcctttggtattttcatagagattgcatttaatctgtagctcactttggttagtaaagatattttaacaaggccgagcatggtggctcatgcctgtaatctagctctttgggaggctgaagtgggaggattgcttgaggccagggattcaagaccagcctaggcaacatggcgtgaccgtccctacaaaaaaatatttttttaattagctaggcatggtagcatacacttgtagtcctgtctacttgggaggctgaagcaggaggatcctttgggcccaggtggtcaaggctgcagtgagctataatcatgccactgcactctagcctgagcaacagagagagatcttatctctgtgtaaaagaaaaagaagtgtaattaaaggaaaaaaacattttaacaacagtctttcaattccaaaacatgggatgtctttttttccttttctcttcagtttctttcatcagtgttttataattttccttgtatagatctttcatctgcttggttaaatttatttcctggttattttatttttttgtagctattgtaaatggtttgctttcttgatttctttttcaggttggttgctcttagtgtatagaaattctactgacttttgtatgtcgattttgtatctgacaacttaataaattcacttaccagttctaatataatatggtctaattaatatattagactagaagtataagatctctcctggagaatgttccatgtaccgatgagaagaatgtgtattctgtggcagttggatgaaatgttctgtaaaggtctgttaggtttatttggtctagagtatagtttagcttcactgtttgaagttaaacactgatgttcttacatttcttataagaacattttatgtttcttatgtataagaacactgatgtttttatatttctagtctaataatgtattattaaactaaaaatataagatttgtcctggagaatgttccatgtcctgatgaaaagaatgtgtattctgtagcagttggatgaaatgttctgtaaatgtcttaggtttatttggtctagagtatagttttttacttcagtgtttgttgattttctgttgggatgatctgtccattgccgaaagtaggaaattgaaatcccctactattattgtatttatctcttgctcttgctcttatgtattcacacttgctctctctcatgctctctctctctctctttccctttgtatctaataatatttgctttatatatttgggtacaccaatgttgggtgcatatatatttactattgttatatccttttgctgaattgacccctttatcattatattatgatctcctttgtccctttttacagtttttgacttaaagtctattttgcctaatgtaattataggtattcctgcccttttctggtttttatttgaatagaatatctttctgcatcccttcactttcagcatctatgtgtctttataggtgaaatgagtttcttgtaggcagcatgtatctgggtcttgtttttaaaatccattcacccaccctgtgtctttatttgggttttatttgagatggagcctcactctgtcccccatgctggagtgcagtggtgtgatctcggctcactgcaacctccaactccctggttcaagcgattcttctgcctcagcctcccaagtagctgggactacaggcgtgcaccaccatgcctggctaatttttgtatttttagtagagacggtttcactatgttggccaggctggtctcaaactccggacctcatgatccacccgcctcggcctcccaaagtgttgggattacaggcgtgagccactgcgcccggcctatcctgtgtcttaattggagcatttagttcatttatattcagtattattgatagataaggttttactactcttattttgttacttgttttctagttgtttttaacttttcttctgcttcttttcttactgtctttctttgtggttaggtgattttctcttaagagtacattttaatttattgctttttatccatttttgctctgtggttaccaagaggcttataaataaacatcctgtagttatagcaagtatttaaaactgataatcaacttaactttgattggaaaaaaaacacacaaaagtgaacattaacttccttctcccccttcattttgaatttctgatgtcacagttcacatttttatattgcctatcttgtaacaaattgttgtagttattatttttaatagttttgtcttttagtcgtcttactacagatattagtgttttaaacactgcaaatacaatattaatataacactcattttagtgtttcttccagtttgaagaagtttttaaagcatttcttattggacaagtctgattatggtaaattccctcagcttttgtttgtctaagaaagtctttatttctccttcagttttgaaggataattgtgctgagcacagtaatcttggttgacagtttcttctccaccagcattccaaatatattcttccacattttcctggcttataaggtttctgctgataagtctgctaccaggcatattggatcttccttgcatgttatttacttctttcctttcagtgatttcagaagtttttctttgtgcctttgacctttgtgagtttgattataatgtgtcctagagtagtcttctttgtgtttaatctaattagtgatctttgaccttagtctacctgaatatttatatcttttttcaggtatggaaagttttctgttatcatttccttgtataagttttctacccctttgtctttctcagtccttctttgacttcagtaacctgaatatttgcccttttgatgttgtcccatagattttgtaagcttgcttgcttccttttctttttttttctcttctcaccatatttttaatcatttttctttgaactcactgattcttttatttggttaattctgcttctgttgctctctattgagattttcgcttcattaattttttttttttagttgcaggatttctggttttttaaaaaagttatttgagtctcttatatttctttcataattttctgaattgattcttcatgttttctttaagttctttgagctgtcttcaaacaggtattttgaatttttggagagatcacatatctcggtcactttcaggttagtctgtggtaccttattttgttcttttggtgtgatgtatttccctaaatgttctcaatgctttagaagtgtgatgatgtctgagcattgagggatttgtaatttattttagtcttcccagcctggctttgtttgtgcctgtccttcttcaagaggccttccagggattctaaagctgacttactattgcattctctgagcctctgaccaattacagccatctcagcactagagtatgctttaagcccaggttttctgagtcctgcaagggcaccaaggttgacacagctttctggcccagatggacctcgggaagacccaagggaggtagttgggctgcctgggaatgctgtccagacacctgaagccagaagactctcctagtggtcctgataggtatgcctcccaacaaatctctgcacagatgggataggtccctgactacaaagagagtggctggagttgagactgtgcgtctttggaatctactgtggaaaggaggctgattggctcacctcattggctcagattagcatgcatcacccaacaggtcccagtatctgggcagtttcttgactgcagcaagagggcttggagccaagactgggccccttcagtatctactatggatatgcctgtcacatggatccagttgggcgtgtgtctcccagcaagtccctccatagatggaatgattccctgactacagcaggagaggctggaggtgtgactgtgcccccttgggatttgctgtgggacagaggattgagagcctggtcttggctcagaggggtgtgcatcgccctgaatgttcctgcacatacaggatatttccccaactgcagtgagacgagccaaagctgaaactgcaccaccctgggatctgctgttggatggaggttgatgtgcttgtcatgttggctcagatgggcgtatgtctcccagcaggtctctgcatagacaggagggttccctaacagcaggaggagggtctggatctgagactggaccctctcaggatctgctgtgggatggtggctggagaacctggtctgagcatgcatctcaccagtagaccctgtagacaagatagtttcctggttgcagcaggaaaggctggagctgagactgggctccctcaggatctcctgtgttgcagaatctggagagcctgtcttgtttgcccggacagatacccctcttccagcagatctctgcacagaattattttcagaccacagcaagaagggtcagagctgagaatggaccacctgaggatctgctgtgggatggaggttggcgtgcctgtctcattagctcaaatgggcacccatctcccagcaggttcctgtttctgcacagataggatgcatcccctactgcagcaggaggagctgaggctgagtctggggcctcccttgggatctgtggcatggagtctggagccccttgtctcattgactcagagacacacccacaggagataacttttcaacttctagtaagcaatcatttgaatcattaagtatttttggtgtattatacataaccacacttaattacaattcatacctgtaccttcttattgctacccatatttgaggaataggtctttcccttctttccttctatatttaaaaccttttatctatattttcttctcatgccttgagtctaatctcaaaccttgttctcttcttgatctttgctaactttgttgtaaatgtgctcctatcccactattgaaacaaacaggcaaactctccaacattcgccttatctatcctcatttcagctgaatttcttgacagtgtagttcacacttctttatctctgatgcattcagctgctctcaccacgtttttaaaatccagtgggcacgagtcacccatgaccttttagttgccaaatccagtgaacacttttcagttcttgtctgacttatctctggcatttatcagtgttgaccttaccataactctgaaacttttcctgtcttgcttagcttatgtgataccttttccctcaggtttttcttcttttctggctcctcttcttccttttccacagctggcaattcctactcttacagctcttctaatgttttcctttcctttcctttatctttaggcaaaggctatggtgtgtgtgtgtgtgtgtgtgtgtgtgtgtgtgtgtgtgtgtgtgtgtgtgtgttctagcaacctctttcaaatgaattccaatggattctaacactaagctggagtgtcaggtactacttgtgatttcttctcttttatcttcctgggagttttacagaatctacagtagtgatcactacttcccacagtcttttcctgacactttctttctccctttctccagtttattcacttctcttttagattacaggacaattttcctctgttctccgtacatccagcctggctgtcctccagtctgtgttccatagagctactgaaaaccctactaagaaacaaattttgtaataccatttccttacaatgcttcagtaattaatgttaacatttaggttaaaaacagccttatcattaagaaaacttttaaactgatttaaaatttatataatgtgaaatcattttaaagtatacaattcagtggcatttactgcattcacaatgctgcacaaccacaaccataatttctaaataattctaagttttcatcaccccaaagggaaactccatacccatcaagcagtcatttgtcattctcccctccagctagccccgttcatccattaatcagctttctgtgtccgtgggtttacctattctggaggtttcatatacatgaaatcatcactatatgtgaccttttctgtctggtcttttacttagaataatgtcgtggaggtgcatcccattttgttgcatatattagcacttcatttttttgattgaataatgttccattgtatagctataccacatttgttattcattcatcaattgatggacattcgagttgtttctgccttttgaatgcctgattttgattcatttttgtagagtccttaggttttcctaagtataagatcatttcgtctgggaacaaggctaatttaatttcctctttttcaatttggatgccctttatttctttgtcttacctaaatgctttggctgattcattttgggcaaatacctgggaagagtgtttaattgctgggtcatatggtaattctatatttaactttttaaggaaatgccaaactgtctactacaacatctacaataagataaattttcaccagcaacttatgagggttccagtttgtgtacatcctcactaactcttgttattttattttccagttttaaatactattaatatctaactcagtgggtataaagttatatctcattgtatttatgatttgccttttcctaatgactaatgatattgtaaatgttttcatgtgcctgttgcccatgcatacatctttttgggagaaatgtatattcaacttactttcccgttttttatttgagttttatttttaaccaagaaataccttttaagtgatcagacctggaaccttgccaggtttaatgattatcaaagcagagccatattttgacttttgatgttatctattattatagtcttgttattcataattacttgaatattatcagcatctctagatcctttgtagttaaaacatagtaaagtattttaagtctttatactaaaatagtacgtcttgaaagttttaatatagaacactctgcttagcatttctttataacctaaaatgcaattaataaaagggtgtcatttcctctgccaattaagtagccttcattggttgatattgaacaaattgctgatacttatttctgtgatgtttactttttaaaaaaaatattttttgctttctttttaacacttccaaacaattgctaggttaatttgtcagttgcaaatctgaaataaaattgtttttagcagtctttcaaataaaattttcgttgagactaaagagatcctggattacaatcaacatttgtagatatgtcatacatagagaaccaaaaaaaaattataaatctgatataaatatcagtgtgccatacaggcatggtggctcatgcctgtaatctcagcattttgggaggctgaggcaggtggatcacttgagtctaggagttcgagattagcctgggcaacatggtgaaaccccatctctataaaaaatacaaaaattagccaagcatggtggtacacacctgtagtcccagctgtttgggaggctgaggtgggcggattgtttgagcttggtaggcagaggttacagtgagccaagattgtgcctctgcactccagcctaggtaacagagcgagaccctgtctcagaaagcaaaacaaaaacgcccaaatatcaatgtgctatgaaaccacacattgtatgtgttcattcccacaaattggagcattttaagaagcgctctaaattagtttatgtcttgcttttcttcttatgttctgtagattctttagtactccataagaaaaatttgctatagaaagcataaaaactgcaaatgcattatatcctccatgaaaccagctttaatttagttgctaaaccctgatcattgttgcactatacactcagaaaatgtatagcagtgactattttgtaaatatgaagagttcatattcagcacattcagcaatggtttatatctaaaatgatttttgaagaatgctttaaaaaacttctttgcctagagtctttaaagctggcactttaaaactatgtttcatggattgtcagttggaatggacttcaggaggtccataagtccatgaaattacagttttttaacatgaatttttctgaggatacatgatttttatcatactctcaaaagaatctaaaactcaaaaatggttaagagacacttaaataaaatgttgataaaggccatggtcattgattctcattcttcagaagctttgcatgtgtgagtttacctactcactaaaatgtacttgtaaatccaaaaccagtactcggtgcttttgcagtcatttgtaaacatatttggagaagcaaaaattttgagttaccttatgtgttcattcctctctgaggtcaaagaaggtgatggtttgccttgtttcagctgtcatactgtaaacaagtgtccttttcaatgcgtatttagtgccatattaatcacattttttgttgttgatttttctgtttaaaatggttcccaagcatagtgcagatatgctgtctagtgtttctaagcataagaaggctgtgatacacctgagagaataaaaatctgtaatagacaaacttggttcaggcatgagttacactgctgttgactgtgagtttattgttaataaatcaaatatgaagtatcaatatctgtataaatagttaaatataattatatatagatgtaaatataaattgttaaaatacggaatctttaaacagaaacatacattttagaaattatgtattggcattggttgaccaagatgatgtttggagaggttttcaggaaactaaccctgtctttttcccaggaacaataattctgcaggaggcagaacctgttgtctaggttggagtacagtggcatgaacatggctcactgcagttttgacctcctgtgcttcttctgccccagcttcccaagtagttcaggctacaggcacatgtcaccatgcctggtaatttttgtattttttgtagagacagggtttttcttgcccagactggtcttgaatttctgggctcaaacaatcctcccatcttggccccacaaagtactgagattagagatgtgagcctccatgcccagctatagttaaccttttgcagtgtttttttttttaacttaatgtttctaaatttcttctagggtaaacatttactacgtagaggctgtgtgtcatttacctcttcatggtatcacacatcagatacttctaacataatcatgataaatgttagtggtttcatggtcttatttacactccagctctaccagaattcactaatctacttcaagtttctgtctgaaatattctttttttttttttgatacagagtctcactttgttgcccaggctggagtgccgtggccccatttcagatcactgcaaactctgcctcctgtgttcaagtgattctcctgcctcagcttcccaagtagctgggacttacaggcacacgccaccacacccaactaattatatttttagtaaacatggagtttcaccatgttggccaggctggtctcaaactcctgacctcaagtgatctgcctgccttagcctcccaaagtgctaggattaacagacacgagccaccgcatcctgcctctgtctgaaatattcttattgttcatcatacagtatattgggctacagtactgtatttttctccagggtgttggtaaccatttatgctgagtttagccattttacttaagagtctactaattcactgtagataaagagttactactttggcatggtggagcatgcctgtaatcccagctctttgtgggaggccaaggcaggtggatcgctcgagtctaggagctcaagaccagccaagacaacatggcaaattttatttctacaaaaattacaaatattagccaggtgtggtggtgcatgcctgtagtcccagctactgaggaagctgaggtgggaggattatttgagaccgggaggtagaggctgcaatgagccatgattgtgccgctgtgctccagcctcagagacagagcagtaccacaaaaagagttagaagagttctttatctaacaaatatgagttgtatatttgcatagttgattgcattcatgaagtctaagtatttttttattcattaaatctaaaggaagttggggctctctgctttcgataagatgaagtaacaagtactgtacttatccttcacctaaaataatgattaaagaaaatttgtgtgtttatttcttaagacacagaacaagcatttgataaaatccaacatccattcctcataaaatcactcctgaaactggtgatagagaggaacttcctcaacctgataattagcatctataaggaaccaatggtaatattatatttactggtgaatgtctgaatgctttctcactaagatcaggaataagacaaggatgtctactttcactacttctgttcgatactgtactgcaggttctagccagtgcaattagttaagaaaaagaagtgcttctagattaaaaaacagaagtaaatcaatcattatacttcagtgatatgatcatctatgtatattattctatagaatctacaaaaaggtactagaatgaataattgagtttagcatgcttgcagaatataagatcagtatttaaaactcatgtagttttctgtactaggaacaaaaatttgaaattaaaatttaatagaagaaatattttctatcacataaataataggctatacttggggacaaatctgacaaaagatctggaagacctttactctgaaaactgtaaaaacattactgaatgaaaataagtgtgcagattctttacatatgatactaatagaatgatctgtttaaaattgattaattgtgcatcagctatatacataagccaaaacttaaacaattgtacaccttaaatatgtacagttaattttgttaattcaaatccctatactactgttaaaacaaattagaaaaacaaactaaaggaatttatgttcatatgacagtgaatgagttgtctgaactcacctcaatttttaatcctaagatgaatccatctctaaaaagtactgaacatctctgaaaagttatgaatatggtgtatgttttctcccataacctcatatatagcaattattgttattaggaaatcagaactagcttaaataatcataacattgaccatctgctttccttgttaaatacatttgactactaacttaatgttttcagttagccctctaaaatttgagaaagcaacatcttttttacctttttgccagatttctacaggctttctgatatatagttggccctctagatcattgctggcagtttgaaatatgtgtgattatgatagagtatttaaaatattttattataaatatttgatcaattttttattatataaattttcttcttttaaaaaaatacaatttagagatggggatcatactatgttgcccaggtcttgaactcctgggctcaagtgatccttctgccttggcctccaaaagtgctgggattatagatgtgagccactgcacccaggctagggtaaacttttgataaatatttttgattatgtagaataattttatggtgagttcaaagtagggttttgcaatttttattgtggagatgtatttatactgttagtttcaggatatctgtactgatcatctcctgtgtttttaatcatgatgtttccttttcaaacaacacattatgatgaaagatcaattttcaatgaaatcatttataagtatatactagctattgcaactttggggtttggaaaggaaaaattaaagtgtgttatgtttacatgttggaaacatgttagaaaaatcagtctaggattggaaggagatgggaagatttaggagtaactgctaatgggtacaaggtttcttcttagggtgagaaaatgttctacaatgatttgtggtaatggttacagaagtatgattatacctaaaatcattgaatcatatgctttaactggataaataaaaggcatttatattggaaaggaaatagtaaaactgtatctgtttgtagataacatgatcttatataccaaacaaaaatcttaagcagtcccctacagatctattagaagtaataaatggcttttcacactacccacatagacgtccatacggcgttctttctggattcccatcgtagcttaaagcgaaacttttcaccatgtctggagcccttgatgtcctgcaaatgaaggaggaggatgtccttaagttccttgcagcaggaacctgcttaggtggtaccaatcttgacttccagatggaacagtacatctctataaggaaaagtgatggcatccacatcgtaaatctgaagaggacctgggagaagcttctgctggcagcttgtgccattgttgccattgaaaaccctgctgatgtcagtgttatatcctccaggaatattggccaaagggctgtgctgaagtttgctgctgccactggagccactccaattgttggccacttcactcctggaaccttcactaaccacatccaggcagccttccaagagccacggcttcttgtggttactgaccccagggctgaccaccagcctctcacagaggcatcttacgttaacctatctaccgttgctttgtgtaacacagattctcctctgcactttgtggacattgccattctatgcaacaataagggagctcactcaatgggtttgatgtggtggatgccagcccgggaaggtttgcgcgcgtgtggcaccatttcccatgaacacccatgggaattcatgcctgatctctacagagatcctaaagagactgaaaaagcagagcagcctgctgctgaaaaggctgtgaccaaggaggaatttcagggtgaatggactgctccagctcctgagttaactgctactcagcctgaggttgcagactggtctgaaggtgtgcaggtgccctctgcgcctattcatcagttccctactgaagactggagtgctgagcctgccacggaaggctggtccacagctcccaatgctcaggccattgaatgggtaggagcaaacactgaaaggtcttaagctgttattgcacacgctcttaagcaacatggaaataaggttgacggaaaataaatgtcagtttaaaaaaaaaaaagtaatgcattcagcaaggttgacagataaaatatcaagatagaaaaatatattggatttttgagcaatattaatgggcaaattgaaaatgaagttatgaaacaatttcatttaaatatcttaaaaagaaataatgtacttaagtataaatataacaacagaagtgtggaacttatactctaaaaactacataacattgaaagacattaaaggaaactaaatggaaagacattaaatgttgatattttgaaaagatttaatatttttaggatggcagttctcccccaaattgatctaaaataaatttcctactaaaatcacagctaaattctttgcacaatttgacaagctgctcttaaaattaatatggaaattcaagggacccagtatagccaaaacaatcttgaaaaagaccaaaattgtgtttctcacttcccaattaaaaaacgtatgatgaagccataccaatatgtagttctggcataatgatagacatatctattaatggtatagaattgagaacagaaataagtcttcacatttatggtaacctgtctttctataagtgtgccatggcataaagaatagtcttttcaatgaagggtactagaacacctgcccatccatatgggaaaaaaaaaaagctggacccctatctcatatgcaaaaattaactcaaaatgaattaaagacttaaatgtaagaactaaaactgcaaccgttagaagacatagggatacatgtttatgactgggcatgggatatgagctggcaaatgattcttagataggtcaccaaaagcatgagcaataagagaaaagaataaataaattagatttcatcaagttttgaaagttttgtgctttaaaggacaccatcaagaaagtgaaaagacaacccacagaatgggagaaaattgcactcacatatctattttatcttgaatatataaagaattatttagactcaataatgatgaaaagacaaataactcactttaaaaaatgggcagaatatctgagtaggcagtttcccaaaagaagatatacaaatgactaaggagcacataaaaagatgctcaacataattagctatcaggtatattaaagtcaaaactacaatgagataccatttcactcctgctaggatgatgggtataatcagaaggacagagttttggcaaggatttggagaaccctaaggcattgctggtgggaatgttaaatagtgcagcctttttggaaaagagtcttgcaattccttaaatattttaacatagagttaccatatccagcaattctgctcctaggtatatacacaagacaaatgaaaatgtttgcacaaatgtttatagcagcattatgtataatagcctaaacatggaaacaacccaagtgtgttactgataaatgaataaacaaaatttggaatatccatgcaatagaatattatttgacaaaaaagaaatgaagtactgatacatgctacaacatgggcaaattttgaaaatatcgtgctaaatgaaggaagccagtcataaaagtacacatgttttatgattccatgtctgagaagtggcctgaacatgcatatttttagagacagaaaataaattagtgtttgcctgggacttgtgaagatgaggttttcggaagtgatgactcaagagtgaactggtttttttggggggtgttgaaaaatgttctaaaattgatgtggtgatgcctatacaactccaaatatactaaacaccattgaactgtacacttcaaagggatgaattgcatagtatgtgaattatatcttaaggagctgataaagaatatatatttattggtctgttttaccctttgaatggattttacccatatgtgatgtttttaccatgatacattaatcatttgccagagtttttgttccttaaattatgcatatcttacaaatgtaaaatgtcttatttgtcaatatcactactaaacaagaaaatagtctttaagcattgggaacctcactggtggatatgagttttacacgatcataattttcagagacccagggagaattatctcccattttttgattagttttctgtacactgttgcctaattatctttctgaaatacagattgatcaggtaactctctgatcccagcctgcttgtcattgtcatgcatggttagtccttcataaaatatgctattatggaccccatcttttactaaattcagagaaagcatgcccatgtctctctgtgttttttgtgtgtatgagtttctctatgtataattcactttagtttatttttcttcttttcgcctggtaaaatcttcaaacttcaagaaacagcatatctgttatttactctttgaccttttcattataccccatattccttggtgctttccaagttttttgttcgtacctttattataacactcctcgtatgttgttttcatgcttactcctccagtagagctatgaacttctcatgactttatttgtgcttctattccctcacagagtactttagatataataagagtctcttggattaatgagttcctaattttattgtgggtgctcagtaacatttttattttgatgatgttataattgaggtatgaatcagactccccttacactttctgcatataaatcttttttgtaaaagaattctatacattttaattatcctataaaaacttaattaccaatattgtttgtagatgtctgttgccagatttttaaaaaatgatgcattaccatccccataaatgataattgccttttgctttttttaatataaaaatgacaactttgcctgtcaaattataaaaaatgttttctcattattttcatttgccattctttggttactgtgctagagaatatatatgtctattgtttgttagtgtttatatcattgccctttaaaaaaattgtagttgtgcaagaatggatgtaggcaggctaaaatatggactctccagagatgtggatatgcctgggaaattgtcatttgatttacctgtcttcacaatcagcattttggaccgtgatacagttgttactacctatttacacttggctgataggcaggctcaaagctgtagcctcttattagagtcagtcaaggggggccagaatggcaagagccatttttttttttaaactgctggtcctacctcagcagcaccaggagagtggcaaagggggcttcttcaaagattttatggtatcttcactttatgtcaaagtctaagctatcagtatttttctttgtagtagttggtgtatgtgccaaagttagaaaatctttctctgtcttggttattaaaataagtggctgaattttctaatacctttatgggttctgttttgttttggtttgttttttcatttgtgtggggtttttgttgttgctgctgttgttgtttttacacttttggttaaagtgtgacaggaaaaacttttctttttttccctgaaaatggttctgtttttatgccagcttaatgtactaattccctcatttccgtctaaaaaaaaaatcacctttattttaatactatattgccataggtacttggatccgtgtttgaactctgtatttttctgttgatctgtatattagtaccaaattgtttctaaagcaattaacaaataatacattttaatacctggtagtaaactgctcccttaatcccatcattattactcatctatttcagaaggtactttcttattattcttccacatgaatttaaaaatcatattgatattttcaaaatatcacattggaatttgtaggttctttaggaagaaataacattttagggtacatttttgttttcttatcatatatcaagtttttcattttaattatttatttcatagctttttattatcgaaagtttcaaacatacacagagaaagaatagtaggtataatgagctccacgtttctattctctatctagcttcagtaattatttacatttgccaaacctgatttaagtacctctcctatgaagcaagtcccagatgtcttatcatttcatcctcaaatgctctagattgcctgagaatggtctcaaaaaacccaccatcatattattcacaatggtaatttcttactgctatttaatatccaatttagatttgcatttcataattgtttcaaaaatagccttttacagtaagtttatttgaatcagcatctaaagaattcaaacactatatttgtaccttgtgtcttttattattactgcttttctctctctcgtcttttttttttttttttaatactgtcattgacctttttttaaaagagaaactgtgttatttttccaggagaatatctcactttctgaatttggttagttgcttcatatttagtatttgctgagaatttgagctagagatttggttaaactcaggttttatttctttaggcaagaatcttcttaaagtgatgctccatcatttccattttatctcatctgtgagccatcatatctggtggttccacttttaatgatgctgagattaatcaatatgttcaggtgtaggttttttgtttgtctggttttctttctgctattgtatatagaacattttccttactgtttttctagtaggttattattggtatctgagaagatttttaaagcatgtgttttagtaactggacatctgaccaaactctcattactgtgtcaacttaaaaatcatgagatctgtaaatctggaaaagagaactttatttctgagaagggttacaacctgtaggctgggaagcacagcctctggattagatcaaaagtagccatttcaaagacgatgggtgagagaggagttttacactaaatgggttagctgaacatacatatttaacaggttataggaggagctatgagtattcatgaaaggggttacatgtatgtatgataagcaaacataacatgttacatatgtcccatgttcgctttggaatggagacttaacattaaaaatgtggtaaaatcagactctatacatcaaaggtgaaacttaggactcaaaggtgctttgtgcacattctctgtaaactgaccagtccatggtcaattgtcgtttatcaggaaggattgctttgtaagttggtcagcagtcatgtcaaaaccatgaaaagggaggggaatctggccacaacatcaggcagttggtcagtggaagaattttccattctttcttttccagggctggtgtttgtttaactcttaggaaaaatagtctaatgacaggtagtgaggaagagtgtatactgagacgtgaccaacctcctatctcatcaaggccgggaaacttcgtttttaaagtttttctggggcctccttagcccacagacatctgttcagtaggttggggcacttaggattttactttatctcacaaatatctaataaaatttttgggtgatcctcttcagtgactagtatagaattgtcacacttgagctttggagatgaggtgtctcaaattaaaccctaggatggttatttagtctttctgtgcctcagttttttttttttttaatctatgaaatggagatcatgtgtctacctcataggtttataatgaagattgaatcacttcccataataatcagaaactacatatttgggctgggagcagaggctcacacctgtaatcccagccccttgagcccaggagtttgaggttatagtgagttatgagcatgccaaagcactcagagtgagattctgtttcaaaaaaagaaagcagatgtttgttttttaatttttccatatcttttgcagattgtgatattgtgctttccctttttttcatattttaggcctttaattttaggatgtaattatataggccataacagttaaaaaatagcagtgataacatgcatcctacaataacatgaatagctaatatttattttagtataattttcttcttgtataattatgttgttttagtagtatgttttgaatatcaccagaataaatttttggtatctattaaaataatactataatttctttacattgatcttttaagatacagtttatccaatacttatgatgccaggttccagaatgcattagaagagtgtttgtggcatagggaatgttggaacagaagcaacactttacaatgttaaatagttttattgagaaggtgagatttgggtaaagactttcaagatgagtgaggatccatatgggtttctgggggaaatccagttcagtggaggggttggcatttgctaaaggagggcatgtttggtgtgtttcaaaatccagtagggagccgggtgtggtggtgtgcttctggagtcctagctgctcaggaggctaaggtgggaggattgcttgagcccaggagttcagatctagcctggacaacatagcaagatcccatctctaaaataaaataaaaatttaaaaaattgtttaaaatcctgtagagagttcagagtggttggagcagagtaatggagaatagtagacaatggagttagagaggcaatgagaggtaaagggaagtggcttgaacctgtagggcctcatagactattgtaaagatttttgctttttagtgagtgttgttggaagcattacagggttttgaacaaaggaatgacatactttggcttgcatttaaaaaggacagctctatgtgcgtggagtcaaggatggaagcagagaggttaggaaatcatcgcaacagtctaggcaagcagttatggtaacttggatgggtggtagcgtggagttaatgaaaagtggttgaaatctggaaatagtttgagaacaggcttttcaaatggactggatgtggtgtgtgaataacactcttctcactggtcttgttgcctctccaatccagttatacacagtagcaaaaatgatcttactttacatttgataatttcaccttcttgattaaaatccttcagtgacatactattacactgaataaaatttatccttcttaatataaccaacaaggcccacataatctagaactgcatatttttctaaccgttttcatctccctgagctccagccatacaggtgttaaattgttttaatatgccaaagtttttcctgcctcagatgctttgcattgctcctccctctggaaacttcccctaaccgtaaggtcactctttacccaatcagctcatttgcatgtttcacgtctcagtttaaatgtccttttgtctatttaaaatatattttagctgagtgcctttaatcccagctacttgggaggctgaggcaggaggataacttgaggccaggagatagagaccagcctgggcaacatagagagacctggtctctgaaaaattgaagaattagctgggtttgatggcttgcacatgtagttctagctacacaggaggctgaggcagggaggatcacttgagcccaagagttcaaggttacagtgagctatgattgtaccactgcactccagtctgagtgacagagtgagactccatctctaaaaaaataaataattggttccttctttgcctgcctcccactctttgtctttctcaaacatttttttcttcatagcatttcttacaattatgcattttatttctgtgtaatgtttttgtttgctatgctttgcattttatattgtgtggaatctccatgaaaataaggaccagcctgacttgttcaagtttgtggtcaagtaacaggatggtacctggcccttagaactatctttataaatatcattagattggattgactgactcaattaatgaacaaatgaacaaacaaaataaatcattatatgctgaagtagcagtcctggacattgtatctaatttagattttaatttaaccttgttattttgatactcgcttcccttaatcagtcattgcatgttccttattgtaaggtggttgtttttctttatcatgagaagaatagttcttctccgggcgcagtggctcacatctgtaatcccagcactttggggaggctgagacgggcggatcacaaggtcaggagattgagaccatcctggttaacatggtaaaaccccatctctactaaaaatgcaaaaaattagctgggtgtggtggcatgcacctgtagtcccagctacttgggaggctgaggcaggacaatcgcttgaacctgggaggcagaggttgcagtgaatcgagatcgtgccactgcactccagcctgggcgacagagtgagaccctgtctcaaaaaaaaacacatttttttatttagctattagcttctaggcaaaatcttaaatttcagaaaataattatactcatatagtcatactacctgtcagggaaatgtgtcaaaggaaatatgaaacaatagctttaaagttgtcccgcaccctcaccctgtttttcttttgaaggtattatactaaaggaagaaagggaaaaagagaaatctatggtgtgagttcaagtttactactgtaagtgtttaagaaagggctctgttaccatgacaacaaatgcatgaatttcatgtggaaaattttcagtgtatgggactgataaaattgtaacattctgattttctctggtatagaattgttctttgtcaagttaaaaaaaatctgttaatatatgttaaaattaaatttttaaatgttttatgatattgttttctaattgtttattataacttaaaatcatagccaaaagagtgtactttcgtagatctgtcaagcagaaagttaagtatttgatttgacattaaaaattacttttctaatctgtattagatttttgctaaatggtaaataaaatggtaaatagtttcatgtattgggagttcttgacaatagaaaatgacctgccactttatagattcctttgccttaaatgcttactaactcaggtagaggaaagctgttaagctttaagtgctttgtcatatttgcaggcttttatagtggaagagaacagcagtcagcaatgatgatggaaaactgtggcaggtagacttaaaacaccataaagcacagacgattgtgtgtaatgccttgaattgaatcctttttgaatgaaatgatcagccatatgtgccacccttatggaccctgtaagaagagtagaagaaatgtgccctaatgctaactgtgcatgaaattgcagtgttaggagatattgaccagatgtttcaatctcagcaaatggcttgttatgtgactgagtgaaaatatctttgctgctttgatcacatacaccttgaaggaaggggtaatttaatagaggctgtcatagttcatcattgtcaataaactttgacttgacctttgccttacgtttttgatgttgctgctgttaagtgttgttgggcagatgtttactgccttgagggattttgctttttataaagtgtatactagaaaaagtaaaggagaaggattttctcaattcttttcttattctttggttattagttggcatgcttctctgtggattttgtagaatttctgggcagatgcatttgagtgacattcttatgtctaaagatcactgtggtgtttctctaaaggtttcttcctttcctcaccttcctttttcttttctcgagacatggtctcactctgtcactcaggctggagtgcaagtgatgtaatcttggctcactgcagcctctacctcccaggctcaggcgatcctctcacctcagcctcctgagtagctagaactacaggtgcacaccaccatgcctggctaatttttgtattttttctagagatggggttttaccacattgcctaggctggtctcgaacttctgagctcaagccatctgccggcctcagcctcccaaaatgctgggattgcaggtgtgagccaccgcacctggccctttctcaccgttttgtcctggttttaatttaccacaataaacttccttggtggtttttctttcttattttatatacagcctattcttttgttctgatgaaagtcacattgaattaaaacttgacacctattgtaacaccataccaggtgctgtgttatttttttatccctagttttggagacctttggagataaatccatgctattttgtaatccatttttgttaatcttaagaaattgagtgaaagtttcagtaacacaatttttttaaaattataagatacagtattttaaaattttggtaaatagctttggattaaatgagtttcttgtttaatttgatgaatttgactcagttctgtaacctttttgctctttttcttgaaaagaaaaaggcttcctcactggctatatctgggttctgcctacactcttccctcacttccccttggtgtaggtggcctagaccgtgttagtcacctaatgaaatctgtgaatcctctcttgaaaaacacagcaaagtttccttacaatttcaggatgtttattggattttccccccctcctctcacacataccctgcaatgataggggcccctggacttcaagcagactaacaaagcttagaaaataagattcatactccttcttagtattctagatatataacaatttgacttagaagtaacaataacaatagtattagtgatactgctacaataattacaacagtaataataataataataattaaaatttactttctgccaaccttatgccagattctatgctgaacctttaacctgtattactggttatattgttaatgatacctctagatagagtatatgcagcatacttttattctgtactttaggaaatactatatctttagaatacagatttgagtaagagattataagcattttgattctaagactttttggaatactgaacttttagttttctgattccagtagtcagtctgtctgtctctgtctctgtctctgtctctctctctctctctctttctcggcctctctgccattcatcttcttctgaaaattagctatcccacgtaagcctcatatatcccctaattcctatttgtagttgtgagggaggaaaaatattttccttctaagttctctgctgtaagattcttgtaacaaaagacagattaacaaaagttaagtacactaatttatattctaagttttatgtaacatagagggaaatgaagacttgaagaaacaattaaacctggtgtttttacattaggttttatgaagagtggaagggaaaggcaataggacaaaaaggggtatgaactaagagtagtaaactgaggggaccttagcaagacctgtttgtttagattcatctcatgtccttacatcttctgagataaggatgttctttttttctgcatatagtaaacatcctctcacatggatggtcttatgatttgcttcagaggaaatcagaaagtccttcctgcacctgctgttctcaaattccttcagcttaaaattttcagtatgtcaagtgccatattttgggggtagtgtgtcctgatctccatcatagttaagtgtcagcttggacacagtttctcatatttatcttaggaaatcttctttggccactctgcaaagactaaggtgctacttgcatgttctgcaacaactcctattatatatatatcatctcttaaaataaatagtaacatatcttgtatgtaagctttatgtacccttaaattgtaagttttaagaagatacaatcctggctttcctgttcacttatttgacaattatttaattgcatagaatgtagcaggcactcttctagatttggaaacacaccctacaactcttttaaaaaagccaagaaaacagtcttgaacagcaaattacaattaagtggaattaattctatgataggaatgatacagtttgttgcggcaacataaaatgcaggcatataggctgggcacggttgctcacacctgtaatcccagcactttgggaggccgaggtggatggatcacttgaggtcaggagttcaagaccagcctggccaacatggtggaaccccacctctattaaaaatgcaaatattagctgggcatggtggcgtgcacctgtaatcccagctactcaggaggctggggtaggagaattgctcgaacctggaaggcagaggtttgcggtgagtcaagatcgcaccactgctctccagcctgggtgacagagcaagactccgtctcaaaaaaataaaaaataaataacaatgggtatatagaacagaatttaggacaacattgtctcagtaagtgaaacctgaaacctaagtaggaagctagaaagaacaaacagaaacagaatgaagtattcagtgtactggaacattgcattcaagagtgttaatgcttaggattaacttggagaggaagttaatggttcaatcataaagttgtttatgttgaacttgcttaagatacttgggtaacgattgaaggacattttaggaagagcactcaaaatgcagtggattggagaaaaacagaactaaaggcagggagatgatctaagaagcttttgcaaatggttgcatggttgggaggatggagtgacagagagaatgggaaatgacatccaatgggtagaggtttctttttgagataatgaaaatgtgatggttgcacagctatgtgaataaacaggaaacaactgaattgtatattttaaagtggcaaattgtatggttatatgaatatatctcaataaatttttttaaaagagacttttatagtagtctaattgagagtagatggtggcctgtactaaagtggtgttaatagaggcaggagtaaaagtgtgtcaatttaataggcaaaatagggttgagtaggtatttggatattcagagcagtcatttgaaaacaagtataagctaaaaatgagggggtctcagcatatagatgataattgaaaccatgagagtagattagatcatatccagagaaagtatatacggtaagaattgtaggtaacctgggaatccaggcctgagaaatgctaaggaatggggagaaggaaagaagcctacaaaagagatagagaagacttctttatccattattaattacaataatgtccaacaaataataggtgatcaacaaatattggtggaatgaattgaatgaatatacactaaaaattctgcattttatcacagtctcagggcactgttgtcatcgtcagctgtactctgtaataggcactgccttgaacactttgcttacattatcctattcaatcatcacaataattccacaagaaacatagtctctgaaatagtagcttgtttaccatcacatggctggatgaacttatatatctgagtctaaagtttattttttctactaggcctaatattccccgaatctgttctgagaatgttaacagatatttactaacaaaaataacaatagaactatttcagggaaagaacaggattattagaaattgatttttattaataggatgcttgctggcaggggcaatggagcagttttttaaggaaagaagcataacatactagttattcagttagaatagattcttaatatttatgaaaatcttgtgttttgccctgtctcacttggtggtattgtaatcatctgagaatctatcctataagttatgtgatatatgctattttccttatcaatctatttcagttttgatttcctcatcatcctttgcagtctgcttgttgctgtttctcagttttgacatttaatttcttttagttgtgctttacagtttttctgagatgcctcattgagttttctgtataaaatttcatatctttggcttatcttgcaactcttttagtacctaggtgtcattcttcatcattctattatgaattgaattaaagcatatggcattatttcagaagtgactgcctcttgggcatcattgtcagttatattgtcctaaatattgcatttaggtaataaaaaggaaatcttccttgaaggtaaagttaatattaatagaaatctttccatatgttgttaaagactcttgttatgaagtttaatatgccatttatttaggccttatttaaattcagttgtaaattttttccttctggctccttaccttagtgaactgtcatctcttatcatcatactctttgctcgaaaaccttcatgtgttgctttctaccctcaggatgttgcctaaatttcttgaagtggtatttactgatctggcctacatctacctttcccattagtctcttccttcccacatagttgctttgtcggtatactcctaatagtcttttatttctgtttttcattgtttttgttaatattatattcttgtttcccaatctgtgcactaagtccccttggggtgctgtagcaaacccacagagagtcttcagggtatttcaaaatttcaaggtaaacacagtgacgtctatcagacacagcatgaaccactagctccagatatttcagtttttttttttttgagatggagacttgctgtgtcacccaggctgtagcgcagtggcgggatcttggctcactgcagcctccacctcctgagttcaagcgattctcctgcctcagcctcctgagtagctgggattacaggcatgtgccaccacgcctgggtaattattgcatttttagtagagacggtgtttcaccatgttggtcaggctgttcttgaactcctgacctcgtgatccgcctgcctcagccttccaaagtgctgggattacaggcgtgagccactgcgcctggcctggtatttcagttttaacattagattactacattccttttggtggcattatactgtgcgaaactgaatctttgacggtttctgtgataaaaagcaaatcagtgtgaaacaaatgagggtgatggttaccagtctgattccaagatttgagaattttgcagtgcctaacaggtagaaaatcattaggaaataaacacttttggctgaaacgaattatttaataaatggaatttctttcatcctaggggcaccatgataaaatttctaacataggaaaggaggcatgtgctatatgctgtatgactcttttttctttctagtttgtaaccattttggaagatcatacccatccttcaaagaccaattgatactgctacctgtctttggaggcctttcctgatcccctccactgcagttgatctctctcatgggtattttccagtaatatgctgcttttttactattgctgtttaagttaaactaattgaagtatttatttgaagttaccaatagtggccgtggttttcctattcctccagttaggtataattacttaaagtataacaagagccctttccttctttgtataaaggtgatacaaatataataatagaaaccctatactgtactaaactgcgtaggttgttagtcaatttctttttatttcttttttttcttttttctttttttttgagaggagttccactcttattgcccaggctggaatgcaatggcgcaatctcggcccactgcaacctccacctcctgggttcaagcgattctccttacctcagcctcctgagtagctgggattacaggcatgcgccactatgcctggttaattttttgtatttttagagatggagtttttccatgttggtttggctggtcttgaactcccaacctcaggtgatctgcctgcctcggcttcccaaagtgtcgggattacaggcgtgagccactgcacacggccttgtttgtcaatttctaattcttacaacatccttaaaagatcataggttatgttatccacattttatatttgaagaaattgacgtttagcagtgttagtttttctcacacccacatacctcctgacctttagctattctagttccttttcctttaatattgattatagaatcaactttttgatatcctcaaaaatccattgagagtttggttgggattgcattgaacttatgaatcaatttggggagaattaatgtcttaagaatattgagttttcaaatccatgtacataatatagctcttcgtttatataagttgtttttttttcctcagcagtcttttgtagtgttctacatatatgtcttgcacatatttggttaaatgtgttcctacatgtttcaattttggtggtattgtaaatattgttttcttaattttaattttcaactcttctttgaaaatttatagaaatacattagatttttatatattgatcttaaagtctgagaccttgattgacttacttttaattctagagcatttatgtggattccttatgattttacatatattccttaaacatgcacaggttggtatctagccatagcctcaagggttactctgtagatttcaactcattcttctctgaaaatctttttcacaatttctagtctcctggctctccttgaacacatctctttctcctcattttagtgaaaatgccaggctctatttgccttctttctccctctccatggtgtggaacttgcctcctggcagagtacctgcatgatgtcagggcacaccttgtttctttcctatcagagatcacagtcctaccatgcctgttattcaatgtctgaaaattctgtaggtgtttccttttggttttctggtttacagcacaacagtaattctagagcctgctactcactcatggccagagcagaagttaaagtttttaaggtatactgtacatatgtgaaccaagggaaggtaggcagtttattttagctaaaagaaggagcataatcaaaggttataaacaaggttgaatctccatcctggagaatcaaaatctagtagttgtgactttgtattaggaacatcatcatttttatctttttattccctggcagacatgcattaaatgtttgttgattgagtatcaaaatgataggaaatagattagttggatgttggtgaaacattgtgttttagatgcttacagatgtactaaaattttaacagaaatctttgcaaattacttgttaaattttcctaaactgatttttaaaaatctatttcattctcaattataacatctttactgagattattaagtgctttgaagcagttaacgtggcttttttttttaatggctgtaaaaaaactgaatttttaggcttgttaaactctggttttagaatgacttttgagtggaaatcactgatcaaaagcaaagttctcacattttgtcaatatctgaatgtcagaaatagaatgtcaggcagtttcccatgttgaaatattcgatagtaaaaggatagcaaagttgctgaatatttctactgtttatcaatttttgccttgcaggttcaaataatatttatttgtagtggaaatatttcaattcatttaaatcctgattatggagtagttagtaaatcaggtttaagcctgacagtgagttgatatagctcttatttcagactgtagtttgaacatgtagactctctgattataactaggctaaattatataataatgactttattttcactgaacaaagtttgctattattttgatgacaaattatttaagtaatcatagtaaaagttgctattggctctgggttttatttattttgctatatatagtagacatggttgatcatttaatcatgccttatagataaataaaagtaagttatagaataacacagaaattttctgctaaatttatactttcactaaatttaataacaatagaaattctctgttaaatttatactttcactaattgtagaataaagtattttaagttaggcatttatactgagacattttatgatattaactgcttcatgttatttactcattttgataaatggagtgataatatccaaaatggaataaattaagtttaaattattgttattctttaaaggaatgatttagctacagtatgtttgtcccaccttttaattttgaacattttctaacttacagaatagtaaaatgaacttttctatacctttcacattgatccaccaattgttaacatttcaacacatttgtgttctctctttaaataaatgtatgtgtgtgtattttcctcagaaccattctgaagtatttattccttattcaagaaattaagcattgatactgttttctgatgtgtgatcaagattccagatgtcacagttattctggtagtgtccttgatagctgtttaattttattctcagtccaggatccaataagaatcacacattacatgtattagtactatttctttaatatactttcctcccacctttttggttaaggcattttcttcaagagtccaacccagttgattgtaatatgtgccaccttgtggacttaatctcatgattttaggcaataatagtacgtaagtgacactgtgtatttcccattgcatcacatcgtaaggtttatggctttattgataatgctaattgataatggttaagatagcatccctcagattttttgcttagaaccttcttccctttccccattccatgtttgtgttttccttatcctgttcagcaaacctagttcccaacagcatcaactttatattcatttgctctatcctacaatacgcacaaaatagtttcaccaataacataaccaacaataaacctactaaataaagtttgatttatttgttgtttttgttccttataattattccattaagactgtattgtcataagagcatactgaaaaattatttgcattattttttctatgtgcttatgttacaatttgataccttctttgatttttcattcttgttatactcaacttcataatttgtttttcttctaatggaatttgaaattaaaattaaattttattatttgaaaatgcaaaattttaacatgtttcagaagtcaaatttgtatggaatgctatattcagagaactcttctattcctattcctctactcctttcccactcactctcatagaaaagcatttttcatttctagtttattctttctgtgtttctttttataaaattagcaaacacaaaattatatatacattctaatatatgtatatagtatagtatctatactaaaagaatatatatggttgagtgaggtggcttgcacctatagtcccaactactcagaagactgagctgggaggatctgttgaattcaggagttcgaggcaagaatatacacacacacacacacacacacacacacacacacacacacacacattctcttttatgtaataaaaaccataacattaactctaccatcttaaccatttttaaatgtaccaattagtatacgcatgttgttacatagtcaacctctagaaatttttcatcttgcaacactgaaactctgtacccattaaactcttaattctctgacttccctccctgacgtccttggcaaccaacattctacttatgtttctatgattttgactacttcagatacttcctatgaatggaatcatacaatatgtgtcttttttgtgacagaccttatataacttagcaagttcttgatgttcatctatgttgtagcatgtgacaggatttccttcttttgtttctttatcctttaattgttgatagatgtctgggttgcttgtacttcttggctatcatgaatattgctgcagtgaacatggacatgcaaatatatctttgagatcctgctttgaattcttttgactgtatacccagaagtgaggttgcttgattatatgttaatttaatttttaatatttctttcaggaacttccataccattttagtagtggctgtaccatgttacatttccaccaacactgcacaagggttcattcacttctccacattttgccagcattttttgttttctgtgttttcggtagtaaccatcctgatcagtgtgaagtgatatctcattgtggttttgatttccctgatgattactgatgttgaacatcttttcttgtgcttattggccatttatatatcatttttggagaaatgtctattcaagtcctttgcccattttaagatcatgttatttgtatttttattgttcatttagaagtttgttatatattctggatattaacctttcattggatatatggtttggaaataagttgccttttcactctgttgattgcctcctttgccatgcagaagttaagcttgatataatcacatttatctatttttgcttttgttgcctgtgcttttgttccatatttatgaaatcattgctaaatccaatgtcctgaagctgtcccccatatttgaaaataatatatattattaagttttattttttaaacaaagctttttacctttgagacttgatttttttttgaagttaacaaaatatcctggaaattactttgtatagaaggagtgttccacagagcttttcctttttttgtgttgttttgctgggatttttgaatggctgtgtggtattccattgtgtggatatatcataatttaatcgactgatcttctacaggtggacttctagtttatttccaacattttgccattacaaataacatctcaatacttatatatgtgttgttttatattgtggatgagtctgtagaagtgggattgctggtcattaagctgttactatgtctcattcttacagttctgtctttgttactttttcctctcctcatccttttacctctcaaatatgcatgtatttcttttctattccaaatatttgagaacagattttatcaaaatctattttgatatcttttgactttgtatgtagattatttgtaggttattttgctacctgtaagtctttgaaactaaacaggtgttacctatagaatcactatagaatattagaaccctcagggatttgagctaattataaaaggtaaaaagttcaaatctgtgaaacatatgcatcttacaagaaatccattaaagcttataataattacttcaatgaaaaaatgagatatttgtaactagaactgtaacactatttctgaatttttaaaagaatttttttagatatgagcatgttttagcttaatttatatatgaattactacaataagtatgacaatcatagtaacagccacagctaatatatgttgttgactatgtgctgggtaccatgctcagcaatgcaagtacattaatttacatcatttcaattagtcctcaacgaccttatgagatgtatttgtaattatatctccactttaaacatgagtgaaatgagaaatgttaagagatatgctctaacatgctctaactcatgcagctagtaagtggcagaagcaagatttgaacccagagagtcttcaatcaagatggattctgctctttttatgacaatgctagacttcttatattgggacccactattattttcctatatcaggccagcatttgtcttaaggtctgtatgattttagctgctgagtccttaacaactttatgtactttatttctctccccaaagcagtataagatattacatggttgttatattaagtttttttaatcgtaagtgatagcacagaattgaaatcccattcataacagctacagtttctcacaaagcattcttgtcacatcactatctgtggcagaatattaaactatgtgtaccatttttttgccccattaaattatttatgttcctgttttacagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtcagtgtaattccaagggaaccactatactaattggctattttaacactggtaaaatatgaattccaatgtgaatttggaattttgactttataattccttttaatgtttgataaatgcttattccttatatcagttttcctgtattgtttttaaatttacttttgttaaacatgcagttgaattcatgaggcataatggaataaaagtttgaggttatttagtccagtctctactttttataattagaatcagaaaaggctgatagcttgctcaatgccttgtagcttgctcaacaccttgtagctaatttgttgcaaaacttgaattagaaacaatgttcttttcaccatatcctgaggttggaatacgagagagagagacagagagacagagagagagtgtgtgtgtgtattttatgtatataaaatacaacattacattcaggctcgtaagacttagtcatctaaatggtcatctaaaccatttctggcaaatagtaattcattcatattgaataaactcagtcgtgggtagtataccactaacaaaacaaccaagtatatttctatacacccttacttattagaaaagtattcttaatatgaacttgaaatatctctctcaggcccctccatatattggttggttgttcttttgtacccacatggagatactccttcagtgtattcatgcactgctaacgttattaccatatcagcacaggcttttttcccctttgcaagggaaaaacaaaataactgccctagctattatattgttgggataatcaaagatgacctctttttaaatagtgattcactagaaattttgcattacttatagttggaaatatgtagtctgtcctcctccattccctatctcctttcttttcccatcttctcttcctttctttttttcccttttcatcctcctttattttcttccccctctccaccacgaccttgctccatttcttctatttacccactttattgctcactacttgaccttcagcagaggtatattaaggaatggactattctagagactggggatcaataagcacagtatttactaaataaccaaaatacaatattcaaaaattattagggtatgaaaggcattttcagatctttcctttaattttgttttttatatacaggagaactttatggttttaagattacagtaaacattgaaatatgggattcagggattttaaaaaaaaacaactaaaaatgttgaaatatgtttgtttagacctttgcccttagttttcccaagaccagccttaatctgtaggtgcaaagttttcccattagtgagaagtaggtcagattttcttctgatatcacttaggctacagtaaaattactaaattgttttagtatgctaaattgctgtcctaaagaacagttatggttgggtgcagtggctcacgcctgtaatcccagcactttgggaggccgagtcaggtggatcacctgaggtcaggagttcgagaccagcctggccaacatggtgaaactccgtctctactaaaaatgtaaaaattagccaggtgtgcacctgtaatcccagctactcgggagacgaaagtaggagaattgcttgaacctaggaggtggaggttgcagtgagccgagattgtgctattgcgctccagcctgggcaacagagcaagattctgtctcaaaaccaaagagagagagagaacagttatgataatattagatcttctggatgtcaaaaacttaacttttatactaattttatggttatagtgatattgttgagatgatatgggactcaaaaattggggagaaatcttcagtatctaaatcattatctaaattctggaagctaatacagttggatcaattgttttggataggtccagtaacctttgctgccactatcaaaaactcagaaattggccgggtgtggtggtcacaccttgtaatcctaacactttaggagaccgaagtaggctgatcactcgagctcaggagtttaaggccagcctggccaacatggcgaaactccatctctacaaaaaatacaaaaattagctggggatggtggcatgtacctgtggtccccgctgcttgggaggctgaggtggaaggattgcttgagcccaggaggttgaggctgcagtggactggggtcgtgctgcccactgcacttcagtctgggcaaaagagtgagcccctgtctaaaaaacaaaaaacaaaacaaaaaatttcagaaattgaagtgtttgggtaatgcagtatctttcttgatccaggttcttcctcttcaaagtcagaatcaaatacgttgggataataagaatactcatatttttctggtcgggcatggcagctcatgcctgtaatcccagcactttgggaggccgaggcgggtggatcatttgaggccaggagtttgagaccagcctggccaacatggtgaaactccacctctactaaaaatacaaaaaaattagccgagcatcatggcgggcacttgtaatcccagctacttgggagactgaggcaaggaaattgcttgaacccggaggcggaggttgcagtgagccaagacggagccattgctcttctctagcctgggcaacaagaacgaaacttcatctggaaaaaaaaaaaaaagaatacttttatttttcttttggagaaactgtagtttcccatcaaaaagtagttttattatcagaatagagtttagtatctggtaccagaaatgtttgcttttatttggtagccattttgtcaaaattttcctaaagtcataattactaaaatatttttataaattaggtctaaattttcttaagtttgtaatatagttattttgtatatgaatatgttgatgcatattactctttctttccttcatttacttgaacataaacagatgtatcctttagtagtaaattggcagatggatgagtggaaatacgttttggaagagaattgaggtttttttttttaacagtgtaatcgaacatattaccaaagtctgaaatgataagattttttttgtaagctataactgttacaatttaattagaaaaagagaaaaattggcaagtaattttttaaattctggagcagtatgaggaaggaaagtatttttatttataatgtaaataattattgtatttatttttaattaaacaagccaagtgacacttgtagcaggattttatttatttatttatttattttttagagatgtggttttgccttgttgcctaggctggagtgcagtggcatgatcatagctcattgcagcctcaaactcctgggctcaagcaatcctcccacctcagcttcctgagtccctaggactataagtgtgcaccactacccccagctaatttttaaaattattttgtagagatgggatctggctgtgttgcccaggctgacctcaaactcctggcatcaagcaatcctcccaccttggcctctgaaagagctgggatttcagctttgagctactgcacccaacctgcagcaagattttaaatgcagtatcctgcttagatattccatttctaaaattggaccagtcaggggacttttcaactatagaaaacaattctaattgatttcagcccttagaatgtaatggtttacaaattaattcctcttagcgaatatggtctacatttataagtgtcttttacgaaattaattccatatttggcttttaaaggcttcgattaaatagacaattatagtatgttgatatttatttttataaagatatttttctacttaaaaaatgtttttagttgcatagatttctttttatataatgagttagccttatttcttaactgcattttgaactattaaggtgtaaaaagtaggtcctattttactatcaaaaggcaacttaaatgccaatttctttctcaaaataccaggtgttgtttagaacaaaaattatcatagatgcctcagaaagttctcaaaacaaaattattatttatatttatttaaaaatcaataacattagttttgaagaattaattaaaatgtaaattttaaactttgcaaaaaatattggtaattatctattgaaacatatgctaagtttgactataatattacttgcttattctttggttgttttaggtccctcatagctaatcttgctgctgccaattgttataaaaaggaaaaacatcttgatctggagaaaaactggatgttggtagaaaaagcaagagtttgttatatagcagtaagtacttacctaattcaaatctctagtacatatttacatgatggattatagttgttgtctgatatatattttaaaataattatcttttatttaccctgcaaattatttatctctctcaaagcatatgttagattcactattgtgaaaatagaacagaaatcattatctttctatgggtaacataatttgtattatttatcttcaggtctacctatttttggatacattatgcataggtgcttgccaaccaagcgcagaattctatattaaatcagtttccaaatatattttaaaataattctacaaacttacatcttacatttgtaggcaacttgcattgtgcagaaaaatattagtagtataaatattcactgcaaatagtttgagctgaattgcttaaaaaacttaattgctatttattccatagtaattaccatgacacctcttaatttaatatttcagaaacattgatcgtgacaaatctcttaaatctgggaacaagggcagggtgtaatttgaattattaagtcttctgacacaaaaataattggttaagaatttatttctaaaataggatggtactaaaaattctgaattaatcaccccatgattaccttgtttttatttaatatgtgttaaatgtggctttacacaaataagtagatacctatgaaaaaagcatctcgtatgcatgtaatatatggttttggtataacagctgctgccatttcattacctgagctctgtgaaatagctggtaagatgtgtaaaaaattgattaccctactaggaggaacatgtttattgaaaatataattatttctttcagtctaatgttaatgtctcctacagcatgtttgtgtgcactgttctaggctttacaacattgttattgattcctctgtataccaaatcctatccctttataactgtcaaataaatgcttacattgagaagattatataatggaaagttatgctatcttttctgccagtatgtgagaaaaacatttcaagaattaaatattttacccctttattatttccatttcattttatttctcaaattggtctcatgttctttccatttttcaaatcttgatactgtatttcttgtagtgtgattctttagaggggatttatgtactatttcaaaccatcttacacttgaaagtctgattttcaaaaagcaccatgtttagaatttggcataatttatatatacttgttgactatgaaataagacagtgtattctgatgaaaaagtatatttaacttgacaattacagtcttctatgtttcaatatatagttgttcaatcctgaattgtgagccaacttgcaaacaactcatagttgtaatgattatacagtataacatgtctagccaactttgggtgaatggaacttttatgaaagtgtagattcaacttgcagacaactcatagttttagcatttatgcactatattgtatctagccatatttgggtgaatggagttttacagtagtattaaatatttatacttacgtgcaattttgtacagcataaagtgatcagcttttggtgaaattaataaggcaaatgatattatttttgagatttgggtggtgtattcagccagaagaaataacaaaatggatttcagttgttatctgtgatacaagtgttagcttgtagcttctgtttcagcagtttcataaaaagaatgatctcttacattgccaggtaaatctgtactcttctcctagcttggcttattccaaaatagttctgaaaatagtagactcatattggatacctgggacgctgtatattcttagtgaacattcaacaaatatttacttggtgaataactaagagcataattcgtatttattgaaatctgtaaacttccttttgaaatacaatgttatttccacaaagacactgcaggttttgcaaatctgtaattccctttgatttcagagcattccgaaatgatgtgtagtctagtctagttttttcttagcatatggtcaaaccataaattaagtgggctgccccatactttctggttctatgaggtcaacagtctcattacattatcatcataaactaatgaggtttaagaaattaaagttctgggggctctttaattctaaaatgtttttgatctaaggaagcaacgcagtttatctattcaacaaatatccgtaactaaaacatctgtctgcatcacataagctaaaccagatctacatactcagctctgcttcttcacactattctccaaactagcagtgtttcatgaatattaagaaaattccaaaccttcttcttcattttcttcaccatataatttactgagtaagttcacactggaaaccttcctgactgaaaagctaaaattgaatatggatacaccagcatcctcttttggtttaaatacagtgccaagatcttttaaaatttattttttacctttcataataaatgtctcattttatgccacgtaaactcagtttttccatgtttaaaccagcttctcagattctttgttagcaggtaattagggactactggctatggtgactaggtaattatgtttttgaaaacataagtctcaggttctcttcaccttagaatcagattgggatatatctgttttttctcacttaagaaataatatttcctggcatagtggtttatgcctgtagtcccagtgctttgggaggccaaagccagtggattgcttttggtcaggagatcgagtccagcttgggcaacaagtaggtctctaaggacttgctttatgaatctgggtgctcctgtattgggtgctttatgaatctgggtgctcctgtattgggtgcatatatatttaggatagttagctcttcttgttgcattgatccctttaccattatgtaatggccttctttatctcttttgatctttgttggtttaaagtctgttttatcagagactaggattgcaacccctgctttttttttttgttttccatttgcttggtagatcttcctccatccctttattttgagcctatgtgtgtctctgcatgtgagatgggtctcctgaatacagtacactgatggatcttgactctatccaatttgccagtctgtgtcttttaattggggcgtttagcccatttacatttaaggttaatattgttatgtgtgaagttgatcctgtcattatgatgttagctggttattttgctcgttagttgatgcagtttcttcctagccttgatggtctttacaatgtagcatgtttttgcagtggctggtacccgttgttctttccatgtttagtgcttccttcaggagctcttgtaaggcaggcctggtggtgacaaaatctctcagcatttgcttgtctgtaaaggattttatttctccttcacttatgaagcttagtttggctcgatatgaatttctgggttgaaaattctattctttaagaatgttgaatattggcccccactctcttttggcttgtagagtgtctgcagagagatctgctgttattctgatgggcttccctttgtgagtaacccaacctttctctctggctgcccttaacattttttccttcatttcaactttggtgaatctgacaattatgtgtcttggtgttgctcttctcgaggagtatctttgtggtgttctctgtatttcccaaatttgaatgttggcctgccttgctaggttggggacattctcctgaataatatcctgcagagtgttttccaacttggttccattctccctgtcactttcagatataccaatcagatgtagatttggtcttttcacatagtcccatatttcttggaggctttgtgcgtttctttttactctttttttttctctaaactactcttcttgcttcatttcattcatttgatcttcaatcactgataccctttcttccacttgatcgaatcagctactgaagcttgtgcatgtgtcacgtagttctcgtgccatggttttcagctccatcaggtcatttaaggtcttatccatgctgtttattctagttagcctgtcgtctaatcttttttgaaggtttttagcttcttttagatgggttcgaacatcctcctttagctcggagaagtttgttattacctatcttttgaagccttcttctctcaactcgtcaaagtcattctccatccagctgtgttctattgctggcgaggagctgtgttcctttggaggagaagagacgctctgatttttagaattgtcagcttttctcctctggtttctccccatctttgtggttttatctactttggtctttgatgatggtgacctacagatagggttttggtgtggatgtcctttctgtttgttacttttccttctaatagtcaggatcctcagctgcaggtctgttggagtttgctggaggtccactccagaccctgtttgcctggctatcaccagcagaggctgccaaatattgcagaacagcaaatgttgctgcctgatccgtcctctggaagctttgtctcagaggggcgcccagttgtatgaggtgtctgttggcccctactgggaggtatctcccagttaggttactcagggatcagggacccacttgaggaggcagtctgtccattctcagatctcaaactttgtgctgggagaaccactactctctccaaagctgtcagacagggacatttaaatctatagaagtttctattgccttttattcagctatgccctgcccccagagatggagtctacagaggcaggcaggcctccttgagctgctgtgggctctacctagttcgagcttcctggccgctttgtttacctactcaagcctcagcaatggcgggcacccctcccccagcctcactgcttccctgcagttgatctgatagcggactgctgtgctagcagtgagcaaggttccatgggcatgggaccctccgagccatgcgtgggatataatctcctggtgtgccgtttgctaaggccattggaaaagcgcagtattagggtgagagtgtcctgattttccaggtaccgtctgtcatggcttcccttggctaggaaatggaattccccaaccccttgcgcttcccaggtgaagcgatgccccgccctgctttggctcacactctgtgggctgcatccactgtccgacaagccccagtgagatgaacctggtacctcagttggaaatgcagaaatcacccgtcttctgcatcactcacgctgggagctgtagaatggagctgttcctattcctttttttgttttgttttgttttgttttgagatggagtcttgctgtgtcatccaggctggagtgcagtggcacaatctctgcccactgcaacctccgcctcctgggttcacaccattctccttgccttagcctcccaagtagctgggactgcacgtgcctgccaccatgcccggctaattttttgtatttttagtagagacggggtttcaccatgttagccaggatggtctcgatctcctgacctcatgatccacacgctttggcctcccaaagttctgggattacaggcatgagccaccacacccagcctaattgttttttttttttttaatcagctttgttaatatatgtctcacaacttacaatacatacattttacttctacatatatattataaacatcgtaaccttgctgctatttttgtttaaattgtcaaatatatattttaaaagacttaataagaaaaaattcatatttttactcaggtatttatcatttctagttctctttattccttttggttagaattagatttccatctggtatcattttccttctgcctagagggcattctttaacatctcttgtatttggatctgtcagtaataaattctttcagcttttgtatgtttgaaaacatctttatttcaccttcatttttgaaagacatttgtgccagatatatagttctagtttgacagtttttcagtacatgaaaaatgttaccccattgccatcttacttgcatagttcttgataagaaatctgacattcttttgttcttcaatgtttcacaacccccattccccaaattttgctgcttttaagatttttcatatgagaccaggtgcggtggctcacacctgtaatcccagtgctttgggaggtcaagatgggaggatggcttttgaggcatggagatcaagattagcctaggcaacatagtgagaccccatccttacaaaaaatacacacagagaaaattactcattttgatcagtttagttatgatgggccttagtgtattcttcttcatgtttcttgtgcttgggttttgtttaacttcttagagctatcggtttttagtttttattatgtttggaatatttgcagccattatacatcttcaaattggttttctgacccttttatgccacttgaagttgtctcatagctcactgacactctttttttattttgtttctttctctatgttttattttggatacctcctttgctgtgccttccatttcactaatattttcttctgtaatacctgaactgttattaatctcatcaaataaataaagctaaatatttcttactactgggggaagacttttcttagtactccatggcacagagcactaaggggtccctaatctctggtactgcaactatatcagttcctgttaggaaccaggccacacagcaggaggtgagtagcaggccaccaagcattaccacctgagctccacctcctgtcacatcagcggaggattctttttttttttttttcaaatgtgaaaaatctaattttattcagtttagattaatgtatagctatacactctggactcttaatgaaacctttcccattctttttttttagattttattattatactttaagttttagggtacacgtgcacaacatgcaggtttgttacatatgtatacatgtgccatgttggtgtgctgcacccagcagaggattcttataggggtgcaaatcctattttgaactgcacaagcgagggatctaggttgtatacgtcttatgagaatctaactaatgcctgatgatctgaggtgcaacagtttcatcctgaaaccacgcctcctacccgtccgtggaaaaattgtcttccacaaaactagtccctggtgccaaaaacgttggagactttgatgaaaaaaatgatgagtttttctgctctaggtctttgaaacagccactatttccaaatgtgtatgtgcctcaggtactgttccttctatttttttttcctcttaatacttttggatgtttctttcccaggtactgaccttaagaaaagaccctctacagaattccaggtttctctgtaaatctttctgttctctgatattgtggtctttcaactcttaactgctctgaaattcccagactctcagttgtatttcctcaactcactggcatctactacagttctccttataccatattctggaaactcttgcaataaactgctgtagtcatatggctgacctccattgtttcccatctctcagagatacgtattttttattcttgatgtccagtgtattaaaaaccattgtttctagttttgctattgttgtttcatgatagggagtaaatctagtttctgttcctctactgtcttctgctttgcattgtttttgaaaggaagcctgctgccattcctatcattgttccctcttacctaatatgtcttttaacctcctttatctgcttttaagatgtttatcactgattttaaacaattttattatgatgtaccttggcatagttttatattttgtgtggttggggttttttatagtttcattcactttggaaattatttaacaataagttttctctttccacctccatctacctttgggactccgattaaaataataataataataataataagaagaagaagaagaagaagaagaagaagaagaagaagaagccacttgtagttgacccatgtctcagtgattctgttttcaatatttttgtttttctatctgttcttcattttgaataattactctctcccctattttgtcttttcttttttatttttatttttattttttgagatggagtcttgctctgtcacccaggctggagtgcagtggtgcaatcttggctcactgcaacccccgcctcctgggttcaagtgattctcctgcctcagcctcctgagtagctgggactacaggcacgcctcaccacacccggctaatttttgtatttttagtagaggtgggttttcaccatattgtttcggctggtcctgaactcctgacctcatgatctgcttgcctcggcctcccaaagtgctgggattacaggcgtgggccactgtgcctggcctctttcttttttttttttttttcagacaagttctcgttccgtcgcccaagctggagtgcagtggcacaatattgggtcaatgcaacccccacctcagcctcccaagtaactggaactgcaggagtgcaccaccatgcctggctagtttttgtattttctctagagacaggttttgctgtgttgctcaggctggtctcaaactcctgaactcaacttatctgcctgtctcgacctcccaaattgctgggattgcaggcatgagccgccatgtccagcattgaataatttctattactctgaagtttactaattatttcatctacaatgtttaatctgccattaatctcatccagttgacattttatctctgacattatagttttcatctcttgaactttgatttggacctcttttactcatgccatatctctacatagtatgcttatgttgtcatgtgctttcggaatgttgttataacaattgttttaatattcatgtctactaattctgtcacttttttttaatctgattaccttggtattggtttttcctgattacctgggtattcattgtttcctcatacatgtgtactgaagactccaaaggaatcccttgcatatctcgagttctcactttccacctctttcttctccaagcagctctgtcctctccagtactctgccccagcatgtggtagccagcttggcctccctgaatggaaactacttgactctatttaggttcttccttcccgctctgcagcctgggaactctattcaaggtgtaagtttgagtaattgtagcgcttaccttattctgccccttctttgattattatccaatgcctgaaaattgtgttttcatgtattttgttcattgttagttgtttaagatgggaatataaatctgctccctggtccttcatagtggctggaagtgcaaatctctaggttgattttggtttttccctttttcaggtaactcgctttttttttcaagaatgcctaatttttttatttgaatttgagtctcagtctgttgcccaggctggagtgcagtgacacaatctcggctcactgcaacctccatctcctgggtttgaacgattctcctgcgtcagtctacccagtagctgggattataggcacctaccaccatgcctggctgagttttgtattttttttttttttttttagttgagatgaggtttcaccattttggctaggctggtcttgaactcctgacctcaagtgatccacccgccttggactcccaatgtgctggtattacaggcatgagccactgcccccagcctgaatttgaatttgataataactatgatttatctctatgcgaattctgtattgagttttcctcgaacaatgtattcattttaaactgtagatttcattcccagttaactttcttgtccccaaatattgtttctcctttacttgacctattggagtgtcagaaaatgatcataaccatcactgataaatgtgttatggggaatattagagtaaaagcagaaattccaagttgtggtgagaaagtacagtagaaccttgaacaatgtgagggttctgggcactgaccccttcgaaaatccacatacaatgtttacctcctcaaaaacttaactactaatagtagttaattggaagccttactgataacgtaaatagttgattaacacgtattttgtatatgtattatattctgtattcttacaataaattaagctaaagaaaaaatgctataatatcatatggaatgaaaatatattattattcattaagtggaaatggatcatcataaaggtctttatcttagtcatcttcatgttgagtgggctgaggaggggaagaagaggaggagtggttggccttcatgtctcagaggttggcagaggcagaagaaaatctatgtataggttgacctgcacagttcaaattcatattgttatagtatcagttgtaatcttaaattcatcttcaggttgatttagtgtcaaaattccctcaaatattattctagattctataaaatgttctagataccattttatcgcttaaaaataaatgtgaaagctctcagctaagatatagttgttcatctatgtgtaattactagttttgtaattttttgtaatttcttagtcacctctgcatagtgtttggattacattgtgagtacagtaggattttgtttagaaatctatgcgttatttcaaataacatctctttatgataggaaaaaaggttccaagtttgaaataacactgtgaagaactaatcaccatgcaagtttaggcttattatggggaaatttttaaactttaggtattaaaaagatttttaagaaatagattttaacaaactttcagtaccttgtgacttaccctgcgtaaacaaggtcagccaaatttgtaccctgtttcatggattagaaattaaacactataagtgaaagaataataagtcatatcttgtcaataattttgtgagagtatgagacttgtggtgagttttcctttagcactcatgcctattttcttttttaaattattttttcagttcctatgtcttattacaggtcttctcttttcctctcttcatttatttataactctgtcttgaccacttatatctgttttcggtctagaattttactactttggagaatgtggtttttgtgagggtagagttttcaaatgtcactaatgtttgcttctggaataagggaagtatgattataggtcagtagaagaaacatggtatgaagaaatgtacagccttggtggtaagcaatagaattcatacttacaaagaaacagaagtatatgtatattaaaggcaagtaagaatcactaccaaatgtttacattttacatctcctgctttgtttgccctataggtttttcatacctatgccatgagtaacaatttttcttagtaaaactttcatttatactcagttacaattaaatatctttatcagtaatctaaaagcaataaagcccttaaaatgaggtagtgtgataaattataagaaatctcatctaagaaatcatatgtttgaaattttacgtgtcagtaatgtggtttgtgtccattgaattaacaagttagaatgaatttataattaaataaataatttctatttttttaggatttggttatcttttggcagtatttaccaaaagacatggttacactaaaacgtgactagaaatttaaaaagattgctcaaaatttcatgctcagaatttagaacgtgccatctagtattctttgctctgtcatgaaaagatttgagaaagtttcagtgaaagtgaattaagttgttttgtaatggtaacctaatggaaattgaagtaatttttttttaaaaaaggtaagtattatttaggccaggcacagtggctcaagcctgaaattccagcccttcgggaggctgaagtgggtggatcacctaagatcaagagtttgagaccagcctggccaaaatttttggtagagaccagaccatctctactaaaaatacaaaaattagccaatcatggtggtgcattccttagtcccagctgctggggaggctgaggtaggagaatcgctcaaacccaggaggcagaggttgcggtgagccaagatcgcgccactacactccagcctggctgacagagtgagactctgtctgaaaacaaacaaacaaacaaacaaaaacttacttaaagtgatagctttaaaccttattcgaccatggaacaagcctttgtaacataatctatactgttacaataagtacactttggcagagtaagtgaactaatgatttttttttataatttaagctagtctgtgaatgacagttgattaaataatgtcacagctctttatatatagcattaaatagagttcaaagtatttttggaatttattaatttataatattcttctgtgattattaaagaggtgggatagctaaactttttctcaccttttatcattgttccaagtgcagttttgaactcgtatgtgttagaactcccattatattggtcaaatcgatgatcaccatatgactttattcctgcatttttgcctcaaatttttaactatcctattctggactgcttcattaacttcattagggattaactatgaatgtttaagcctttattttacaatgtccttgcaggtgtccttaactgtttcatttataaacacagagaataaaatgaaaaaaaaatctgtagagttgtttgttctatttggagcttttcatgttggtgtaaaattcctgacacttaacacatatgaatctttttcattcatgtttaataattttatttgagagtcacttcaagtaaagcccaaactgtgttaacatttgagttaagcaaagacatctttgcttaacaataaagcaaatatcacaataaagcaagtcacatgaatattttggtttctgaattcatataaaagttatgtttacactatatggtactctcaagtgtgtggtagcattacatctttaaaaataaacatactttaattaaaaatactttgttgctaaaaaatgctagtgatcatctgagcctttagcgagtaataatctttttgctgttggagggtcttgcaccagtgttgatggctgctgactgctcagagtggtggcttctgaaggttggggtagctgtgacgatttcttaaaataagacagcaatgaagtttgccacatcaattgactcttctttcataaaagatttctctgtagcatacaatgttgtttgatagcatttacctacagtagaacttctttgaaattggagtcagccctctctaactctgttgttgctttaacagttatgtttatgcagtattctgaatttttcgttgtcatttcaacagcattcatagcgtgttcaccaggagtagattccatgtcaagaaaccactctctgtgttcatctataagaagcaatttctcatccattcaagttttatcatgtgattgcagcaattcagtcctatcttcaggcttcacttctaatactagttctcttgctatttccatcacatgtgcattgacttcttccactgaagtcttgaagccctcaaagtcatccatgagggttggaatccacttattccaaactcctattaatgttaatattttgaccacctcacatgaatcgtgaatgttcttttttttttaaacagggttttactcctgtcactcaggcagggaagtgcagtaacaatcactgcacattgcagtctcaatctcccaggcaagctcaagcaatcctcccacctcatcatttattttatttttgtagagacgaggtctcaccatattggccaggctggtctcgaactgctgggcttaagtgatcctcccactgcggcctcccaaagcgctgggattgcaggtgtgagccaccatgcccagcccatgaatgttcttaatgacaactggaatgatgaattattttcaggaggttttcaatttactctgcccaaacccatcagatgagtcactatggcagctatagccttatgaaatatattacttaaataagatttgaaagtcaaaattactcattgatccatgggctgcagaatgaatgttgttttagcagccgtgaaaacaacattcatcttcttatacgtctccatcagagcccttgggttaccagatgcattgttaatgagcagtaatattttaaagggaatctttttttctgagcagtagatctcaacagtgggcttaaaatattcagtataccagctgggcacagtggcttatgcctgtaatcccagcactttaggaggccaaggcgggaggatcacctgaggtcaggaattcgagaccagcctggtcgacatggtgaaaccacatctctactaataatacaaaaatgagctgggcatggtggtgcacacctgtaatcccagctactcaggaggctgaagcaggagaattgcttgaaccctggaggcggaggttgcggtgagccaagattgcgccattgcactccagcctgggtgacaagagtgaaactgtccccaaaaaaaaaaaaattcagcataccatactcaaacaggtatgtgttcatccaggctttgttatttcatttatagaacacaggcagagcagatttaacataactcttaagggctctaggatttttagaatggtaaatgagcattgacttcaactgaaagtcaccagctgcattagcccctaaaaaaaaaagagtcgtcctatcctttgaagcttcgaagccaagcatttacttctttttagctgtaaaagtcttcaatagcatcttctgccagtagaagactcttttgtctatgttgaaaacctgttgttcagtgcagccaccttcatcaatgatgttggcaagatctgggtaactcttcagcacctgctattttaccttgcacttttatgatatggagattgcttctttctttcaacctcacaaattagcctctcttagcttcagacttttcttgcacagcatcctcacctctcagctttaacagaattgaaaagagttaaggttgtgctcgggattaagctttgacctaagagaatgctatgctggtttgatgttctatacagaccagtaaaactttctccatgtcagcaataagcttatttcactctcttattcatgcgttcactggagtagcacttttaattttcttcaagaactttttctttgcattgagaacttgcctgtttgttgtgagaggtcaaactttcagcctgtctcacctttcgatatgccttcctcactaaactcaatcatttctagcttttgacttaaagtgagagacatgcaactcctcctttcacttgaacacttagagaccactgtaggattattaattggcctaatgtcactattgttgtgtctcaagaaatagggaggccttaggagaggtagagagatggggtaatggccagctggtagagcagtgaaaacacagcatttatcagttaagttcaccatcttctatgggtgtggtttgtggcatcccaaaacaattacaataataatatcatagatcagtgatcactataaaagatataaaagtttgaaatattgaaagaattaccaaaatatgacagagatccaagcgagcacattctgttggaaaataatgacaccatactcaaggcaggcttgccataaaccttcgatttgtaaaaaaaaataataaaaaggtatctgtgaagtgcaataaaataaggtatgcttataccaaaacagacttaattatgctatttcttaccattagtgttagagttcagtttctaatgtttttcattttccatatgttattgatgttcagtgagttacacaaattatttactgttgttacttccaccttagtagggagaatctttgatttttgctggataaattttcaaacaagagtgtgattataggctggacgtggtggctcacgcctgtaatcccagcattttgggaggccgaggtgggcagatcacttgaggtcaggagttggagaccagcctggccaacatggtgaaaccccctctctactaaaaatacaaaaattagccgggcgtggtggcgcatgcctgtaatcccagcacttgagaagctgaggcaggagaatggcttgaacctgggaggcagaggttgcactcctgcctaggtgacagagtgagactccatctcaaaaaaaaagaaaagaaagaaaagtgtgattacagagatcctatttgtgtttatttttaatttctctagaatttgttttcttcaataaataaaattctaataccagttttttttgagtaacactgtgatttttatacagaaagactttctccaaattggagaatgtactcttttattcctgtaatttttcttaactcttatttttggcagctaccaaaagtaaaactctctaccaagacagagaagaaatctttgggaatattaagtaatgttatttttcattacacggactaacctttttactaagaagaattgggatagtattggttatgggagcttaggagccctaaagataaagattggaagattttgtgttgtggacttgtggcactgtaacaaagtctgggaattttatgtgagattggaaaccacactatgtgctaattgcctcagaatggtaagaaaataagcatatgtatagcatttagttgttaagacagtaggcacttatgcagagccccaaatgaattaacaaatcatctactgaaatattttcacttctgtttactttatgtattttagaccaatcagcagttgcttgagaaaatgaaatgtttactaaatctctttaataaacatgtttaagagaggaaaaacttataaacattcagatggcagtgtacatttttaagtgctagttgtcatatctttgaaattgtatgtaaactggacataaacaatcaagtgtctacagaatggtatctgtcttccaatatatttactgaagatattatagaatctttatagtttaatatgatttaccccacatgttctgttgttgctatcttttcagataaagttgaatttaatctttcttatcagcttttattgaggtatttatgaaccattgagttcacccacttaaaaaatatcattcagtggctgttagtgtatttacagagttctgctaccatcactgtaatctaatgttagaacattcacatcaccacagaaggaaatgttatacccatcagtagtaatgctccataccccctggatttaatcttatatccacatctctcataatagtttcagtggtatctagttattatgactacaaatgatgcaattgttcctgattacacaaataatgtatttatgtctttattgttggcatgtaatggaagacataataagtctgctttgatctcttgctcttacctatttctctattgcaagtgttataaagagtcttttaagcttttgctcatatatataaatatatatatacatacatttatatatacacacacatacatatatacacacacacacacacacacacacacacacacatatatgtaatgctaccgtgtttgagggtcatgagggtcagttttttgaaataccagtttttttctgatttaggtggatgacatggtacgtgaagcttaaaaaaaaatttggtaaattggtatgaaaaaatgagaggacaacgtttttcctttctggtacttagcaggaaggcaagttcttgtatgaacccatatttcctgttacccattttcagaccaatattggtttctcatctatataatagggatcttttgactctaacctcttaaatctatcatgtgttttctttcttcaccttggaaatagcttcttgaagccccagacttctagagcacattcatattaactaacattgtcctggtttactagttagggatattagtaaatcctaaatagttgaagacgttctgaaagatatattgctgctttttaaaaatttatttatcttgttctctatacggatttctggcacaaggttggtttttgtttttgtttttgtttctgttttttttttgtcaattgtggtaagtccatggatgcttttctctataactttcccattttcccttatcacaccgtcactgcaaacatctaatttctgtccagtctctcaactcttttcagctctgctgtcctaactaatcattttttgtattcatctttcaaagtatttgtttctgtcttcattctataagtaacaagattatttaaggttattttgtattacagaaatagtaaaaatcaaataaaatatcaaatgtagaatagtccaccaaaaatattttatttcatcttttccagagaggtacacatataataaagtaaatgagcattatatattttattattaatcctcaataatatatttttcacaggtatgttgcttcttgtaagtttaccttttttaatgtgaaaactacaataaactaaattaaattttaaaaatattttacttactaaagtcaactgatgttttcctggtagattgataggcttcttgtggtagcttttaatcatttgcaagttttgagcccatttctaaaacttttctcattgtaaatatgtatttcctttcttatattaactgagaatttgtttttataaaaataaagtggggaatcagactcaaggtgaaatgttgtagacttagtgccagcaataagcagaattatttaaaatcattcaaatatctttaattcccttgttgtctttttcaaaaactgtacattttaactacattaatataacggaagactttttaaggcttagttttcctttatagatattccctaatttcatttttatttcagtctgtcagggttgtgaatgtgatgttttaaggtacactgtagtgttttcacatcctcagatgaactgaattgggacaatactttgtaggaagttttttaatatagtatgtagacacattggtaaaaatcagtatgtccactggcttattagtttcacagatgcttccataattcttagtgtactcttgggtattttaaattatcatttcctgacagcaatcctgaaacatgccagtcttttaaagccttatttctgagaactaaagcaaggcatcagcgaaccatatctgacatgccatgttaatttccataactatcatttctgggaggtggtaggatttctaaggcatggagaatctcagtaaatctactttaaaaaaaaaaaaagcaaaatatctgttttattactgggtttccattcacgagccctgactgcttcattcccacttaaataatttcaaaaatagtgataagcatattttttctcttatagattattaaatatttactcacgtgcacaatatatcaaaacatattttgaattctatattcttagtgttgggtgttcatgttgtgaatgaaaacctcattctgttatctcatagcatatttatatatacaaataatttttgccttaagtaggaaagaaacagctaaaagatacataggttattttgctttttaaaattttagcaaactattctgtgaatcttttgtgtgtttggggctgtttgtagaggaaaatttcatcaagcaacattttgggaacattggccttttgtactctttcctaaataaacagaaacttgtactccccaaaataaaatgtttctttgtatattgttacctgcaagttattgataatggaaggaacaccttttcaatccttagtcccctttcccccaacacagcttttagattgtcgataaacttcccagctcagtaattaactgagctcagtcattgcaccctgtatcatgtgatttttttttccagtggaatacattattagagcacttacacagccagtctagctgcagcagcccaggcggcaacagcagtgccatttttcacaaagaaaatgttgaacaggagccaaatgtttggtggcagtctgttgctaggaaatcaaggtcctgaggcgattaatgacaaagcaagcaataacaagaaggcagaattacagatttaaaagagaaaaaagtggttggtgttataattacccaaagaaatccgcactcattaaattggctgtttttatgattgactttaattggaggttagctcagatatttagctcctttcccacccctttaaacacacacaggcacataatctgtagaactgcagacttgtttttctaagcattgagaggagcttgccctgtaatttgatccccactgacagatgcattttctatgctgccattttgaattaacctattgtagaacaattttcttcagccctgttgaataaaacatccagtctgattacctccgatggatttgatagagtaaaagaatgtacttctcattgaagtagattgtttgcatggactctactgattgtgaactctgccagtaagcacaatcatttgtaataaattttcaaagaaatttgtgaggaaaaggtaatgagagtcacccttttatagtttaatgtttggcacctccatcaaaataatataattcttataagacagtgttatttttccagtaagcttttcacgtggttttagaaaaaatttctgaatcttcatttggactattcatatatttaggaatagagtcttgtatttacactctaaaatgaccattcttcctccccaacaacagtattttagtgcaagactcaatatgcaaagcactctattgcaaaaatatttttggtatgtacaatatttaaagtgattttaagattggcctatttcagtctttgaagtatttcccccccccaaaaatcccttatttaaattttttagggtgtgataaagcatattactagaaaagcatcaatcggtctttcaggtacaataccagaggaaccatcacagtttatttacctttcagaagctttaaaaataaagttacatgatgcctctgctctccagatttctaatcaaaccctggaacaaaagagccaagcacattctatctgacaatgcacacactgctaatcagatgccaatgccaagctgtctgctttgttaaatacttagcttcctagaggcaggaagacagctgctataagtatgatgaaattttgtagttcaatctatttttgctacccttgggctaccaagatactgttaatttagaccaccccaattggtacattttagggagttttttaaagagtttgtaattaaaatgataaaacatcgttattacattgaagaccttctgtaagttttacatttggcagatacctactgagataaccccagcatgtaatttacaatgatgtaatggttgtaattgcattttagaaaaaaagaactataggaggcaagtgcttccattagaagagtttttaaatctgcttctgtttcatttaaatctacttctatccccaaattacttacttataattgactagagcagctataaaccttaagatgctatctgaatatttttaaaaagttatcaccccagacactgccaccagggggaggaagctaaaatcttaaagttcttaactgatgatgatactgccagtaggtagattatattgcttagccctacatagttaactacttcctccagataataccgccttttgggacatgattctcacaacctgtaatatgtgatacctgtagacttagcacactattaattgtaaataaaatggaaactttcgtactctggtggttggggtcaggaaggggaaagaggaagtacaaataagcaacctggacatttttattgtttttctcttatctgttagtctacttgaagagctatccttgaaagtgagtgctttagatctatgaaactgggcagctatcatagcacatctattaagatctaataatcacataattaatgtagcaaaatgaatagactgtaaggtagttttctattttttgttactacactgtggttttgtttttaataaatagttttggctttattttaaacaattaaaaattcaaaatatttttatgaccaaagcttgtaggttctatccctggaaaatattttataaatgcagaaaatagttgcttaggattggaatccaactctgtttaccatgaacaacttaaaagttgatctcataatcttgcatgttgtggaataataccacgaaaaagttaattaaagaatttagatgtttgttctcctgtctagaactcaataacttttaagtagtaactctccctacagtttaactgttaaacagtaactcttctgacagttttaggttttattctgtgaagactcatgatttttaatttttgcatcttaatttttcagttatttcaggtattgaaattacaaacgacgggaaagaaaagtggttgactaaaaaggggatacaaaaggcaatttttagggcgatgtactgttctgtatggtactgtggtggtggatacatgatactatgcatttgttaaagcccaaagaactgtacatcacaaagggttaattttaatgtatgcaggttttttaaatgttagggatttcaggatagaatgcaagctgtaacaaatgaatctaattgtattacaaatgtatggcataacttcactgaatgggtgggggaaaaggagctgacctaagtaactttggaaaatggtgttttgattggacaatgtaaagctaaagactaaggaacactatagaaacactctattctagttggtaaatttgtttctcataacggtatgggtgaacagttctgaacctctttacatgtatcctggggttgaacaaataagtaaatggatgatgaatggtggaagctaggtttctcactgtcaggaagggatgttacagataaataaacaagaggggagagccagaatgaaacctgtggtactggattagagttggagatataagtatttactcatgtttagcttaatatatgcagatggatagatgcagaaataattatagatgcatgtgtatatgtggattagtatacatgcatatgtttcctagctgtgtttactgagaaggcctagaagcagtgatatcccagtagccacaaacacatctaacgctcacatcctggtttgtaaatcctattctccaataaaaggatccaggactccttttaaatatgactgattctggggctggtgatgggaaaatacaacataagcatggaatatcttgtagtgccagaaggcaagagatttcttaaaaataataaagattaagcatgccaaaagggacacatgagccaatgtgaaagaactccgagtggccgtagctggaataattagagcaacaaaataaaacatgtagcattggattaaggataaattattgagtaaatatacatgagttcacagtgttatgtataaattgtataaataagtaaatggaggagaagagataaatctccctgacagaagaattccaaataacatattgccccctccagaagggggatcctacttcccttctccttgagagtatgagctggattgagtgagtcatatccaaaaattgagtttggaagacagcgaaatactgacttgactatttccattggagaaagctggtaaacaactatgttaactaagtgatcaaggttaacatcacaaatgggaagtcatgctgatgtgaagaggtggaaacttcatctctctgatattctttccctaaacctgtagcctcaatctaatcattaggaaaacatcagacaaatcccaactgatggacattctaccacataagttgagcattcctgaaaactgtcaaggttgtgaacaatgaagaaagactatgaacatctcactgacaagaagagactacagagtcatgacaactaaatgttacatagtttcctggatcaggtccagaatagaaataggatattagtgtaaaaactggtgaaatctaaataaagtcttgactttagtcaataatccaccaacattggtttcttggtttggccaaatgtaccacagtaatgtaagatgctaagatagtgacattagaacaaattggatgaggggtacataggaagtctgtatattaaacttgcaatttttctgtatatctaagttcccaaatataaaataaatttatttgaggttgatcaatgggctgactatattgacaagatactgataggttacatgttgaagaaaacatacaatataaaatagagaaaaagtcagttccatcccttcccactccccctttacctacctgctccccagtactcatcattgtgatttagtcagaacagggtttagtgccagaggtcagggtgactgagggtggaggagttgtgagcaatgggttcatggctgtcacaataatgctgtggcaattctatggtttcccagctgggagttaggagtggggagggggctgcagcctgatgacagccagctgaaggaagagctacctctcccttccctagctgctcatcacctgaacccaagaccacgccaaacaagatatggatgtagatgctcttgctgagtctgttccgcaagagggaaagaaagggtagctgctccaaacacgccgtcctcatatacaagggtgaggggaacagaagcatgtggctgctaccagcaaaggaaaagtaggagagcaatagaaaggggaggaaatgggaagagcagaaaatcaatattatttaaaaagtgacctaagacttaaaattgaattagtatttgtacagaaagatgcaggtggaataactcactctggcctgtgatcaaaattatatggagaaatcatggtgggccccttcctctgtccccagtggtggcaccagttgctgagtgtgattagttagaatggattccagtctagtcgttcaggcagaggaagtagttgcagtgggcaggcaagaggggctcagttgctgcagcactggctcttgctggctgggtggttcttctggaggtccgtacctcagttttggcctggagcaccaggtgcactctggggcttattaggaatcttcttagctctcgccgtgtaaacttcattcacgttcattgcagtctttactgatgtctccatagtcaactgtcgtcgtctgcatagtcctgtgcttcgtggaattctggggctttcttgctggccaggtctgccttgttacccacaagtacagtgacaatgttggggctggcctgcctctctagctccttcacccatttcttggctggtgcaaatgtatcttttttggtgatttcatagtacatgggggctgggctatgataccgctcctgtccagcgctgccccagatctcaaacttgactattgtgtcgtctaagcagacagtctgtgtaaggaaggctgctctgattatgctctcctggtactcttgaaattgtcccttgacaaagtggaggacaaggctggatttggccaccatagactcattgttcccagtggctggtccaccaggtcgtgtgctgtgccttgccgacccgccactacccgtccagctgttgtgataccagagagcatggggacgggagccattgctatgcaaagaggcacttagttgggaagggggtctccaaaatgacgcaagggcagtagtattacttggggctggggctcacacaggctccgcttctctccccccacccctggtggtatctccatataaaaattttacttaaacgcagagaccatatatgtacttaaacacttgtctaaagaaataaaatatggccgggcatggtggctcatgcctgtaatcccagcacagaggccgaggcaggaggatcacctgaggtcaggagttcatgaccagcctgaccaacatggagaaaccctgcctctactaaaaatacaaaattagccgggcatggcagcacatgcctgtaatcccagctactcaggaggctgaggcaggagaattgcttgaacctgggaggtggaggttgcggtgagccaagatccccgccactgcactccagcctgggcaacaagagcaaaactccgtctcaaaaaaaaaaaaaaaaaaaaaaaaaaaaaaaaattcccctgcctctctccaccccagagggtaaccattatcctaaattttattattattattcacatgcttttctttataggatagccatacatgtatcactaactgttctaccatatctcataacctcttatatagtttcccttttttgtcatatttgctgtgttctggataatttcttcagatctatcttccgatattggtaattgtatcttcagcagtgtctcatattctgttttacctgacattgaattttatgtaataatcattacttccattttcatttcttcccctgaaatcagtttactttatcattttgataaactcatttcattctcatatatacaatcctcttgtttatttaaatatattaaacttattttctattttgtgcctagcctaatatttaaagcttatgcagttctgattttgctgtctgttgtttctgctggctgttactcaaactgccttattttcctgtgtgttagcttgtattcattatttgtggtgatttctgagactgagatgaagatacgtttccaaagagagtatttacatttgaatctgccaaaagcctggggatactgtcaacctgggaacacattcaaataaatgttgggcttaaagttttgtgggctgcataggtaacatgagttccagatccataaaccttcatgagggtgggcttgtggttaaattttcagggaagatgtatttacctgcacccagcatcaagtttgaaagaggttaatttccttgtttattccttctgtagggtagacatcattctattcaactcttacactaaacatgtatgtagctctttaggatcccaactttatgtggagagtctaattagacttcgtatcgttaatgtaccctagaatttatcccctaaaccttgggttcagtagtgtcctggtaaatattttaaagctggctgtccagggcaaaaaaaaaaaaatcctaatttctcacatttttctatttcacactatggctgatttcacgataccagcctgaagtcattgaacgtggagttgggaaaagatatgtacagttagctttctcaactccagtgtatcactgccagttctgtacatggctgtgaaaactgaagctcaatgcacagggcttggcatatccctcagaatgaaagaatctgagtgtttgcctacccctctggatttccatttttactttgttttaaccttttgagtattctgtgtcaactcagcaatatacttcaaaaaaagattcttttgttttctttttattttaacccagcatttgttgttgtttttagcaaaagtcctgtgttagggtacctatttagtcagaaatagaagtctctgtgcttgtttgtaagtataatgtattatttttctttttggggaaatatagaaagaaatagaagtctctgttcttgtttgtaaatttaatgtatttttcttttttgagaaatagagaaaagtacagagaatattaaaacacccataatcctatcatatatgttcattttatgtgcatgtatgtctctatacatttttatataatttgcattatatctactatttcagtatatgatttttgttaatatataatgaatgtttgctcatgccgttaactattcctttaaaacagcccccattatatatgagactaaacataaaatgctgcacacataggagttagtataattcagaaatttagtctgtattgcatttggaaataattttgtgaaggttattcatgcagcattattaataattgcaaaatattggaaaccatataaatgaccagttctagaagattggttgaatatactctggaacatacaatagactactatgtttataaaagctatctgtttttataaatatatggagtaatttccaggaaatattacatgaaacaaaaagcagaaacaaatacccatagtgctacttgtcatacaagaaaaagggagaattaaagaatgtgtatgttcaggaaggataaagcagaaaacagtaaaattagttacaagaggtagaagggagagtgaggtggaagggatgtgggagggagtgagacttggatattggggtatactttcttggcatagtttcaacttttgaaagcatgttaatgtccaacatattcaaacagttaaataaaaatgatatcactgggacagggacctaaaattgtaaacaaacaagtgaacttaattcatttttttttcttatttttttattattatactttaagttctgggatacatgtgcagaatgtacaggtttgttacataggtatacatgtgccatggtggtttgctgcacccatcaactatcacctacattaggtatttcacctaatgctatccctcccctaaccccccaagcctcaacaggcccctgtgtgttatgttcccttccgtgtgtccatgtgttctcattgataaagttaattttaaagtaaaatgaatactatatccataccgaaaggggataaagaagaaagaaatgaaggaagaagggaggacagatttatgaacaccagattcaactatatgtccttagcttggggtgggtgggagagaaatgaagaattgcaaacaaatcctgaactcacttttgtaggtttattttattttattttatttttttgaggtggagtctggctctgtcgcccaggttggagtgcagtggcgtgatctccgctcactgcaagctcgacctcctgggttcacgccattctcctgcctcagcttcccgagtagctgggactataggtgcccaccaccacgcctggctaattttttgtatttttagtagagacggggtttcaccgtgttagccaggatggtctcgatctcttgaccttgtgatccacctgccttggcttcccaaagtgctgggattacaggtgtgagccaccgtgcccggcctataggtttattttaatggtatgggcaaactaaatcagagactattttgagcaaatgagtgagcctggtttctcactatggaagaagggacaaacatatagacaggaggaagacaggtaagaattctgtgtagaggaattggattggaggtgtctgtgtacatatggacatttctgtgtgtgtatgtatctgttgatgtgtgtgcatgtatttttgtatatgtatatgtatgtgtgtgtgtgtgtgtgtgtgtgtgtgtgaagagacattcatatatttcttagctctattgctgaaagagcaaaggagcgaagtcacaatagtagtgacacacctagcgttatttcccactgttagtttcctaaggctgctgtaataaattaccgtaaacttaacagaaatttattctttcatagttcaggcggccagagctccaaaccgaaggtgtttgtggggttggttccttcttggggaggcagagggagaacctatccatacctctctcctagcttctggtggttgtgcataatccttggagcttgatggtttgtgacattataacttcaattcctgccttcattgtcatatgacattcaccctatgtttacctgtccaaattttactctttttatcagagtaatccactcattagggccgactctaattcactgtgactttatcttaacttccaaagaccccgtttctaaataagctcacattcacagggttagtacctgattatgactttttgaggagcacagttcagtccctaatgcctactaaaactaaagctcttcactcaaatgactggcttcagtctggggcagggtaggtacaagatgaacctagaacatgttgtaatgccaaaaagtaaggaaatgctaaaaagtaagataagttgtttgttaagtatacagaatctagcttgaagagttccccactggtcaaatctagggcaatttgagcatcaaataattaaatacagtaatgaattataagctgttggaaataaagaactttataagaccattccaatcactaatgggtggatggatagaaaatgaagatattttacttacagtggcatgctgaaagttgaccagcaaatgtggaggttgtgctagagttgggaaaaaacaaaacaaggaaacctcattttgcagtcatcatgttaaagattagatcaggcaaaaatcatcaatggttgtaacatctaagaggacagacatgttgatgaagaacagaatatttacatggtcttgaaatgttgtatgggagaagagaaaaacagcaacaatgcagtggagaaatcagacaacacattgacagggtgatcacaagtatcacctccagtgagagtcaaatgaacattgtttgcctccttatgtgtttatctgtccctgagaagtacacaacatcatctatgcagtttctggcccagaatgcatctcaactcaatcacaagagaatattatgcatacatacagaaaaagaaagaatacaactgaacatagatgataaagaaaatgaggtaaaaatgtgacaacagatgaaaatggataaaggtattttctgtgtttttatttttggaactttttgtacattgaaatgattgccaatggaaaagtttagataaattgtcctaaagttacagagaacttgcagggaaaaacatcttaaagtagactaatagtggagagtcataaaagacacttggcaaatcttcttagttgaatattattcaaactattcagtcagggaactgattttgtgctaattatgaaatgcattattgcattgactttatgtctcttacaacattaaattatgttacctaggatcaatttgagattcaacacatgatagtagtttaatacagtgaagtcataacttgcaacaaactatcccaattttaagaattaattctgagcaatttttatatgcatgaaaaagatggttagaattatttgcagacacttgcatattctttagtcaagtggtcttattaccataattcatatctgttgtgggagtagggaagaaagagatttaaaaaatatctatcagttctttcaatcaagttaggtataatattaatagactttgagctaagaaagttttcatgaccagaagaggagcaggaactgtctaacatagaaaatgtttatggtataccataatcagttatacaaatataaaaggaaaaaatgtttgactagtgatactctcaaacttggatatccagaagagtgattctgtcagtacactaaaagcaaattcatctatcaggagctttcatgttttcattcaacaaatatttatccagtgcctattatgtaccagatagtgttatactgtgaatcgggagcatatgttaaaatagacaatatagtagacattattctctaaaattattaacaatagtagctaatactcatatgatacttactctgggccacataccattctaagatctttacatatagtaattcctttacctcaaacaaccttattagattggtactattattacctctattttattgatgaagaaacagaggcacggaggtgttaactttctccaggtttcacagctaaaagtagcagacccaggattttgaatccatcagactggcttgtgtccaagctttttttaattaattttttttattttgacataatttgtagattcacatgcagttgtaatataatacagagagatctcatgtactttttactcagtttctcgaggtaacttcttacaaaactatagaaccatatcataaccatcatattgacactgatatagtcaaggctccaaatatatctgtcaccacaatgatccttcatgttgcccacccacttccctctgttcacctattgaaagacatcttggttgtttccagtttggagctattacagataaagctgctgtgaatatttgcacataagtttttgtatgaacaccaatttttggctgggcgtaatggctcacacctgtaatcccagcattttaggaggccgagatgagagaattgcttgaggccagaagttcatgaccagcctggtcaacgtagcaagaccccatctcattttataaaaataaaaaattattttttaaaaggaacatcaattttcattactttagactgcctctaagcttttaattcttacattctaccacctctcaatatatagtagggaataaatagtagagaatgacttgatggttaagttgacattcagaagaggcctgaaggaagtgaagaaaaaagccatacagctgtttggggaaagcacatttcaagcagagggaacaagcacagaggccttgagaaggaaatatgcctagagtgtttgagacagagcaaggcggctggaaggagatgagttctacaaggcagctatgagccaggtctataagatgtggctgctatatagaaaatagatggtggttgggcaagtgttgaagcatggggaactattaagaggctgcccatcggagcttgcagtgagccgagatcccgccactgcactccagcctgggcgacagagcgagactccgtctcaaaaaaaaaaaaaaaaaaaaaaaaagaggctgcccatgtgagagatgatggtagcttagacttatggtggaagtgttaaagatggttcagattctagatatgttttgaagaagagctcacaaaaatttttctgatgggctgacagttggatatgagaaaaggaaaggaggcaagaatgattccatttaccaggttccaagagaatgattacagaaaccaatagattgccttatttatttatagtaggaaatgtagttatcacatcggcccaaatgtttgtgtctgcttaatccgcatatctgtttctttaggcaaacttgcattggaatgtaatggcgactgcagaatcaggataaggggacttgaataaatcagtctttaaatgcatctgaggccgggcatggtggctcatgcctgtaatcccaacactttgggaggccgaggtgggcagatcacttgaggtcaggagtttgagaccagcatgcccaacatggtgaaatcttatctccactaaaactacgaaaattagccaggtgtggtagctggcacctgtaatctcagttgctcgggaggctgaggcacgataattgcttgaacctgggaggcggaggttgcagtgagcctagattgtgccactgtgctccagcctgggcaacagagcaagactctgtctccaatcaatcaatcaatcaatcagtaagatacatttcactccagcctggacaacagagcaagactctatctcagtcaatcaataagatacatttatctctttagtagggacctgaaaaaattaaattccatagacaaaaggctttctgagctcttctttaataagtagtgttggcagatgcagtggctcatgcttataattccagcactttaggaggccaaggcgggaggatccctgaggccaagaatttaagacgagcctggtcaacataacaagtccctgtctctaccaaaataataataataatatttagacatggtggcttgtgcctgaggtcccagctactcgagacgctgaggtgggaggatcccttgagcccaggaggtcaagcctgcagtgatccatggttgcaccactgcactccagcctgagcaacagaatttttatttttatttaaaataaaagtagcacaaacatttgcttttgtttctctttcataatgcaccaacactaccctaacccccaacataatccttttgtagatttgttaatatattcagacaggccatattccatatctgatcctacttagtggtttgatggttggctaaaaggcagtattaatatctgttatttccatgctattgagggatatctcacattgatcatccttgtattggcaatagaaataaatggtgatagtatttttttcatttagataaatttagcactgctcttagtattattgaaacttagtttaggaatgtatcatttatctataatcatttattgctgaagtgaacccttctttaaattttcctcttccaaatattgatgtagttctttctttcttcatcagttccatgcatacaattcaattttcttcatgacacgggatcatcatctataacgtctgttacttataggactattctatgagtctcttcaagtgtatacatgtatttgcttttattttaagttactcaaattgttatatattttgagtacttatatatacattttaataattttactagccctggagctggtggtgtgtcatcttcaacttcctttttaaattccttctaatttcttagggtgggaaaaatctaattcagtagattgaatttttagaaaagagtagataaactgatgtctaaatatttaggtatttgtctattctggaacctttttgcttcatgatttttcttttttactttgcattcctgagatttcctttcatgaactggaaggctttactttactaagtgactcagcagtagctctatgtatcttttagttggaaatgcctttggctctatgcatgcacacactgcccattaattagcaaaccaacatagaatcatctgttgatgacaaaattaccaaaatggatcatccataagtgtttatactgcaaacagtgtatcagaaatgtcataatctcattcattaagaaatttacatacacaccagattttagagtgctcattcatgatgaatgtctacttccacactgtttgtttggaaacattcaatagccagtcttgaatttaaaaaatttaattgaatgcttaaagaattacaagtgttcctttccttggctctaatgctaaccaaagtgcttttctaaactgctaagaatggactgaagattctgctgagggctgtagatacttatctgcctaattgagccatcatttgttgacatgaagaaaaccacgtgacctactttaatgcatttctcagtagcagcaggaggctagaatgtagttcatccaacagtaaaactagcagcagtattattagacatgtgaaaatagcattggttatgggattagttttgtaaagtaaggatagtaatataaaggtatatagtcataatataaacagtatagagtgatttttttattttcaaaattatttgaatccaataatcatttaagtcagtcattcagtaactatttaccaatgtttacagttgccagctatattaaaggaattgttgacttgtcaaagttgattcatatgagagtaacagtgttaaaatctgaaactggtatggattgctaaaacgaaatactttgagtacacagggaattactatgatcaaaactatgctggatacattaatttgaccatgtgtctttaaattggaggtgaggaagattagttacagatacattaattagaaaggtgttatattagtctaggttgaggctgatataagtaagaaagtaggaaaggatgcaaaagcccttggaaatgaatatttgtgtgtggtgaagtaaaatgaggtagaggttacccttttacatgacttgagagaatcatggctcatttagtaaatccagagggagaaatgattttctatatatataatgagtttggaatacaggaagaatgccaaaaataacatcttaaggaattcttcctaaatagtgaagaaagaaattagtatcaacagaagagacagaaaaggatggttatgaaagataggaggtcatcgctgtctaaaatgactgatggattttgattacaccactggtgatagaaaaaaaattattagagaaaagtgtagtctgagaactatttgatcttagtctgtaatgaatgaaatataaaatttgagactatttggaaactgtttaacaagtttacacccccttccagcaaatacaaaattacaacaaatttaaagatgttaattggtttttatttgcaattctaaaatcggacaacaacctcattctattaaatagaatgaatattccagtaagctgagcagaggaagttgactttatagacagaaaagggctgaggaaagcaaaaacagaaaacaaaatgtggattggtatttccaaaattacttttcttataaaggttaaagcagaggggacttccttataccagctaaaactggtctgtttggggatctggctattatctgtttctcctgatttcttggaaagtaagataaacaactatgttttagcttagtgatgtggaacttcagcttgagtgactccattttggtttggtctggtgggcctagtgcaggagcttagtccaaactaatgggatcctatacattttgtttaacactgccaacatcctggtgcacgatcatcagatttctcattgaacagggaatggatgactttgaatgttggagagcacctgtggtgagttgtttatatataatctgtaaactagttatgcacagtagcactatatatgggtctatgttggactagaggataaaaaataacttggccttcacctcagagagtttaagaatcactatgccaccagaaagatggtagtagtaggcacattacatcgagtgaagactgttgggtgagagggaaggtttgcttaaagatataagagatttgagtttgtatattgtctaaggaagatatgatagaacagaagactgataatgcagtgtggaagagtgataactgctagatggaattgagatcaaaggtttatagatgaagactttatccttggaaaaatacatttacatttatttaatgtttagtttttaaattagatattatgtaacttgagcctcacagtaatccaatgaattaggtgacatatggttggtataattcatccgcctttacatttaagaaaattgagacacaaaaaatgttgtgtgttatccacagtcatgtggttagtaaatggggagatattttcatgcccagttctatgctataactactattatgtctgaaaataaaggcagaaaaaaatacttgaagaaaaaatggcaaaaaaccgcccaaatttattgaaaaacatttgtttatacatctaggaagctctttgaacaccaagtacaataaatgcaaagagatgcacacctggcctcataatagcaaaatcttgactatttgacaaggacaaaaggaaaatcttaaactcagcaaatcacaacaggggaacacaaaattaacagcttacttctcaccggtaccaatgaagccagaaggtaatgagataacatatttaaagtgctgaaagaaaaaaatcatcagcaaataaccttatgtccagcaaaaatatgtcaaaaataaaatgaaatattttcctagataagcaagtctaagagtgttcattgctggaacatctgccttaccaagaaatactaaagaaaattctttaagctgaaattaaatgacaacagatagcaatttaaatctatacacaaaaaacaaagagcatcaataaaggtaattatgtaagtaattacaaaagacagtataatgacatatttcttcactattctctcaactcatttaaaagcaaatgcatacagcaatttgtgtataattgtatttaggccctatgacttattagaatgtaatgtatatgatgataacagcagaaaggaggtgcatggcaacaaagctctattggagtgagtaagaaaaggacaccagatggtaaactaaattcacaagatgaaatgaagaaaaccagaatggtaaataagaagattaatataataaactctttaaatgcttgtagtcctagctacttgggaggctgaggcaggagaatcgcttgaacctgggaggcggaggttgcagtgagccaagatcatgccactacgctccagcctggaaatcataaggaatagaaaatatatttactattcattaagtggaattgaatcatcataaaggtcttcatcctcttagtcttcatttactgtctccaaaaaaaaaaaaaagtttccatgactcttcagtagattatcataaattaagatgtatattgtaacccttagggcaactgatgagaaaataacaaaaaattctagttaaaaattattaaaatgcccctataatatgcttaactgatttttgacaaaggtataaagccaactaattggtgaaaagatagccttttcaaaatgttgctgtggcaacatgacgtcaaaagtgaaaagtggccaaaagaccaaaaagtgaaccttgacctgatacaaaaatcgagtaaatggatcacagccttaaatgtaaaacgatgaaacttttatgaaaaacataggagacaatctcagaatctaggggtaatcaaatttctactgaaaattttagtagccacagcaaataagcaataaatagaaagaaatgtcattaaggttggaaagaagtgaaactactcttatttgtagatgacattttgcatatagaaaatcttaaggaatccactaagaaaaataaaggaggacaggtagtgataaatgcaaaaacagaaagtaatgaaatagaaaacaagaaaatagaattaaatctaaagcctttttaaataaaattaacaaaataatcaaagtggtcataacactaagcaagtgaaaaaagaaaagatagaagcaatattataagtgaaaaacaatgtttaatcataaacaattctaagaaatttggaccaataaaagtttgacaaaaatctgaagttctctaatttgtttatatatttttggtatttatgtatttattgtcataggtttcttagttagattcatggccaaaagtaccatccaaaaaactatttccaaatgtatatttttagcacatacctcttttctgatctccaaacttaatgaccaactggttatttagattattatatgcaaatagacttcttaatatacagtgtcaatcctgtttctcttatgtttaatacatctctgtatatggtaccactgcagggtttgactcatgtgccctagccaaaccctaggagtcatccttgattttttcttttccttcaataagtccctatctttatatctggaacccatttactcttcttttatcagcaattaccattctattacagaccattagtatttttctcctgccctactgctatagtctcctgactgatctccttctactttttaaccctttcaaaccattctccacagaatagctggagtggccttttaaaaatgcaaaccagcataaaacattttgatgtttaaatccctctcatggctgccaatgattgctcatagaataaactccaaactttctgccatggtgtataaagccctacatgtcttacatggctttcctcctacctgtctaatatcatcttattctagttctttctcattgattattcctttaacaaccaagcccttttccttcaaaagtccttcactcttactcctccttcctggaatgctcttcactgttttctaagggctgactcatgtataaccttcaacattcaactcaaatgccatcctcttagagagtcattttctggttagctatctaaagtagctttccctgttcctccatgagctgttgtcataatatccctccaacccccaacccccaccttatataaccatgcttgtctcctttgttgcagttatctccatttgtaattaacttgtttaaatcctcctagaatgccagctaataagaaggtaaggtccttgcctctctctctctttttttttttttgagacagtctcccctgtcacccaggctggagtgcaatgacgccatctcggctcactgcaacctccacctcccgagttcaagcaattctcctgcctcagcctcccaagtagctgggattacaggtgcctgtcaccacatccggctaattttttttttttttatctttagtagagatggggttttaccgtgttagccagagtggtctcgaactcctgacctcgtgatccctccgcctcagcctcccaaagtactgggattacaggcatgagccactgcccccggccttgcctctcttaataaccatattacctctggcaaccagcatagtgcctggtatttattgtgctcagtatgcatctgttgaatattattattttgtatactctatagtgatgagcatgttgtaagcaacccgatatgtataaattcattgatggtgttctctctctaaattttctttattgttttcatggtgggttcatttcctcctttaccccctctttttaggttgtataatcattagttttattttcatctctgattttatatggacatgtttcaatgcatacagacagttaatattcttttcctcctaattatctattatatatatcatcttcagtatcatcaccattcaaaaaactcttttatatgttctagataatgtggcctattttttacgttagactacctgataaggtgtcaactgaattggctgcctttatctacattctgaaccaaaatttaattctagagtttgtagtcagcgtttttccaaatgtgtaaaactgtaatccttcataaaatgtcatatgtaaaagagtaagcaattctgtgtgtactaaaaggtgagaaagttattactttagctttcactgggaagacttaaagtttatcaaaaaggattatagaaagaacagatttatagcaactgtctgatatatgaccagaacccttatgttccactgaaagagacttgccctaggctttctagagcataatgcccttagcaagtagctttcaacatctttttcaggaagcaatattttccttcagtaaaagggtcactgtactgtttttctttttccttccctgtcttatcttttgagttcaggaagtactttaaatttacaggcagctttgaagacatgaagcaagttcagccccagaagtatttcctgttatggcattaatctaattccatgaaagtagaactgatttttcatctgtaaagtagataaagtgcctagagcagccgaccattattctgggttatcatgataaagaggcttagttttgacacaaaagagtttatcagcctacccagtggaagatttcatcctttttgttgaaagatatattaatggattataatctgtcttggcttccaaaagaaagttcacctttatattgaaaatgattagttaaatcagcaaatattttcctgaatatacattttataatatacgataaatcaagcaaacattctagggatatcacatataattaaatatctaatgttaaatcattttatgttattttaatgtttaaattattgtctcaatttgaaataatcacagattttccttataaaccaacttggtttaattttaacatatagactaacataatttctagtaggcatatatgcttcattttagaagcccctgttattaggttatataatttctccttacaacttataatgtagaaatagttttcttataataaggtatttctcttaatagttaataattaaacttagttgattattttaagtatatagtacatacaaataatatataattcaaaagctataatatatttttcctatccctatttcctggttcctctctaagctaaggcatttagactaatcctagtggcttagtattgtttaaataattttttatttgaaaattgattccatattggacatatttacaatatttccttgaataataatagcttaccacatagtaatacattacatatttagttctctcagtagccttctgagttaaattctgttatccatttgaaaaatgcaggaactcaaggttagagaggttaaataattggctaaaattcacctggctgataagtgacagatttgggctggaactcaggtcctctaataccagagcctatattcatagcccatactgtaggattatagaaataaggttattcccagttgtgccttttatacttgaaaagaacaaaagattccactgaatgcttattttacaattaataaattaagttaggctttatcataccctaatgagatatcttattatttgtttaaaataaatgatctaccattatgttcataaataaaaataaagatattgttttattatagatgttaatgttttaaaacttagatcatctaaacatgaaaaatctctggcctagtcaaaggcacactgagaactaaacttgggattggaaaatttggagttttcaaatggccctaccaattcagcgcataattgtatatgcttatcatttttccaaagagggttgaatagtattcttccattgtatatcttagggaggcattataaaggtaatatgacatcagatgttaaacttacttatttaaccagcattcattgaggctgcctactatacgtatcctgtgaagcaatgtgaccaatacaaagatgaagaaaacatgggtgctgtctttagtgaactacccatcttctaggaagaataagatctattgtaatataaacaagagtgatgagtccttagtatatgtgaaggtctcctcagctaagttccaaaaagtaacaagctaactgtaatttcaccaccttagtattttatgaacaccaccttagtttttatgaactcaggaccttacctccactttatgaaaacacatatacacaaagcaaggagttttaataagcacttgaaaagatgctaatcttagccatcagacagtggcataaccatgtgagctttatcttaacacccactaggatgtctataatcaagaagacataataccaagtgttgacaaggatgtggagaacttggaaccctcatgcaccactggtggaaatattggcagttcctcaaaaggctaaacacagagttaccatatgacccagcaattccacttttagatatataccaaagaaaaatgaaaacctgtgtttacacaaaaatgtgtatatgaatgtttatggcagcattaattataatagtcaaaaggtagaaatgactgaaatgttcatcaactgctgaatggataaataaaattagattgttattttacatgagacacaaaaatgaactcaaaacagattaaagatttaaacataaaacctgagaccttaaaactcagaagaaaacatattagaaaagctccgtgacactggtcttgcaatgactttttatgtatgacactaaaagcacaggcagcaaaagcaaaattaaacaaaattgtatctatatcaaaccaaaaagtttctgcacagcaaaggagacaacaaaagaaaaggcaactcacagaatgggagaaaatatttgtaaaccccatatatgataaaaggttaattatccaaaatatgtaaggaactcatacaactcaatagcagaaaacccgattaaaaaatgagcccaggacctgaatagacattttccatagaagacatacaaatgacccaggtatatgaaaacatgtgcagtgtccctaatcatcaaagaaatacaaatcaaaagaccacagtgaagctgggttcagtggtggtggtgcgtacctatagtgccagctacttaggagactgagataggaggatcagttgagcccaggggttcaaggccagcctaggcaacataggaagaccctatctctttaaaaaaagaaaaaaaaaattactcccccacccccactttcctctccctcacaatgagatactaccttaaatttgtgactgttatcaaaaagtcaaaatcatgtggaaaaaagggatcccttgttagcgggaatgtaaattggcacagagattatgaaaaacaatacgaaagttcctttaaaaacagaactactatataatccaacaatctcatttttggatataaatctaaaggagatcggccgggcatggtggctcatgcccgtaatcccagcactgtggaaggccgaagtgggcggatcacttgaggacaggagttggagactggcctggccaacatgatgaaaccccatctgtactaaaaatataaaaattagctgggcgtggtagcacatgcctgtaatcccagctacttgggaagctgcggcaggagaatcgctcaaacccaggaggtggaggttgcagcgagctgagaacatgccactgcactccagcctgggcgacagagtgagactctatctctaaagaaataaataaataattaaataaacggaaatgaaatcagtatgttgaagagatatttgtactcccgtgttcagctgcattattcacaatagtcaaaatagggaaataccctaggagtctgtcaacagatgaatggataaagaaagtatatgtatatataaacagtggagtactgttcaaccttaaaaaagaaggaaatcctgccatttgcaacaacataggtgaacctgcaggacattatgctaagtgaaataggccagacacaaaaatatagatactgtgtgatctcatttatatatgaaatcttaaaaagtcaacctcatagaaacagggtagaaagtgtggttgggggagggaagaagggtagtggaatgatggggagattttggtcgtggggtgtaaacttttagttataggatgaatacgttctggagacctaatgtaaaacatggtaactatagtttataattatgtattgtatacttgaaatttgttaagaaagtagctcttaagtcttctaccacacacaaaaaaagataaatttgtaagttcatggatatgttaattggcttgatagtggtgtcatttcacaacatacacatatatcaaaacatcatattttatactgtgaataaatgtaatttttgtcagttataactcaagaaaattgaaagaaaaatgtattatatccacacagtgaaatattatttagtaataagcaggatgaagtactttcatccatgctgcaacatagataaacctttaaaacattgtgctaagtgaaagaagccatttataaaaggctgtctattgtatgatctcattcatgaaaagtcttaaataggtaaatcaataaagacagaaggtatattggtggttgtcttaggctgaaagtgttgtgggacaatgctacactcctaatagatacaggatttctttgggagttagacaactaatctaaaattgactgtggtgatggttacacatctccgtcaatatactaaaaatcacgaattgtatgctttaaatgcaatttatatgtgaattagatctcaataaagcttttattttaaaaaatagatggtattaacaaaacttttagactactgtgaccacttggcacacctaacaacaaagcatccaaggagattaatatttaaacgtacattataatatgaaaggcatgaatttagatgggggcatgtaacctcttgaagaaatatataatgtaaaagtgttattattgctattttatttcttattttaatcaaacactgtgatagtattattcattccactgtaacccctattggataaatacattatagtatttagaataaaactcatgtgttagtaagccagtgagaaagaatcataccagagctttatagatcaccagttctatctcctgtccctccatttcaggtatatgcaactggcctacctgttcagagtattaactctatggtgcttcatcagtcagaccatccactatgcccaaatgagtaatatgtccaaactgtatttgcaaaatgcatttcttcacagaaattaatatcctgtgcaaatgctggctaattgattattactctttcataaaggcttaattaggtaggaaacccagtacctgcagcgagagaggaagaaaagtctttcctagggctagatcctgacccaaggttttggattttaatggggcagagttgtctgttttctattaaacacatacttgggagtaagtagacttgcccatctcctgttttatactgatcttttcacgaatgtgaacctttttcttgaaagagtaaatatctttaaatttttctgtagccttccctgttacaagttaaatgttcctacttctctagagtatttcgaagtgtttatttaaataagtaaacatggatagacactattttgtagcaaggggttgggggagtatactctaaggcagcttctctctgacagcttatctttcttataagtatagtgtaaacatataatttataatgtgggaaaagagggtttgatcttttaataaagccatttctttttatttcagagttaaggagtttaaattctttttctttagcatctagcagtgagttcaggggtgatggtcattaatatcttgatccattacttttcctaaaagataagattttttttcccataatggttcatttgtctgactgctttatttcccaccagaaatcacaaaatccatttttcctgtgacagtataataattttcacaacatctgattttagtggcacatacatgcagaagattaaaggtgtaggttagaaaagaagcagtaagaaggcattgagaataaaaacatggtagaatttatttctttaatgtcataataactaatttagaaaaacaaatataaacaatgggttgtaaatagtttattcaatattttaataaagaattaattcattacatgcacacttatttttacatacttgcccagatttcttaccaaaaaaaattttctcgccctattctcaaacaaaatttatagacattatatacagcctctgttgaaaagaccttctgttaaaatcagctgcccttagcttgacatatcttgagttcttagtgattaacatgttaataacaagtgtgaatgtcattaatgttcctataattaatttcagtattaacaccttatgtttcttattattcattcctcaaatgaaggatttttccatttataactaagtggcaattattatatcatttttatataatggagcaataaattgtatctgatgttattaatagtaattcctacattccttataacatacttttatactcattcctttatatattcctttactgttatataatactttttaagtgcctttaagtgaagagaagtggttgaaatgtaaaagaagctacttggaatgtctgtaataacaaatgtgttagtatatttacacctgcttgaaggaaagagtaaagtatttcctgaaaaccccacaattatataggtagttcaacctctgatctgcactgaggcatttaacctctcttaaccttggcttccttatttaaaggaagtggctgttgagccttacctaaatcataaagtgagtgcaagtaattgtttactgagaaatctaagaaaggctaatggaaaacatcaagtatgaatgaaacagttataactgttttcccctttgaaaagaattgctgttccacattgaatttctgtcatgaatctaactctttttaaatgagctatttaaatttaaatacataaatggatgttatattttgattttaattacttcagtagtaattcagaattaattgaagctacagcttaaacatattttattacatttaaatagttgggaaaaaataaacagttggttagctaaaacccaataaataaattgggaatagattctgctagttgaatgctgaaatgaatagtatatactttaaagggctttaattttttctttcatactgatttaagactgataatttatctctttacttattctaattatttgaccctttttgttggaggagagggggcaatcttgtcactaattgtgtaacccttgtttaatttactctttcaggaacccttccaaccttccccctctccaccttaatacactgatgttcattttggatttccaagagggagatatgatatgcaactttaaaaaacctattttccagtcaagccatttttcaaagagagcttattaacctctcctatggatcaaattgtgaaatactaaactaggttgcctgtggaagtatagtgagagacgacgataggaaagaagataggatggggtcagaagaaccttacattccatgcttaggagtataaactgtatacgataagcagctgggaaccataaaatccttttaagaagtattgtgatataagactaatttgaaagaatagtgagaaggtggataattgtacatttgattttattcctttatgctaataattcccatgtacatacagtgaatgaaatataggagacaaacatcttcaactattctcatttcttattggttttagagcttggaaatatgttaaaaagacatgtaaactagttccatcaattgtatttcctcctatttagatagtacagtgattttgagcaaactgttaacattgattttaaaatccaaaatatattattagtctataaatcactgcatggttctcattcattgattttcacttaggaggctttggggggttgttttgtttttataatgctttacccaaagcattttaaatcttctactctccagtaatagtttttgtcaaatatattttgatatctgctgtactatttgctatatttacttaaacatctctccactacgtagagcaggtactataggaggaaaaacttttcctctaccctcttatgttcagtagttggtgcttgcaaattaaactgacaaaaaattaggaggataaaaggattattttgtatgcacgtgagaagcctcacagaaaagaattgaaaaccccaaaaaaccaatgagaccaaggggcttacatatcattttaagaaagagtgataaagtatggagaagagactagacaaaatgggggtttagacttctggtggggtgagggtgggcattaatgataggtgactaaggaatgagtggtaaataagggttgtttagtaaggtttattaggcagagtcaagtgagaagagtctgcttcttctcttcctggtactggagaggaggacgccattacaaatatgaatttcctttacaaaagggaaatttatgccctatttttaggaagtaaaggggagggcagagagctcctcctatgtttgctgttttaattgcctgtagttcaaaataatccttatgctgaagtggcatatttgagggtgtcatactctgatccccttcactatagactactctctaataccagggtactgagttaagataattctgaaggcttcgctaataatctactactctttgtcaatttcctatcttagttttctcatctgtaaaatggagatcatgatagcacttacctcaaaaaatgataagaagtcaattaaaaaagcaccaaaaaatgcttaataaagtggtctgacacatagtaaattctcaatgaataatgtatatactgttaaggagtcatttccctctaagagtacaaagtacaaaagaaaaagttggagcttaagatttaggtttggctgggtgtggtgtatcacgcctgtaatcccagcattttgggaggctgaggggggtggatcacctgaggtcaggagttcgagaccagtctggccaatgtggtgaaaccgcatctctactaaaaatacaaaaaatggcagacgtggtgatgcatgcctgtaatctcagctatttggaaggttgaggcaggagaattgcttgaaccctggaggcagaggctgcagtgagtcgagatcacgccactgcactccagcctaggcaacagagtgagactctgtctcaaaaaaataaataagagttaggtttaatcccagctacttgggagggtgaagtgggagggtctcttgagcccaggagttcaagtccagccggggcaacctagtgaacacttccctccactccatctcttaaaaaggatgggagtgttcccagtgctgattatgccacctattagccgtatgaccttggacaactgtaagcctcaactttcccatctatgcaataagaatcatttttacctcattagattgttatgaggattaaatgaagcagcatgtatatatgtgtatatatatacgcatatatacatatagtatcttgtatataataagtatttattacatgcaatttcatcttttatgtagactttctagactctaaccttgccccaggaagataagtgacttttacattaagccatgttctctttttcctttatgacactcctcaatgcttaatgaagaactctggctacacaaaaaactaaagtaaaatgttgacagactgcttttttctacatctgggcttctttaattgaaagctgacatttaggccaagaattgttaggaattcctatttaggtttataccagttctcgcttatatacaagatgtatacttgtgtatacatgttatttacacacatacaataatatatactggctttctttttttccctctcatcccataacagatagtatactgccttttttaaaaaaaaaaatgcccacttttcaaattaaaaagcagaggcacacattctttccaaatgtattagtataatttgaaataatgagattgtattaataggattcagccacagaaacagacccattagggaagatagagtgagaataagatttatttgttggttgatcgattttgaggaattggcctatgtcattgtggagactggctaagtagtccaaaaccatagggcaggcaaccaggaaggggagaaagccttgaacttcttaggcatgggcagaagctgtcattcataggtggaatttattctctctgtcaaggaaacttaagccatgcttttctttttaaattttattattattatactttaagttttagggtacatgtgcacaacgtgcaggcttttactttcaactgattgaatcaggcccctccagattatccaggatactccagtaatagaagtcaactgactgggagttttaattacatctgaaaaatacctgtatagcaacacctagattggaatttgattgaataactagagtctgtagcctagtcaagttgtcacctcaaaaaaaccatcttgggataaagttttttgaaaaaagaaatagaaagttcagggcattttggtcattatttttgtgtattgtgcctattatatctttttattttaaatttttgagaatctgtttagtgcctagtattttgccaagattataaaggaaacaaaggtatcttaatgtttttttcaaatcttaacatcttaaagttgtttcaagcattttccctgaattcattgattaagtattgttagaagaagtggaacatggatgatgcatatgctttagattgaggcaggagtatgtgtggtgactaagagagtaagaaatgatgatctcgagaatactagactgtgagctttctaaaagctggtatcgtgtgttatttatccttgtattgccatggcctggcacagtaattgaaaaagttcaacaatggtttgttgtttaggttgattaaggaatgagcaaaaacgtaacttaaaagctatctgtattgaagtgtgatctgttatatgtattcagatctgattatacttggagtcgaaatcactgtatctaaattaatattaagactcagggccaggcacattgtctcacatctgtaatcccagcacttcaggaggctgaggtgggaggtcagttgaggccaggagtttgagaccagcctgggcaacatagcgaaaaactctgtctccacaaaaaattaaaaaaataaaaattagccggacatggtggcatgtgcctgtagtcctagctacttgggaagctcaggtggaggatcacttgaatctagaggtggaagctgcagtgatctgtgatcgtatctctgcacttcagcctgtgtgacagagtgagactttttctcaaataaaagaatcaatacagcaatacagccccaatttctaaattggagaaagtcattttctatttcgtctctctctgttcctccactagattgtaaactctttgagagtaagaattatgcagttttgtctgctcttcaatgttttattgccttgcattaaaaagataataaatactgcttgatgaattaattaaaaacagcatacagaagagatccaaatttaattttgtaataaatcacctctgagaataataagaaaaccagaatatttgaaatacatcatttaattgaataaggaacagtaaactgatttttaatgttcctgtttttatgtatttgaagttaatgtttagttattttgttttaaaatctttataaaaattctctgctttatcttccagtgaacaagacatattaatagcttttctgtagagcaaggcatattaatagcttttctgttgaatatgaaagaaagcagctgtagttttatcctactgagtacaaatatttgttggggaattaaagatttattagataaatggcttaaagattaattaattaactatactatctttttactttcctatcttatctgtaggccattggtctgttaatatatataaattgctctgtttcctgctatctttccatttcttaattaaatattagaaaaatgcccaaggaaaaacaatacaactgagcttcctttctggttttcatgcttttaaaatttataaaaattgtggctctgctgcctttttttttttttttttttttttttgtagttagatgaatttggcctgagattctatgaaaaaaataaaacaatagtttttatttcatgatttttttttcaagttgttctgattttataatatctagtcaagtgatgacatgcagagattttgctgtgaggagagggagagagcaaaaagtattctgccctgattgctttttagtgattttattactagaaagataaacattgccttgttattttagccagtaaaattgtctgcaaagtaggtaacaaaatgcaaagcagtgtatttacttttccactttttcccaaaggtatgataaaagcagggttccagtggaacaatttgctgagttctttcctagggagcactggtagcccgtattaaatgattatattttggaaaatgctaatgatgaaagatgagaataatttatattctttgaaatgtgactaaaaagttggaaatgaaacctatctttctgaagtgacatccacatttgtggttcattttcatcacacctgattcacttctgccagcaattcagaaagaaaggtggaggtgggaaagcatatatgtagctaagctactaaagtgactatttgagtatttcattccatctgtcaaaagattcagtgggataaagaatttggcataaatggatgtaattcattctctttttacaaagaagtaaatgatagaacaaaatcatcctaaaatgaaggaacaaaataccagaaagtgaaagaaaacaaaatttgtattttttgatagaatagtagcagaactcaatgtaaaaataatgattacattaataattatttgctcactttttcctgtatttggtattttgggaaagtgggcttgaaaaacagtggatacattgatgaaacatttcaattttcacttgcctgttgtgtttgctcatgttagacaaactataacttctcggtgtatagatatgatgtacacaaaattacacagaaattaagccatgtataataatgcatgactagaagaaagatatatctcccttgaacaaataacagttattttagtaaatttgtaacagagaaaataggcttgattaacaaaaatatgaaagatcttttaaataaatgaattttgaattttcagagtagcccagaattttatctaaactcggattatttcattagctagaacatgaaaataggcatttattctactcacctacagcttctgtagtactaaatttatggaatgaggctttgtggtgctgccttcagagctcaatgatttgctttttctgaattttggaagtctgtctctaattgattgacacatatgaatgtagtgggaagaaatgagattaagcatacaagctttctttttcatttaaacatcattgaagccatgaatttgtaaattgatataaaaacacaatcctttggatctgtattaggaaatttataaatgggagctttattttgctccagaaatgtgataattagaaatatattcaggtgattttttccctttggtttttgttgttttttaatttatttttctttcttatttttaccaaaggttcaagtcatctgtaatattcaggtgtttttaagaatttctcatggcaagttaattgtgggtgaacatttccctattggactaccagatgtactttgtggttataacttgcatagctccaggatttttcgtgaacaagtaataaaacacatttctggtttgctttctgccatagagtattaagagtttaacactttttaaatgttactttaatctctgaaattttcaacaatgattagtggcagtatactcaaaaaaggaaatgtgtaggctttactataataaaaataagaacaacttatataagctccacactttatagatttgtatggatatacaatcaaatgtactaatttttaaattatcctcattttgcagtaattttacattttgctcatttgtgcaaaccgtggtgatagtaaaatatttaacagaaattcaagcacattcttttaactctttctgaaaaatctcacaaatgagatttttttaaaacagttaagaatttactaaatttaaaatgtatatatacctgatgccatccagatgttttattgaatttctaaaataaaagtccacctaatgaatggctaatttactcaacacgtaagacaaagatgtatttctgtgttactaagaacatgcatcctatctccttgacaatggctctaattacctcagcttggactgatcaatatttgatctttttcccaccatgcaaacatgttactttgactttgtctcttcctcttcttttcagataatttgcagccatgtgagaatggttcattttgtttgttctccctggcttgaggccaggggtctcttattagtataatgcagttcattgatgtgaatttgttgatctcctgggtaggttttcacaaatttaaggcaattaaaagcttttatatggcatttcacttgaagttattagtggcctttcagtgattttgcttttaaaaattacttcatcattttatgattatttcctttccttctcttttctctactctccccatgctataaaattctatagtaaaggattgaaacaactatttcattgatttcattaaaagtaataatttataaacttataattcaatagcttaatattttaattaccacaatttttaaaggactaatgaaatttttggttttgtgttttcaaaagctgctttgttttaagcatataaatattcatgatagaagccataatttggagaataataagaattgaatctaaaaattattagtaattgctaaaaaattcaaaaagcacatagtgtaaactttgtgtatatgagacagaactttttctaaattgcagtttcattaacatcttaaagttttctcgtagctaacagatgtccatgatatttttgcttccttaacttttacagtcaatggaccattctccagcaggtcataagtaagaatgttaaataacggccactaaatcttaaggaatgtgacaacattgattagattaaaatcctttgacttcattgacatatcttttttctttccccatttaaaaaattgtttcagttgttttcctactgtttgttggtggcatactttgttacagtacttgatccagtttgtttcattggtgtgcttggtaaatttgaagaaatgatcactggagaggatttgaaataactagcaaaagttttgaagtattgcagtgagtatatggaatgtgttactcatttatgcaaaaaatattggtgtttttatactttttattttaaaaaatatataacaataatagcaaatatttagtaagaatgtaactttatgccatactaaggcaagaatagtatattgaataagaggatataccctgaaggcagggtataaatccaagttgcgctgcttactagttcacttcttaagcagttaacttctgaatctctctttatgtgcaaaatggtataggagaggaaaaaaaatatctttccctcctgatatgtacatgactggggcctctataacaaaaacagattaacaagagaaaagtatactataatttaagtgtaagttttacatgacatgggagccttcataaggaaatgaagacccaaagaaacagctaaatctgagtgttttttatattaggttcaatggtgaaatgatagggtatgaagtaaatgtagtaaactgggtgaaacttggcaaggcctttttgtttggattcccctctgtctctttgtctttggagaaaagatgctcctttatagagagggtaccattcacataagggtcttgtgacctacttaagggaaaggtcaaaaaacagttaccaggttttatgatctgtttctagagaaaagggcaggggacagtcagagagaccttcctgcttctgccattttctcacattccttcaccttaaaattttcaatatatcaaggtgctatattttggggtagtatatcctgaaccgtgcctataggaatgatgataataatatctactttataaggataaaatgagacaatatgtataaattgtatggaacagtgcatgaaccacaataaacactcacaaaatgtttgctataaagatattttcgaccttccatggtggttcatgcctataatcccaacactttacgaggctgaggtgggaggatcacttggagccaggagttcaagaccagcttgggcaacatagcaagaccccatctcttaaaaaaaataaaaaataaaaattacccatgcctatagtcctaattacttgggaggccaaggcaggaggatcacaattgatcctcaggaagatcatgcttgtctgtaaaggattttatatccccttgacttatgaagcttagtttggctggatatgaaattctgggttgaaaattcttttctttttttttgagacagagtctcactccgtcaccaggctgaagtgcagtggcatgatctcggctcagtgcaacctctgcttccctggttcaagcaattctcctgcctcagctgccctagtagctgggactacaggtgtgcgccaccacgcccagctaatttttgtatttttattagagacagggtttcaccatgttggccaggatggtcttgatctcttgacctcgtgatcctcccgccctcggcctcccaaagtgctaggattacaggcgtgaaaattcttttctttaagaatattgaatattggctcccactctcttctggcttatagggtttctgcagagagatctgctgttagtcccatgggcttcactttgtgggtaacccaacctttctctttggctgcgcttaacattttttccttcatttcaacctttgtgaatctgacgattacattgtgtctgggggttgttcttctcgatatgtatgcacccaatacaggagcacccagattcataaagcaagttcttagagacctacaaagagtcttagcctcccacacaataatagtgggagactttaacaccccactgttaatattagacagatcaacgagacagaaaattaacaaggatattcaggacttgaactcagctctggaccaagcagatctaatagacatctacagaactctccaccccaaatcaacagaatatacattcttctccgcaccacatcgcccttactctaaaattgaccacataattggaagtaaaacactcctcagcacaagcaaaataatagaaatcataaaaaacactttctcagaccacagtgcgatcaaattagaactcaggattaagaaagtcactcaaggctgggcgcggtggttcacgcctgtaatcccagcactttgagaggccgaggcgggcggatcacaaggtcaggagatcgagaccatcctggctaacatggtgaaactctactaaaaatagaaaaattagccgggcgtgatggcgggtgcctgtagtcccagctactcgggaggctgaggcaggagaatggcgtgaacccgggaggcggagcttgcagtgagccgagatcgcgccactgcactccagcttgggcgacagagcgagactccatctcaaaaaaaaaaaaaaaaaaaaaaaacctcactgaaaaccacccaaccactgctcctgaatgaatattaggtaaataatgaaattaagacagaaataaagcagttctttggaaccattgagaacaaagacacaatataccagaatctcttggacacagctaaagcagtgtttagaaggaaatttatagcactaaatgccctcaggagaaaactggaaagatctaaaatggacacactaacatcacgatgaaaagatctagagaagcaagagcaaacaaattcaaaagctagcagaagacaagaaataactaagatcagagcagaagtgaaggagatagagacacgaaaaacccttccaaaaatcagtgaatccaggagctggttttttgaaaagattaacaaaatagatagactgctagacagactacttaagaagaaaagagaaaagaatcaaatagacacaataaaaaatgataaaggggatatcactactgatcccacagaagtacaaactaccatcagagaatactatagacacctctacgcaaataaactagaaaatctagaagaaatggatacattgctggtcagataccccctcccaagactaaaccaggaggaagtgaatccctgaatagaccaataacaagttctgaaattgaggcagtaattaatagcctaccaaccaaaaaaagcccaggaccagatggattcacaactgaattctatcagaggtacaaagaggagctgttggtgggagtgtaaattagttcaatcattgtggaagacagtgtggcgattcctcaaggaactagaaccagaaataccatttggcccagcaatcccattactgggtatatacccaaaggattataaatcatggtgctatgaagacacatgcacacatgtttattacagcactgttcacaatagcaaagacttggaaccaacccaaatgcccatcagtgatagacgggataaagaaaatgtggcacataaccaccatggaatactatgcagccataaaaaaggatgagttcatgtcctttgcagggacatggataaatctggaaaccatcattctcagtaaactaacacaagaacagaaaaccaaacactgcatgttctcactcataagtgggggttgaacaatgagaacacatgaacacagggaggggagcatcacatactggggcctgtcagggggtaggggactaggtgagagatagcattaggagaaatacctaatgtagatgacgggttgatgggtacagcaaaccaccatggcatgtgtatacctatgtaacaaacctgcgtgttctgcacatgtatcccagaacttaaagtacaattaaaaaataataataaaattttaaaaagaaaaagattgggtatttcacatcttcttgaatgtaaaactgggggaaaataatcttttttaatgtgcattaaaactttttttttttttttttttttttttttggggggagaaggtctcactctgttgccctggctggagtgcagcggtatgatcaccgctcactgtggcctcagcctcacaggcccaagtgatcctctcacttcaggctccaagtatctggactcaaaggcgtgcaccaccactcccaggttttgtttttttttttttttttttgcagagacagggggttttctatgttactcaggctgttttctaactcccagcctcaagcaatcctcttgcctcaggttgccaacgtgttgggattacaggcatgagccactgtgcctgacccagtgaaacattttagtgcagaatagttgtgaatttttgaaatagataaccaagaaaatttaacttcagatatcacctagttgtaagttatctctccgttttgtcattcaggaatgggttttctgagactttctaaagaaatatatattatcgttcagtttggctttggaaattttattattgccctatatttctagtaaagtaatgtagatctagtttgatacaaaccattctatacactacaccggtactatcagctttcacttttcacagctcccaaaacaaataaataaaagaaaatagctttcttttctatgccgtttctttctgaaatagtactaatctgccttacctttaatactatcccatagacccacctagtagctcttcccttacgagagagttcttttgatcagataaggtttaatatggaaaataaaaagaaataatcatttaaaacttgaccaaaatattttaaaaacatacacatatatactctaccttaacatatggtgaaaagcaatttttcctaaaatatattctatgaaaaaaaaattttggccaggcacggtgacttatgcctataatcccagcactttggaggctgaggcgggtggatcacctgatgtcaggagcttgagaccagcctggccaacatggcaaaaccccgtctctactaaaaatacaaaaaattagctgggcacggtggtgggtgcctgtaatcctagctacttgggaggctgaggcagggagaatcgcttgaacccaggaggcagaggttgcagtgagctgagatcacaccattgcactccagcctgggcaacagaacgagacctcatctcaaaaaaaaaaaaaatttatttccaatcagttggaaaatgtaagaatatgcaaaaatttaacagatttctttaatgtgggtttttcctagaacacctttttacatttcagaggacattagagttcagcaggacacagtttggtaaatattagtataaaaagttaggctcagccgggtgcggtggctcatgtctgtaatcccagcactttgggaggctgaggtgggcagatcacgaggtcaagagatcgagaccatcctggccaacatggtgaaacctcgtctctactaaaaatacaaaaattacctgggcgtggtagcacacgcctgtagtcccacctgctcgggaggctgaggcaggaaaatcgcttgaaccagggaggcagagattgcagtaagcctagatggtgccactgcactccagcctggcaatagagcaagactccatctcaaaaaaaaaaaaaaagaaaaaaaagaaaggagaaaaaagaaaaaaatcaggctctctgtagtcaaaagtcaaacatttttactgctaaaataaggcattattttttttccttgcttaattgccatgccaacttttattggttctttcctgtctcccaatgagttaaaaaagaaaaaagtatccaaatgtgttcccaccccaacccaagcctgtgatcacttctttgtttttttgcttccctgtaagggtatttctccctataattatactcacactttaagaagtaggagccattatactttattttcaaatttcaaattagaaagtgatttgggtttggaagcttgtttctgtctctggctatccaactgtttctcggctccaagatgtgaaactgtttcttcaccctaacggcaaaagggcacctgctattgagcgtgctttgagcgttattctcccaatagtaccctagataggtaagacatttttgaaatcaaaaataaacaaaaacttcttgttgtgatttctctgtataccaaaacatcctcttgacataaactgtgttatcctaatgacacagacaaacacaaattatcttcatttgggttgcagagttgggggtcatttcttgtgcttatgagcctgctattctgcaactgtgagatttcagacatgttcaatttgtggattttattttttattacacacacatgtgtagtattattgcttgtaataccttgtatgaatataaaaagattgtcatttttcaggtgtatattaacttcattaattttttacaattcaaatgatggagagattcctattgaaggatacttagctttttctaataattcagttatgattttatattcaatgtaaatgattttgtctctctggggccagattatcctatttaccttgaccccctaccatgacaatttaaatactgcatttaactgtagtatatgtaagattgtccttaacaaatatgagacttgaaaggttgtttttgtttgtgtcctctcctctgaagttttccttttaggatgacagcatacgatagatgtgttctagtaaagtgcttcttttattcatgaattacaaatagcttaagaaaatgtttaaagtaaagctataatgattagtcctggtagtctccattttattcagaatgtctctgtcagaaattatgtcatcactatggactgttagccaggaagttctgtctagcagatgaatgaatagggagtactgagttttctaataaaagacactgttgtaatattgaaatactgctaatggaggttgccagttttctgttcttaaatttacaggacatcttctgtgattaaagtaaggaatacttagagcaagtccttagagtaaaccaactataaacttaagaaaccggaaatagaattttttttttttaaacaatgccatttaagtccctaacttgtcttggttcagctgctagacatttgttcctttgtctcaaaaacgttagcagaaagcaataaatatagttcttgctttactcagctaacatctgattttatctgcacattgcttccatcttaaaactttcttaccttactagtctgaatggcttgtgtagcctaatactgttataattgtcagaacaaagggtttgattattttggcaaggaaaaaagcctggtaatagtatttgcatttcaattaattgtttcattctgatttgaaatgtgacttatgttagatacatctctgatccttccctatctcagtactaatactaatatgttgtatttccactacaatagcattacatcttacaaacatttatttcctttataactgacgtagagctttccacatagtagatatttaatataattgatggtttggaattcatacattttgtaggctaagtataactctcctactgtttcacctacttcctaagctagatttatctttacaggtactagactttatagaactaatggtaaattcagtatgcatatcttctgtagtaaacatagaaaaacatttttgtaatagtgctccccaaattttagtttcttgactagtaatgaaatatcttatctgtactagagttttgttatacaataatgacagcattttcatgtgctatgttatggccagttaactaaaaataagtggatatttaaaatggaaaatgaaattatcctgttgcctgaaatatcttgactcaggttctattacaggttgcatatggtatctgttagagctttgaatctatgttggttgttgagttattatgtgcattaactattgcattcaaaagttctttaaaagcatatgtctgttttaaatcttatacaaattccttgcaggttttgagagcagtctttttgtatgtctttcttgtttgttgttttgtttttataccagagcaccatgtcctaagcagcagtaaatttaaaacattgcttaggatagttttataatatcattaatagatttttatattagatagtttctctgaattattgacctattatagggaacatggaaaaatttagaaaaattagaagttatacggagtattaagaaaaaaactttatattttggtactcccaggaaaactaaaacctctttctaagagtatattttaggaaattttctaaaattttgtaaatcaacctacagagaaaaaaagtatagaaagtattttgaaatatttgtgtgtatatgtgtgtgtgtgtacacaagccacattttctcctagaactcactactgaaatttctgaaagtgattcaataagatatatatttcatatctggtttttaaaatccatagaatttttgtgttttgaccatcaggtagagtcttacagtttagtcacagtggaatcatcagcttcaaaatgaaagaacaagatagtctcttggcattcaaaaatttagcatactttaactcatatttgctgtgatgttaggtagtgaattattcttgttaactatctagcgtccaatgtgacatgtgtttgttgttacctacaacttatcaaataaacagttaccctctggaatgataagaacttgggctttttatgaaaaataccctctaaatgaggacagaaatctatattaaggataggctattgattaaatttagagatacacataaagatgactctcatataaaatttagaataaacatgaaagttttagcatgtccagactttagggatttaggctttatgaaggtctcaagcctgtctcctggaattccaacattgtgatgactcaaattttatcagtaaatatggaaaaataagctaaagttcttgagaaattgctatctaataagtgattattttattttttttctagttttaaaataaaaaatctttactatttattagattcaccagtgttttatactgggggtccccaacctttttggcaccaaggactgtttcgtggaagatcattttccacagggcagggtgggggaggggtggtttcaggattattcaagtgcattgcatttgtcgtgcactttatttctgttattattacagtataatatataatgaaataattatacaactcaccataatgtagaatcagtgggagctctgaacttgttttcctgcaactagacagtcccatctgggggtgatgggagtcagtgacagatcatcaggcactagattctcataaggagcacataagctagatccctcacatgcacaattcacaatagggttcgcactctaatgagaatctaatgccgccagttatctgacaggaggtggaggtcagacagtaatttgagcaatgaggagtggctgtaaatacagatgaagcttcacttgcacatctggcactcacctcctgctgtgtggcccagttcctaacaggccatggatttgtatccgtccatgtctgaggggttggggacccttgttttatacaattctaattgtgtcattgaatttcttttttcttttttctcattgttaggaggctaaaaacaaacttgtcttgtgcagattcgtcgtctttaccaccaaatttttgtcatggtatcttgtcttttttttacgtctttctaaactgccttaatccttgtaagggaataggtaaggtgtaaatataattaataaggtgcaaggaaatgttattagaaagaaattagattgttatttgaaaacatacagagcctaaatgtaagagaaatgtcctaagcaaaacttattaacaggaaatttactgaattggaaagtactcttgattttatgactaatatgaattgaggtattcttatagacactcagagattcctgtacacatgttacttgtgtttttccaaaactatatacgtatagtctttttacaaataaacagtggccaccaagaaaaattacagcagtacacataagacataccgtatacatgatactcaactttgtctatatcctttgtgttcaagtttctagaaattttcatctttgtaaggatatcatgtgagtgtgctcaaggtttgttctaagaatctagctgagcacagtggctcatgcctgtaatcacaataccttgagagtctgaggcaaaaggaacatttgagcccaggagttcaagaccagcctgggcaacatagggagacccccatctctattaatttaaaaaaaaaaattacctggacatggtggcatgcatctttggtcccagctacttgggaggctgaagcaagaggatcaagaggatcacttgagcctggaaggtcgaggttgcagggagccacagtcatgactctgcactccagccttggtgatacagcgagaccatgtctttaaaaaaataaaataagaatctatacacaattcatggaatgatgttgttttatagttttactgtatatttgtttctgtcataacttccaatatcccaaaaactttttaattatttttattcaagacatacatacagaagcaggccaggcacagtggctgatgcctgtaatcccaacatttttggaagccacgatgggtgggttacttgagctcaacagtttgatgctacagtgagctatgatcatgccactgcactgcagcctgggcaactatttaagaaaaaaagagagagagagagaagcagaaattcaaaggacactttttgaaatgcacttaatgtaaaggctgctttgcatggttaatttattcctattaaaggaatactacattcctgccacttttctaggtggtgaatttatagcagcgaccaggtaaatattgctgtcctcagggtgcttacctttcagtgggtaatgctttaaacaaaatatctagtatattagatggtaataagaaccttggagaaaaataaaacagaaaagagtgttcaggtctagcatgaaaggttacactttcaaatctgatcattagggaaagtctcacccaagacagtgatgtttaaaaatatttcaagaagcaagttgtgcacatattagggagaaaaacaatcagtgaataaatagcaagtataaagtctctatgccaggagcatagcatgtttaaggaatagccaggagattaatatggctagagtaaaatgagcaatgggaaaagtaagtaggagatataattacactgggaaagagtctaggggcatattaaataagactttataggtcattataaagactttgttgtttttgttttgttttgactctgaatgagatcaaaagcctttagagggttttgtgcagacgagaaacataacatgacttatattttagtagggttattctcactgttatatggacaaaactgaatggggcaaagatagaaatagggagatcactttggaggtcattgcaataatccagtgggagatatgatgacttggactagagaattagcaatggaggtgttaagatacaatcaggctctggatatagtgtgtaggtagatttaatagaaattgctgttgaattgaagaatagtttacgagagaaatgagtcaagggtggaagcttcattaactaagagagggtaaatggggataatttggtctagttttgtataaattatggggaaagtcttggtctcatagtttagcattccatagtacgttctccatagtgtataagtgataggttttactaatttaataatttttttgtctcaaacttgtgacttagactttgataaacttctgtttatgatagatggatttttaattgattttattgtttgtattttataatggattttaaggcatattagtgaaaacacaacttaaaatttattttcttaccttactaacattccaaaaaaggaacatatactgtataatgtttttttgtctcactaatatattcgtatccctcttcccccttcttggcaaacttgtctgaaagtatactgttgcatgttatgtcatggatgtaccggagcatgtgtgtaaaatacatgtcataaatggaagcagctggtttcctatgcagttaagagaagaaatgcatacagctgagctcttcaaacttcagaactcattggattcagtttctatcctgtgtaagcatgctatgatttcaaatagtacaaatgtataacaagttaccttaatagcttaaaaaattattttgtttcgatagttgaactactaaatctgttttattctctttccctctgccttcagtccctacttacctatcctacctcttgaaaagaacattacacctatagtcttagttttaaattcgaatctgaaaaggccttggcaagagttgggaaaaagttatcatctcaaagggaaaagctgaattcatacacaggaactgcaggattactctggcgttttactagtcccttgcagcactcgcaagtcccataaatacctaatggaaaaacagcagaaaatgagatctgcagcagccttttgagatcaaatttatgttgctgaacatttttttgaggttgagtgtaaaggtcaaaagaaagtgggtagattaaagttgctgatttttgcaaacttaaggccatttttaaaggtttctctttctgtagcaagaaaatttcaagataaatggctttgcttcattagctgaaatgtcatgtcttcctttaatatctgttacctgagacatttagtgatttagtggtatttatatacaacaaataaaaatctcaatccactttaacaaatctagataaatttatgaaattgcagatctttccaagaacagcatgatgataaattaatgtatatatacatgtttgtattgccatgtatatatgtatcttaaatgacatattttagatgtttttgtatgatacagaaggaaaagataataatcaaagttttgtatttttaaagtataggttattgatccagcagtgtaattataaccatctttttttaaaattatttcttatattaaactattacaatgaagataaatgacctcaaagaaaagatcgtgcatgtaatagcattaaaacaaaattcatggatgcttttaatggtctcttaccttttgaacaacattttaacacgttgttactggtgcaagcctatatctaagaaactgtgagttactagggtactgcagacttgatgcaatgaagaacaataaactgccatttctggacatctctatcctgagttgatagtacagaaagccaccacatatgttaacgtgaagttatagattatttatatctccagggcttgcttcgtgtctttgatttcgtagttcagattgcccagttattagtacttagaattcaaaagaataagataaaaaatttttacttaatacattcatttctgcatcacaataaagagttttcatggaaattatccagataatttcatagtagaataatatatgaaatgaaatcttttcttttttatggtagttgataattaatagtaaatctattcagtttatctctaagaagtcagattatgggagacttgtctctatttttctctatttaattttcccaaaaaaattcataaggaaaatattaattttcatttaaatctctatattaaacattaagtgatctttttatgccttggaatcacaatgaatataaatgttatttttattgtagttgattttgcagtttcaattcatttctattaaatattttaataaacatttttatgaaactaggtagaggtcacaaatctcattagtcactgacagccaattctcaaacccaggtcttttcctgtataccacatttcctcattagttctcactacactgtatggctatttccgcctcttaactttttatattttattacactcttaaagtacaactgtacttctcttctcaagtgcccttttctattcagtaagggtcccaggtgagcaatgattctgactggggaagagggagaagatggtgttgtagcaagtagtattaaaaggcccttaggaaggtagatagatgtataattttgtctctttcttctcactgttttcgtaaagacaaaggctatgccttaacttttttgccattcttatttttgagactacccattagggattgtttttgatgttgttgagatgaagtatttggtgaagccaaaacctccttgacttttatagttttaataagtttgtgctctccaaaccttcataaagtaatgtctagtgatcctttcagatatggcatgctgtcatgtcagctttaaataattgttaatggcatgatttttaacattttacctagttagaatcagtaaaatttattatatatactctttgctgatcagtagagcctcttatgaaggagtcagtatgatgtgctggatagagcattagatggcaaattgggcctcagatattattaggcatagttttgccactaatttgtataatgtgcaagtttaataacctttctgggcctacagttctcctcttctgaaatggaaagatgaataggttatctctaaagtctatccagatctaaagatctattttattatagaaaacttttaatcatacacacaaagatagaataaaaataaatggcattatgaatccctgtgtattcattacctgtcctcatatgttatcaatagtaaccccttagtatcttctaatacctagttcatattaaaatttcaattaaagtatctagtccatattaaaatatcatctcagtaataatagtttctagttgctttgttttgttcaaattataatctagacaaggggtgtgtgtgtatgtgcatgtgtgggtgtgtgtgtgtgagagagagagatctagttgtgtttttaagacttatggtcaaaaatacatatcataaaatttcccactttaggctgtacatggtggctcacacctgtaatcccagcactctgggagaccaaggcaggaggattgcttgagcccaggaatttgagaacagcctgagcaatgttgcaaaaccccatccctacaaaaaattatgaaaattagccgggcatgatagtgcgcacttgtagtctgagctactcgggaggctaaggtgagaaaatcacctgagcccaggagtttgatgctgcggtgaactgtgattgcaccactgcactccagcctgggtgatagagtgagcccttgtctcaaaagaaaaatattttttaaccttttaatttattttttagagatagggtctcactgtgtcacccagaactggagtgtagtagtgcatagcatagctcactgtaaccttgaactcctggggctcgagtgatcctcctacttcagcctccagagtagctaggactacaggcacacaccacctcacccagctcattttaaaaattttttgtagagctggggttttgccatgttgcccaggctgttctcaaactcctggcctcaagtgatcctcctatcttggcctcccaaaatgctgggattataggcataagccaccgtgcccagtctatcttaaccatttttaagtgtaaagtacagtaatgttaattgtatgcacattgtgtgcaatagatttcttgtacaaacaccttgcaaaacggaaactctgtagccattgaacagtaattcccctttgcccccttcatacagccccaggcaaccaccattccactctgattccgtgaatttgactattttagatatttcatgtaagtaggatcatggtttatggctggctttttatggctggcttatttcacttcccttaccatgatgtcctcaaggttcatccatcttgtagcatatgacaggatttccttctctcttttttttaggccaagtaatattccattttgtatatataccaccttttttttttttttttttgagatggagtcttgctgtgtcacccaggctggaatgcaatggcgcaatctgagctcactgcaacctctgcctcctggatttgagcaattctcctgcctcagcctccggagtagctgggactacaggtgcgcgcaaccacacctgactaatttttatatctttagtggagacagggtttcaccacattggccaggctggtctcgaactcctgacctcaggtgatccgccttccttggcctcccaaagttctaggattacaggtgtgagccaccgcgcccagccacattttctttatacattcatctgctgatggacatttagattgcttccacttctttgctattttgaataattctgcgatgaatatgggtgtgcaaatatctcatcaacatcttgttttcagatcttttggatatatttccagaagtgagattgctggcatttttaattttttgaggatacttcatagtgttttcatagtggctttgtcatctaacattgtcagcaatagtgcacaagcgtttcaatttctccacattctgtatcttctttgaaaaatatctattcaagccctttgacaatttttcatttggattctttcgggggtgaggtgttgtggagttccttatatattctgaatattgatcccttattggatatatggtttgtaactattttctctcacttcataagttgcctttttactctgttgtttcctttgctgtgcaatagtttgtaagtttggtagtcccatttgtcttatttttccttttgttgcccatgcttttggtgtcttatctaagaaattattaccaaattcattgctgtgaaacttttttctccagtgttttcttcttggagttgtgtagttttaggttttaaatttaattgtttaattcattttgagtttatttttatatacacaataaggtaagggtctaactttattcttttgcatgtggatatcctgtttttcccaccaccatttctcaaagaaactatcctgtatgcattatcagtactatactttttctttttttttttttttttgagatagattctcactctgttgcccaggctggagtgcagtggtatgatctctgctcactgcaagctccgcctcccaggttcacgccattctcctgcctcagcctcccaagtagctgggactacaagcacctgccaccacgcctggctaattttttcagtttttagtagagactgggtttcaccatgttagccaggatggtctcgatctcctgacctcgtgatccacctgcctcagcctcccaaagttctgggattacaggcttgagccaccatgcctggcctatcagtactatactgttttgattgctgttgctttgtgtaatatgttttgaaatcaggaactctgaggcctctatctttgtttttctttcttgagattgttatggtatttgggggcctttgcagttttatatgaattttagaatttttttctatatctgcaaaaaaatgtcattgggatttgtataggaattgcatgtgcaaaggaatctgtacattcctttcagtagtatggatattttaacagtattaagttccaatccatgaacacaggacgtcttttcatttattggtgtcttctttaatttctttcatcaatgttttgtggttttcaatgtaaaaatcttgtgcctccttggttactcataagtattttattcatttttaatgctattattaatatatttgttttcttaattttctttttgggttgttcattgttagtattttcaaacacaattaattgttttatgtttattttgtgtcctgcaactttgctgaatttatttattcctcctaataggtttttttgtatgtgcagtctctaggctttttatacatacaagattgtgttatctaaagaaataattctacttctctgtttccaacttgtatgcctcctatttcctctttcctttctttctttctttagctgactgctctggatacaacttccagcactactgtgttgggcctggtggtatgctcctgtagtcctacatacttggaaggctaaggcaggagaatcacgagttcaggagttcaaggttacagtgagctgtggtcataccactgcactccagtctgggtgatagagcaagatcccgtcggtaaaaaaaagtggcaaggggggcatccttgctttattcattgtctttgagggaaagctttctgttttttaccatcgagtattatattacccatcggcttttcatatacagtctttattgggttgaggtgatttcctctgtgccttttttttatttaattataaaaagatgttgaattttgccaaatagtttttctgcatcaatagagatgtcatctagttgtgatgtctgataagattcttctttctgtaagtcattttcctcccctccactccattttttagctttcctttggtttgtcagagaagccaggtcttacatttgtctcatataatgttctacaaggttcagtgcttccttttgtagtgttgttcctctatcacctaatttcctaataagacctagaaatgcattgtcgtctggtagctactagctacatgtggctctttacctgtacatttttaaaaattaaagtttaaaattttcagccattgtagccacttatcaagtgctcatatagccaaataggggtagtggctaccatattggatagtgaaaaggaacatttccatcatcgcagaaagtggtctcatataaagaactgatatgacagtgttttttccatactctattttgtctttttccacatgccagctatctcaacaccatttggggctatttttagatgtcataattttagccaatactaatgggtatttattgatatctcattgtggctattttttcatcaatagttttttgtttgttttggggggcagattttgtttgtttgttttcatttttttgagatagggtctcactctgccacccaggctggaagacagtgatgtgatcatggctcaccgcaaccttgaactactgggctcaggtgattctcccacttcaacctcctgagtagctgggactgcaggtgtgcaccaccatgcctaatataaatatatatatatacacacacatacatatacacacagacacacacacacacacacacacacatatagagagagagccactgtgcctggcctaaatagttttattttgaaataattttagatttatagaaatgttctaagatagtaaaaataagttccatgtactcttcacctagcttctcctaatattaacaccttaaataactgtaggatcttcatcaaagctaaattaacattggtacaataccattaactaaactacaggtttattttcccagtttcttaagtaatgtcctttttctgttccaggatctgttggaggatactacttgacatttcattgtcatgttgctctgtcttgccttctcttttgtggccttgacacttatgaagagtagaggtcagatagtttgtaggatatctttcaatttgagtttatctgttgtttccttgtaattagactgaaattatggggttttgagaataccaccactgaggtgattttgctttcccaatgtatcacatcaaggtgtacgtagtatcaatctgttactgttagtgtgaaccttgaacatcaagttaaggtggtgtccattgggtttctccattgtctatttgttcctttccatatacagttcattagaaatgaatcactaaatccaccccacacttgggggtgggggggtaaatacaaaatgaatagtgtttagaaacctcatagaggaaggatatagccaccacagtaattaataaatattagtggagagatattatgaaattatgcaaatattctagttttttaaagttttacccactgatttatagcatttattagtggatattgcctataccaattacaactatggtgttctaatggtgattttctatttccctcatttattctatatttaataattcaaattctttaaggaagatttgtctctttgcttccatttttaatattctttaatttttttttcgagatgggttctcactctatatctcaggttggagtgcagtggtgtgatcgtgactcactgctgcctcaaccttctgggctcaagtgatctacctgagtagctaggactataggcatgtgccaccacgcccaattaactaattctttttttaagaggcagggcctcactgtgttaccgagcctagtctcaaatgcctgaactcaagtgatcttccctcctcagcctcccaaagtgctgagatcacatgtgtgacccaccacacctactctgtattcgttttttacaaattcagtagtcttttcttttctttctttcttttcttttcctttattttctttctttctttttctctccccctttcctctcctttccttcccttcccttccctttctttcctttctttcctttctctcctttctccctcccctcccctcattctctctgtgtcatccaggctggagtgcagtggcgagatcatggctcgctgaaacctcagcatcctgggcttaattgatctcccaccttaggctcccatgtgtgtgggggtgtgtgtgtgtgtttgcatgtgtatgtagatggaatttcactgtgttgcccaggctggtcttgaaccttctaggctcaagcaatcctcacaactcgcccttccaaagtgctggaattacaggcctgagccactacacctggtttgtttccatttttcataaattctgcctggtgcggaggctcacgcctgtaatcccagcactttgggaggctgaggtaggcagatcatgaggtcaggagatcgagaccattctgaccaacatggtgaaaccccgtctctactaaaaatacaaaattaactgggcgtggtggcacgcacctgtaatcccagctacttgggaggctgaagcaggagaatcgcttgaacccgggaggcagaggtttcagtgagccgagttcacgccactgcactccagcttgacaacagagcaagactccatctcaaaaaaacaaaaaacaaagcaaacaaaaaaaaacaaaacaaaaaacccttaattgtcatttatatcaatagggctcatggatatttatttagttctttgggttataatctaaaactgtgtcacttttactactcaaattcgagatttaactattgagagctttgtcacattggcttctgtatcattgtgacagacctgtcatctttttattactttcttactttctggcactacaagatcatctagactttctgtaccccagcttgtttctccaaggatcactggttcactttatcaaagagaaggaccaggcatggtgactcaattctctaatcctaacactttgggatgctgagacagaaggatcacatgaggccaggagtttgagaccagcctggacaatgtagtaagacccccatctcttaaaaaaaaaaattagccaggcatagtgacatgtgcctgagacctagctacttgggaggtttaggcaggagaattgcatgagcccaggaggttgagcctgtgtgagccatgatcatgacactgcactccagcctaggtgacagagcaaggccctgtctctaaacagagaaagagagagaaagagagagcgaagagagaaagagagaaataaaagaagaaaagagagagagggagaaagagaaagaaaagaaagaagagaagagagaaaaaggagggagagggagggagggagggaaggtaggtgggaaggtgtttcaaaaccagcatctgagcactgttttctcgtaagctactggcagtaattgcttctaggttctctcagcagatagaattaggaaatatgcttatgtctgctaactcatgtatacatagacacacattgtatttaatcctgttacctatgtgtgtttataatatatataaaatcgtgagtttataatggtatctcttactctaattcagtaccacagagttcatgctagcatttccctttgacttattttaacttccttctctgatagtgagaaagctggctctgattatttgacatgtatttacttatttatgcaaacctagtatacatataaagtcgtttaaaaattgctggctgggtacagtggctcatgcctgtaatctcagcactttgggaggctgaggcgggcagatcacctgaagtcgggagttcgagagcagccttaccaacatggagaaactgcgtctctaacaaaaatacaaaattagccgggcgtagtgacacatgctgtaatcccagctactcgggaggctgaggcaagagaattgcttgaacctgggaggcagaggttgcagtgagtcaagatcgtgccactgcactccagcctgcgtaacaagagcaaaactccatctcaaaaaaaaaaaaaattgctgaatcatacctctgtgataaaccaatttaccagaatacaatgcttatatatagttctttttgtctttagcactatagtatgtaaaggaaatactgttggctacagttatttagggtcttttcattcccaccactttcagtaagtttatttcatacatatttaatacatttagactaatttatcacagtttgcattccatcttgggttcccttaacatcctaattgatatttttaaattagtatttgctgaaagaaacctaaaatattgctcctttacggtagttggtcccttccacctgccaaccatgggaaaagttaatctgtttttcatctctgtagtttggcattttctagaatgtcacatacatgaaattataaaatatgtagactagtggttctggcttttttttacttagcaaaattcatttaagattcattcttattgtgtgaatcaagtttgtgtttagtatgtaaaatatatagtttaaaccagatattttggggctgatttctgttattgtatggtatgctttctgtactatgaggattttttaatttgtttctatcttttgccatatcctcccactttggtttgtgtgtatgtttcttccaataatttgtgagacttgtatttttattcaagtgaccacatttagatctgtaacttcatgtaacatgattaagatttttttatttaaaaaaaggtcttttgagacatggtctcactttgttgcctaggctggagtacagtggcatgatctcagcttactgcagctgcaacttcccaggcacaagcgatcctcccacctcagcctcccgagtagctgggtttacgggtgcatgccaccaggactggctgttgttttacaatatgtttttagagatagggtttttccatgttgcccaggctggtctcaaactcctaggctcacgtgatctacctgccttagcctcccaaagtactgagattacagtagtgcaccactgcacctagccaagattttttaaaagataataagtattctttttcggggaattcttcattctcttttcctagaagatttttctttcccttagtgtttttaagaatacttagacctcaattacatgatttatcagcttttcaggatctccttgacccctggctataaaagatgaggaaatctttcttaccctcatagtctcacaccttccctctcccaattactctattttgtatatttgttcccgagatttataacatttatattgttctgtaaccaaacatattctcctccctcctgcaaatttttgatcttattcataacagttaaaaggcaataaacagaatcaatgtttatagctaagcctttcataatagtcattttatctcttggtttgctgaggtttgttctggtggtttcttcagaaagtcacatagaaactatatttcccaaattattttatgttctaaattttgtctcttcatttatacttacatggtagtttgaccagatacaaaattaactaggctatctttccttgaggaggtaatagacattgctcttttattatagggttttttggtttgtttgctttaatgagatagggtctcactttgttgtctatgctgatctccaactcctggcttcaaccaattctactgcctcagcctcccaaagcactgggattataggcattagccactatacccagcctatcttagaactgtatttatttatttctagagacagtgtttcattatcactcccaggctagagtgcagtggagccatcacagctcattgcagcctcaacctcctaggattaaatgatcctcctgcctcagcctcctgagtgtcagggactccaggcatgtgccaccacacctagctaatttttaaaaaaaattttcatagagatgagtgtcagtctgttgcccaggcttgtcttgaagtcctggccccaagcagtcctcccaccttggcctcccataatgctgggattaaagacatgagtgaccacacccagcaattctttaaatgatactttgaagaacctgagcacgcacatatatttcttccctctttgttagtaactctcagttccttatctagctttatttttctgtcacctggtgtatatattccttggattatttgtttgctgtcatctccatctatagaatgcaactatcaatagtaaagggatttggtctgatttgttctctgttgaattccaaatagcttgttagtgtttaatacttagcatatagctaatacacatttattgaattaataaggtcagaattcatgattctgccccattctccatccttataagtactttgatgggtttgattgcttacaaaaggattcgtttcacattttgaattcccgtgcctttactcagatatgtcttggtcttcactactgtgtgtcagtgttgtgctctttccaactatatttttctgtgctatttctagaaagttcttccacatgtatctttttttaaaaaatatttttttgagacagggtcttactctgtctcccaggctggagtgcagtggcatgatctctgcccactgcgacctctgcctcctggtctcaagtgatcctcccacctcaacttcccaagtagctggaaccacaggcacgtaccaccacacctatctagtttttgtattttttgtaaagacgtggtttcaccagttgcccaggctggtctcaacacccgggactaagcagagctcacctcggcctccaaaagtgctaggattacaggcatgacccatcgtgcccagcctcacatatctttatattaggattgcagcttctgttttctactattcccactggcctggtttatcattctctatctcttttagccactttgttttttgttggtttttttttttttttcattttttttctccctacccctctcttttagccactttgaattggtttgttttagtgtctctttgccatacagcagagaattttcttttgcttcctgaggcaatctgaatatactttcatgtcaataagctgctgatatatttggcctcaaacctgtcatgttattctataattactaaatatatatgtatactgtttttctgtgtgatttattatctctgctgtttttaaattttttattctggcattttggaaaggtttatatttcttttctagccattagcttttcttttaagtgtgctttttatggtggccttaatccccatttttcttataacattctactctccaatcagttttaaatgatatcctttgattctcacctattatctatacaacagtgattttattctgcatttttctctcacttctttgttttaaaattgtattacttctactttgtcagaatatgcagtgcttacaaactatgttctttccatcctttttaatttataattataattatcttattaaatgtaatgaggtttaccaacaacagtcctgtgtttgagttttcccccaatcatgcttggatgaagcttatcttctaatacatttctcaggaaaggcgtatgtgtacagtatcctctgtgttcttttttttctattactttatactttttcctacacaaagacagcttggctgcatataaaatccttgactttatttcttggaaataatgttctagttttgtcttgctttgtgttttgctcttgaagtctaaggcagcctaattttctttctttctttctttctttttttttttttttaaagagacagagtctcactctgtcacccaggctggagtgcagtgtggtatgatcatactttactacagccttgatctcctcagctcaaacaatcatccaaccacagcctcctgagtagctgggactacaggcatgtgccaccatacctggctaatttgttgttttttgttgtttatttgtttggttggttggttggttttgtttttgtttgttttttgtagagacagggatcctgctatgttgcccaggctgttctcaaactccaagcctcaaatgatcctcccacctcagcctcccaaagttttaggattataggcatgagccaccacacccagtccctagcctaattttcttattcttatttttctaatttcttactcttaattttatctttttgcctgtaggcctgaaaatactgtttcatcattaaggtctaataattttaccaggatgtgtcttagacctttcttgtttggggtcagtttttccaggtatgcaataataagctggaaatatagtttctagcttatagagtaatatggtagctcatgccttgcacatgcttttacaccagcagcacatcttttaaatgtgtagatttaaattttcatctatttctggaaagttttcttagactatattttaaatatactattccattgcgttattttttcctcaaggattctgtgtttatgttggatcttcttttcctgtcttccatttcatctactttctctctttgttatgtctttcttctctcattttcattcttttggttgtttgccttcattttttcagtgtacctttttagattttcactttattaatgtattcagcatggtgcactttgtaatttatttctgggattgttttttccttttattgcatttcttccctgattactttgtcctagtaatgttgaagacatggtcatatattgttttatttgtacttcttgtggcttattgagagaatacgaagataaatttggtttcagattattgccattatcctgaaatagattttgaactgtttttctgtgctactactttgttactctaatttaggaatgccatttatattatcttagattcacttttcctcttgttctgtccttttctcaccaatttattttattacctttgttagttcctatttcattttgcttgctttacacagtcctgacctccattttatttactatatttttatcagtgtttttttctccatttctttgatggttgcatttttctttcacactctcttgagcccagccagtttgtgtttcaccatctgttaatatgtttaattataacttctctatactttagtgtctctgcttaatagggataattgcttcatgaattttgtccatgcatttgcttataattgatgtgtgttccattactatatatttctgttaaatgtcttgtatgtgtcatttactttgctactttttttttcttctgtcctcatacaaattctgttctggttcctttttcatttctcatcttcgaatatggtattttcctacattagctattttacatgaggtttaattaaggaaggggttacacatgtatttcatactatgaagaattgtccatatgatgcacatatgccagttcaattaatggtcttaactcaggacaatacaaatagtacctattgtttcctaccactattcctaagcaccttatatcagattttcttttccttaacccttggagacatctagggaagattcatcgtagtttttagtcactttcagctgttaaggaaattgccctgcttttggttatttaaacaaattttaagtctgttgttaaaaatgtcagtcttaaactgtgtttgtattagtcctttcttgcactactatgaagaaatacctgagactgggtaatttataaagaaaagaagtttagttggtttatggttctgcaggctctacaggaaatgtggctggggaggcctcaggaaactttcaatcatggcagaaggggaagcaggcacatcttacatggctggagcagaaggaagtgagacaagggggagacgctacacactgttaaacaactatagctcattgaaaactcatgcactatcacaagaacagcaaggggaaaaatccaccctcatgatccaatcatctcccaccaggcctctcttgcaacattggggattacaatttgacatgcagcttgggtggggacacagaactaaaccatatcattctgcccctggcttctcccaaatctcatgtctttcctacagtgcaaaatagaatcatcccttcccaacagtcccccaagacttaactcatctcagcattaactcaaaagtccacaatctgaagtctaatcagagacaaggcaatctcttccacctctgagcctgtaaaatacagttagttacttccatgatacaatggagatacaggcattgggtaaatccctgttccaaaagggataaatcagccaaaagagaggggctacaggccccatgcaagtccgaaacccagcagggcagtcattaaatctttaaactccagaataatctttgactctatgtctcacattcaagccacactgatgcaacgagtaggctcccaagggcttgggcagttctgcgtctgttgctctgcagggctcagctcccatgtcagctctcaagggctggcgttgaatgcctgcagcttttccaggtgcatgatgcaagctgtcggtggacctaccattttgaggtctggaggacagtggccctcttctcaccattccaataggcagtttcccagtggggactctgtatgaggactccaaccccacatttctcctttgcattgccctagtagaggttctccatgagggttcacccctgcagcaaacttctgcctggacatcaggtgtttccatacgtcctccgaaatctaggcagaggctcccaagcctcatctcttgccctctgcatacccacaggctaaacactaggtagaagctgccaaggcttacagcttgcaccctctggagcagtggcctgagatgtatctggggctcttttttccatggctgggacgcagggagcagtatcaaggttgcacagggcagctggtccctgagcctggcctaggaaagcactcttcgcttttatgactctgggctggtgatgggaggggctgctgcaaatgtctctgaaataccttagcagcattttccccactgtctcggctattaacatttggctcatttttacttatgcaaatttctacagccaacttaaattcctgcccagaaaatttctcttttctaccacacggtcaggctgtacattttccaaactttccaaattctgtttcccttttaaatataagttccagtttcagatcatctctttgctcacatatatgagcatatgctgttagaagcagacaggatacatcttgaatgttttgctgcttagatatttcttctcccagataccataaatcatctctctcaagttcaaagttccacatttccctaaagaaggagcacaatgctgctagtctctttgctaaagcatagcaagagtgaccttcactccatttgccaagaagttcctcatctccatctgagacctcctcagtctggacttgactgtccatagcactatcagcatttaggttacaaccatttaacaagtctctaggaagttccaaacttacccgtatcttactatattcttatgagccctccaaactgtttcaacctctgtgtgttacactgttccaacgttgcttccacattttcagtcatctttatagccatgccccagtcgtaggtaccatttttccgtattagtttgttctcgtactgctataaagaactacctgagactgggtaccttagaaagaaaagaggtttaattggctcatagttccgcaggctctacaggacatatggcttgggaggcctcaggaaacttacaatcatggcagaaggggaagcaggcacatcttaaatggctggagcagaaggaagagagacaagagggaggtgctacacactgtttaacatccagatctcattgagaactcgctcattatcacaagaacagcaagagggatatctgccccactaggcccctcttctaacactggggattaaaataaacacgtgattcggatgggaacacaaatctaaacctatcagtgtttacattttttatttttattatttttattacaaagctcagctttccaatatactctgcttataaactgaaatttttaatattatttaaaatgtcaattctccctacagtgagccatagaatcaatgcctttccaaccaaaaaacaagatttttgtgaaactttaccatacatttctatggaaaagcaaaacggcaagaatattcaaactactcctgaagagggacaacaaagtgggatgtagcctaccatatatctgaacattctgtgatttttgtaatatagcagttcgctattaggacagtggtagaccagtgtaatgggacagagaggacagagacagatgccttcatttccataaggaaatggttgattattcaataaatggtgctgcgataattattttttcataacaaaaaagtgaaatcaaatttctgttttatactatacacaaaaatcaatttcaggtgaattatagatctaaatatgaaggtaaaatgacagagcttttggaaggtaacttttgagaatatctgtatgatctcggggtgtggaaaaatttcttaagcaggacacaaaagcataaaggcaaagactaataagttgtaccacattaaaattaagagcctttgtttatcaataggtacctttaaaagattaaaaggcaagccactgagtaggagaagacatgtgtgacacaaataacccagaaagaattaatatccataatatattttcaaaattttagtaatcaatatggaaaagacaacacagaagaaaaatagtcaaaagataccaacaggaaatttaccttagaagaaaatcacatgtgtattgaaggaatgaaaaattgttctacctcatcattaattagggaaatgcattagccgggcatggtggcacatgcctgtattcccagcaattcaggaggctgagacgggagtattgcttgagcccaggatgtcaaggttgcagtgtggtatgatcttaccactgcactccagcctgggtgacagagtgagaccctgtctcaaaataaataaataaataaataaataaataaataaataaataaataatcctttgaaaaataagggaaattcaaatgtaatccacaatgaggtatcattttataccagttgataaaaattttaaagtctaaaaatttcaaatgctgcataaaattagaattactgactcttacacacttgaagatacaaattccctactatccccagaaaatgttattgcttttagacactaattatatccaatatctagaacttagtctaataaactatgaacaaggcctctaccaagaacacttaaaacataattgtgagaacttaaaatgtaaatggaggtgtgttttaaagatgtttatttattagaagactcaatactgtaaagatgcaatatttgtccattttagtctgtaatttcaatgcaattctgattaaaatcctaacaagtaggggtgtatatgagtgtaaattgacaaactcatttttatatgtttttggaaagtcaaaggataataatagccaagaccatcttcaagacaaataagatgggagaatttactggtgatatggttaggctttttctcccatatccccaaatctcatcttgaattgtaatccctataatccccacgtgtcaaaggagagacctggtgggaggtgattggatcatgggggcggtatccttcaggctggtctcatgatagtaagtgagttctcatgagatctgatgatattataagtgtagttgtcttttccacacttgcacgctctctctctctctcgcctgccaccatgtaagacgtgtgtcttccccttctgccataattgtaagtttcctgaggtcactctagccatgtggaactgtgaatcaattaactcttttttctttagaaaatacccagtcttgggcagtactttataaccgtgtgagaacagactaatacaactggatattgagtcatcttataaagttaaaataataagacattgtgacattggtgcagtgataaataatggaacagaataggaaacccaaaaacacaccaacaggtatagttttccattttgattgttcctttcattagatgtttaaaactttataatgaatatgtacttttagtcaaaatttatttacttgagaagcaaagtgatgtatggattatggcctctgaggctataatgtgagtttgacccaaataatgatccaaatgtgagttccagtcccagttttgtcctatactactagctgtttgagcgtattcaactggtctgtggttcttagtttttttatctttaacacaagataataaaattacctctcagaattatggtgagaatttgacataacaagtataatcctgctggcacatgctgttcccttgatgaggggaatttgttattatgtttcttaggaacacaaaacttctgtttattcttggtaagaattcatgtttcccagatctatgtgtactatttgttatatttaaggttatcaaattgtatccttggtaatggttgccactggatcttttttggaatatgtacaactccttattcaaagtggctttctaatcatgattagttttttgtagttttggaagagccatattactgccctgcattcataaagcagtcttgtaaacactgattatgatagtgttttgaaaaattaaaagcctccaaaatcactaatttttaaaaaataatgcagttaaatatagaaaaggattagccatagatattttgtagttaaccctattatcattaacctaagtgaatagaacctaatttttgtacttgctaataattgctattaagaattttgttaatcgtgtgtggattggtgcttgagttcagaatgaatgattgataggggacaactctaagaaatacagcacttacattaatgttttattaaacagaaaaagctttaatgttttattaaacagattttaagagttacagtcttaaaatctttattatttattttatgaaatatttcattttgttttttttctgggcactttaaaattgagatgaggatggtagaatttgccagtttattttttggctattttttttttaacccatcttattttgagaacgaatttagtaatatttttctcaacatcctgaaattgtgtaacctgtagaaacttcccactgtctttttaaacttattcttaaataccacatttaatataggataaataagtcacaaagcttgcttatcaaaacagaatattgtattcagctttccatcggagcttttggggaagacatcacagtattgtactgtctcccaagatgcaaagtatcaggctttaaataatgaaaataagggaaatgccaatagaaaattagaaaaaatgttagaacagttaaaaacagcatactgaagcctgcattatttggcttatctaaaaatcatatgttttcaaccaatcagtacttatagtcattctatttaatcttttaagaaggagacataatccaccctcaccaagtgattcagtgtagcatcctaactaataatgacttaatgtgtgtccaaatggcatgtaatgagaagtatgaaacattgtctgtatactttcttgcctaagatacttaactgagtctaatcataaagttcagacatatcttcactgtggaacatttctacaagacaacggcctggactcttcaaaaatgccactgtcatgaaagacagtaaggagaatggaaggagactttcagattaagggagactaaagagacttaagcaaatgtagtattagatccttgactatatattagataatactacatcactgccacattttgtgcttatataggaaaatctccttggtcagtatgtatcataatagggtcataatgtctgcaacttattttccagtggtttgaggggaaaaaagacgtgtgtgtgtgtgtgtgtgtgtgtgtgtgtgtaaagaatatgttctaattgatacatatacgtaaatagcataggagtgttcatttgtactactctcaattttttctataggcttggtttcaagatgaaatttgaaaaaccttaagggaaaatatgtttaaagtatgataataacaaattagcacactagataaactttttatagcttttgtgagtttttttccttcagaaaatcatatttatgtagatagcaggattaaagaaaacttttctaaatttcagatgtcagaaatggagacatctaaattgtttttccatttcatctctaaatgctaatgaaaactggacttttacgacattaaagacatttaattgatctctgtgggatttcatgtttagcttttttcaacagctatatattgaacatttaggtgatgagattgagtagctaatcttagaggcgctctattgagattgtccagattccaaccctgatcccacaacttaccacctttgtgatcttggacaagtaatttgagatatctgtgcctcattctcctcaaatattcaacaggataataataatacataccagtttcttaggattgtagtaatgcttaaatgaattaatatatttggagcacttaggaaagagccaagtacatagtaattttctaaaaattatacctacttattatgtggatctttgctgaggaaatatgagtaagcatacaagactggacaggctttgagtagtgaagatgttttactcacaagcaaggtaattatgccttttatattaaaagaaagttcatatggaacactctgcttatatgcttcatcttcttttcaatcagataataagttctccaatgtagaagggaaatgtcagcctcacacataaaaatatacctgtcagagattatataagtgtcaaaataatactatctagagaaattcaggacatttggataaataaaggaatgtcatgtagtttggatagaacatagagaagtgaggaaaggagacattcccagatagaataacagctcaatgacttgaacaaggatacagatgcatgtagtatacacagtggactagaccatttatgtgtgtatgtacatatgtgaaaaaaagtctttgaaatgtttgcatttcaattaaattctgattttaagaacttattttccccctgtatcctgtgtgtgctagcattctgtttcctaaggcattctttcagacagacatacctagtcctgaaaatgctgctattattgttccagatacaaagcaggatgtcataattttttttttttactattccaactggaataatatggctcaacttaagttctgtacaaaactacttaatgataactcacaaaattaaaccaatttatattttctgcagttaaaatagaatgcacagatttttaaagacctaggacacattattatatctagttcctgaaatcattaaatgtccatggggaagaaaaaaacttgtgtaagtaggaataatataattggatttgcaatgctctcttaagagattctttaaaatcatgtgaaataagtagagtttctatgattttttaaaaatcacaaatagcatatatccgttttatctttaatagtgtttgagcccatcatttgaaagcattggagcatgtaaccaatatttctgaaaatgaaccatggttccagtcataatctatatgctttaaaattccttccctttattctttcttcccaaatccatgacatctgaatttcaataaggaagaaaataagcatgtttttaaaatgttttagaaaagattttcaaaattagattaaaatgtttgaggaaataaaaacttctttatgtattcattgtgatactgatttttatcaatgtctttttgtaaaaatacctatatactaactttgaataggtccaacatatggtaatgtgttatgcaattaatgataatgtagaacgatgttaaacccacagaatattgccaaggatttaccaacaaccaaaaatgtaattatatagaagaaaagtgtagttacaaatgcagtcttttgtctttttacattctctatatgtagagggtaacagaaatactgtatcactttttagtatatgttctcccagaataagttgccacaattagaacagagtttaggagcctatattaagctttactagttatggttatttccatagtgctagtaaataagagaaaaaaactttttgaacccatgtctcattgtaggtctcctaaaggaaagtggcccaaagtccaaatacttcaataccgttcgtctctgcctgataacaaagtgttttgtttttgtttttaccctcggacaagccagtcagctgatctttgtcctaatttgttcctggtagaattgaacaagatgtttgcagaagcttcctctagtttgaaaattgtattgattttttttccccatagtaactcacagatggcttctcaggttggaaataatggtgtccatgtttaggtaccacgtgttagatcagatttgtactcatggatctgtgattattttaactttttcttgttatttataaaaataattatgtacttctctctggggtttaatgtgtctttttattctcaaaaaatgtagtacattgatcagccacctaaaatactagccctatagaattctaatagttaggttttatatacagccatttgtcgattaaatattaaataccggatcagcttaaaatggacacacaaaaaaacactaccacataagctatacagtgccttttttcacagtgtcttataggtggaagatactcagtgagtgtttgttgagtgaataaaggatcttcacttggtgcatcccatttccttacaatttattattttttattttactttactttgagtcaggatctcactaggttgcccaagctggacttgaacttttagatccaagcaatcctcctgcgtcagcctctcaagcagctgggactacagggatatgtcactatgttcggctttaatttttattttattatgaaagttttcaagtagcaaaagcgatgtaatgaaccccatctacccattactgagattcaataattactaagattttgccacacttgctttatctagtctttaaagaaatttctccactgaatgatttactttaaaatacttgacctcctggccttttactctgtattttaaagaaagctgtagtaatttgtgacataaaccaatagagagcagctaaattttgttatatcttcatagcaattgactatattttggtttgtcttaccaataatttgatgaatgacctttcattttcaatttatctttggtaactaagtagataagtgggagtgtaggtttacttatttaaattctttgaatttgtgtgtgtgtgttgctttcccccccgatagaaactataaatggtagtgttattgtggttaggagtatggggctatggagttggggaaaacatgtatgaatctcagttctactactttaccttttgaatgtgggcaagacaagtctcagagttgttttagtttttttaattttaactttgaaataattgtagaaaaatagcaaaactagtttaatgaattcccatatgttaatatttaccacagctattgtatgtatgtatgtagagtttttttcctgagtcgtttgagagtaagttgcaaaaataatgcctctttaacctctaaatacttgaggtgtggttagtaaaaattcacgttttgttacataaccacagtatatttatccaaaacaggaaattaacatggataaagtattactgtcttatctagagatcttattcaaattttttcagttataccactaatacccttcatggcaaaagaaaaattattttattcttaggttgaatccaagatcacatgttacatttagttgtcatctctagaaactgctggtagtcctagctatttgggaggctgaggagggaggatcacttgagcccaagagttcgagtctgacctgggcaacataataagactctgtctcttaaaaaaaagaaagaaaagaaaagagacagaagaagaaaacagaataagctcatggactgttataaaggcaataaatgtgacataaaggatgctaaccaaaacagataaatagtaaaaggttaaataacagaggacttagctatttgcaagtactgacaaattttcatgattgggcaatgaatgatgtgacgttaacacatctgactttatctttcatgactttgatatttttgaaaagtataggctgcttattttgtagaatgtaccttaagttttttttatgtttccttatgattagatttaggttatgccttttcataaaatactatggatatgacctatccttcatgtaccatattaggaggtacatgatacctgttttatcctattgctgatgatgttaccctttgatcataacattatattttcaaatttctctaccataaagttaccattttccttttgtaatggatctcttgtgggaagatactctgagagtacctaactatcctatttctcattacatgttcacatgctagttttgacatccattcttcctagagacagttattactatggagattgccaaataatgatttgtttttcattccatcattttttctgcatttgttagttggctttcagcttcaatttttatatctgtaaaatgaacctaattgatgtaaaattggttaataacacccaaatcatgtagggtataagataatgcattttattttattttattttactttactgagacagagtctcagtctgtcacccaggctggagtgcagtgagtgacatgattatggctcattgcagccttgaactcctgggatcaagtgatcctcccacctcaggcctccctagtagttgagaccacaggtgtgcaccaacacacccagcatgtatgtgtgtgtgtgtgtatatacatatatatgtatatccacacatacatacatacacacatctttacatatatagacctcatctatatatatatatatatctcatctatatagaagagatatatatagagagatatatagatatagagagagatatagatatatagatatagatatagatatagatagacatagatatatatctcatctgtatatatatagatgaggtctccatatgttgcccaggttggtctcgaaatcctgggctcaagtgatccacccacctcagcctcccaaataatacattgatttgggacaattcttagcacataactctttaaaatattagatattataatttttattatgctagtatctacttttcagttgaagaaatagatcattttaaagatctttgaaaggtcataggaaatgttaaaaatatcaggtattttatgtgtacctaccatgaatgttttacctcatctttggtaaggtcagaagtgagatgatgtaacagccatcatatgtatgtgtattttttttattgacctgagacagtttttggttatttaatgcagaaaatatatttgcagtgtacttcatatgatatgcagtactttaaatacttgttgtaatgtggtcatttaataggagagaaacttagagacatggtaaattaagttttgatttagtatactgaatgatgaaatagaattatttatggtcattttaattctttaaaagtttttaaattagtattttaaaataatatatgtacacagtttactgattttgtccttaagggtatactgtggaaaagagcaataccctgccctgtactttgacagcccttttagctatttcttcttttacctacctccatatttttaatcacctcacctatccaggttagatattatgtacttaccaacttcctactatgataagataaatatttgtctctcttatatacatacattctgtcctctcctcctctccagttctccagtagagtttttgataaatcagttttcagcataaataatattatacagatgtatgtattatttatttctgagacaaattatattctatggtgttttacaacttttagtttctcctagagtttagaattcccttatctttttgtttccttaggtttctttatacctgtggtgacttccatacacatatcttccaatagcttctcacatttattttgtgcatagttaaaaatgtgagttttaatttgtaaaggtaattataaatcatgtgctctgaaagctttgtttttcttatttttttctttctctctctttttttgtttttgagatatagtctcactctgttgcccaggctggagtgcagtggcatgatctcagctcactgcaacctctgcctcccgggctcaagcgattctcctgcctcagcctcccaaatagctaggattacaggggtgagccaccacacccggccaagttcttttgatggctcacatccttcattaactttctgagaaaaaatacaagggagataaatattttgagaaccaaagtgtctcaaagtatctctgtttactcactctggattaatatatgggctccatgtggaattctagtgagaaaatttattttctttagactcttgaaaccattgctctattatattctaaacttacatattgtttttgagaggtctggttcttttttttcctaagcctttatatatgatctgccttttctctagaagcatttatgatctgtctctggttttctaaagtttcatgataaataataatgatgtagatctcttcattaattcattatattaatacattattccctataaatttagacaataagtcagttctgtgaatttttaaatgaaattttacttcctgggttgatcctctatttttcattttttctttctttttgatttttttttccttttttttctctttcattgaagttgagctttttgcatactcttctcaagtgtctggtaatgctggtagtgcatttatatttaagagtgatgcactagacaatgtacaaaatgagacctttcaacttccttagggtatttgagtaaaagacagctttttcataggggaagtaatttacatgcaccttctccagggctatttaatttctccaaggaaaaatggattctctaattttctttttgggtgaacttaagcctaagtactggtcaggaaaagggtcagaagggctatttggtatgtaagtgttcacataaccagcccagcctgttcttagttcagcacttcacccatttccctatcttcctttgtgcttggagttcctgagtctgaagcctttccagttctttcctagcctaccttccctccattattctgcagaggtaggaaaaggacacttgtcaggctatatgaggtgggaatggggtctgaaagttctgctgttaattatctccctattttcagctctactagttacctggtaccaccattttctgaattttccaaggtttggagggtgaatcagcttgatttttgttggaatctcctcttagtaggcttttatactttagctttcttccccctgctaatctaattaccttttctccatatactgtctgacctcagaaattgtaatccaggattatcagtatcttctagtttttttactaatatggttagttgtaatttttcattattgtcttgagatgatttttgataggagaatgtgcagaaatgtttatattttggcatcagaaatatcacctttggagggggcgagggggtcttacctaggctggagtgcagtaatgcagtcacagctcacttcagcctctacctcctgggctcaagcaatcctcctgcctcagcctttcaagtaacttggactacaggcatgtgccactgctatggttttgctctgtgtccccacccaaatctcaccttgaattgtaataatctccacatgtcaagggtgggaccaggtggaggtaattgaatcatgggggtggtttcctccatgctgttctcatgataattaatgaatctcacaagatcagatggtttaataagcatctggcatttccgctgcttgcattcattctctctcctgccaccttgtgaagaggtaccttccgccatgattgtaagtttcctgaggcttccagccatgctgaaccatgagttgattaaacttcttttctttataaattacccagtctcaggtattccttcacagcagtgtgagaatggacgaatacagccaccatgccacactatgtttttaatttttttgtagacacagaatcttgctgtgttgcccaggctggtctcaaactccttggctcaagtgatcctcttgcttccacctcccatagtgctaggattataggcgtgaaccaccatgcctagccagaaatactatcttaaaatcaactctgcataattcactgacccatcattaaaatttgtcagtacttaaaaatagctaagtcctctattattttatttaaccttttactgtgtagtttatttgttttggttggtatcatttaagcctcatttattgcctttacagcagtccaaacagaacctattctgttttctttctcctcctctctcattttttttctcttttttaagagacagagtcttacagtgttgcccaggttggactcaaatgcttgggctaaagtgatcctccctgctcagcctcccaagtagcagagactacagggactacgggcgccaccttgcctagctccccctctctcttatcttctttaccctagttaaattatttctgctttgtcccaaaaaataatatttgtacattactctccacatggctttatggtggagtaagggtgatgcttgagtgtaagaagttttacactgggatgtggtacttttccttttttcacttatagttgttttgaagtttgggcattctttttgtcttcaaattgtgctgaaggcatggtgtttttgtagatttatttttctgtccttgttctatattcttttggagagaaacagggcttaggtggcaaccattgcttcagctgtctggaattcctcaatttattttaactttatataccatcttttctcccacctctctcttcattataagcagactcattcattcacagtatgtttagtgagtgctatgtgccaggcatggttctagggatatggtaatgaacaaatgtctttgccctcataaatattatattctggtggtagagacaaagaataaaacaaaaaagtgaatatatactataatgttaggtagtgattaatgctatgttttaaaaaaataaacaagatgagtgcagtggtacactcctgtagtcccagctgcttgggaggcagagacaggatggtcacttgagcccaggagtttgagtagccactgcacgtcagcctgagcaataaaacaagactgtgtctctaaaagtatagatatatcaatcaagaacctggggaagttctagtgctacctacaagagttgaggaagaccttttcttttttttttttcttttttttgagacggagtctcactctgtcacccaggccggagtgcaatggcccgatctcggctcactgcaagctccgcctcccgggttcatgccattctcctgcctcagcctccccagtagctgggactacaggcacctgccaccacgcccggctaattttttgtatttttagtagggatgggatttcaccgtgttagccaggatggtgttgatctcctgacctcatgatccacttgcctcagcctcccaaagtgctggaattacaggcatgagccactgcgcctggccaaggaagacctctttgaaaaagtgttacattagcaaattttgttttgttatagaatagtaagtacatctttttatattagcatttaccttatgtaaatcattaagattttaccactgatcaggtttccatgataaattgtttaattttaaaacttctgtagtagaatgggcatgtggtgttatggaattcataccaaataagaagaattttacagaaagtaaaaccataagctgtctactattcaactcttctcattctgctttagagaactgctattgataaaagattatttgagaaacatataatctatccttttctctaataactctacactttattttttatttttattatactttaagttttagggtacatgtgcacaacgtgcaggttagttacatatgtatacatgtgccatattggtgtgctgcacccattaacttgtcatttaacattaggtttatctcctaatgctatccctctccccttcccccagcccacaacaggccttgtgtgtgttgttccccttcctgtgtccatgtgttctcattgttcaattcccacctatgagtgagaacatgtacactattcacaatagcaaagacttggaaccaacccaaatgtccaacaatgatagactggattaagaaaatgtggcacatatacaccatggaatactatgcagccataaaaaatgatgtgttcatgtcctttgtagggacatggatgaagctggaaaccatcattctcagtaaactatcacaaggacaaaaaactctacattttatgcttggactatcagaaaaactgtttacttgaaaacagtttacagaaaaactctttaccctgacatgtattgatttgttgctttgtgttttttgagacagggtcccactctgtcacccaggctggattgcagtggtatgatcatagctcactgcaacctcaaactctggggctcaagcaatcctcctacctcagcctccctagtagttgggactacaggcgtgtgccatcacacctggctaaattctgagttgttttttatattgaagccttaatctttcattgaggaataccacaataaacagactgagcttgctgttgagaagttgttgaggacaacatagtcttctgtattaatgtttaacatattaaagaccctatgaaaagtttattttagaatcacgtgtttcttataagaaagtgacatttttggccgggcacaatggctcacgcctgtaatcccagcactttgggaggccgaggcgggtggatcacgaggtcaggagatcgagaccatcctggctgaagcggtgaaaccccatctctactaaaaatacaaaaaattagccaggcgtggtggcgggcgcctgtagtcccagctgctcaggaggctgaggcaggagaatggcgtgaacccgggaggcggagcttgcagtgagcagagatcgcgccactgcactccagcctgggcgacagagcgagactccatctcaaaaaaaaaaaagtgacatttttatctcttcaagcatgaaaagtagataactaggcatgtcttactttttgctttcactgtcaagaaattggaaacaaattcagagctaattcaagacgcctctgccatgtatttctttttctccccaatcttatactgttctgttttctctgatcattttttttaggttgtctcactaattatggaacaatggcagggatgtgtatgaaagagtgagcaggtagataagtcaatagatgaatgctgttgcctcctcaaatcattagttgtatgagcttgggtgagttaaacaacctttctgcactgttaatttcatctgcaaaatgagaggattaatagatcaaatatttgtagctgcagaactctgttttcatgggaaataatttggaagcccgaaatagaagccaagtagtagcagaactgttgtgtcaggccagtgccatagtggccgggaaactaagcctcattttttatccagatcatattagaactgcctcttggaacaaagaaacactacctctagtgtttctgcaatacagtgttctgtattacagccttgactactctactttttcccccactccagtcaagttttacattttgtagtaggcctcctttttgccatcttcgtgaagattctgaattttcctggatggataaaaatcataaggataataaatggatatttcagtgtttttttagtcagtggtttgcaaaaccacctggagggcttgggaaaacacaggttgctgtgtcctacccacacaggtttctgattcagtaagtctggggtatgaccaagatattgcattttgagcaactttccgagtgattcagaaattatactttgagaactactatcctatgtgagtattaaaaatgtattttagtcacttttcttattttaaaaattacatcaaatcatataacttcataaagctcagaaaacaatgtctgagtaatatatggtttttgaaaaataacatttaagtgacatattccgatgtcatggagcaagtgagaaactggtttgaaatgtttgctatctagtgtcaagggctatctatccctttttgacttcttgtgctactggtgcaaatggatagatattaatcctgcagcaatcaggatttgcttcagcaataaagaaattattgatgtctgaaagcaatcctttccttttgacatgttggcagcacctaagaagaaaatgtcagggtcaatataagtgcatttactgacagtttggctctttcctatgttacagaaaatgatttcacatttagcttttatcaaaaacagaaacactgaccactctgaaggatataaacaatagctttcagcttagtcattttccacttataaagtgatactttcatagaaataaacaatgcaaacttcagagagccaaaacaattacacagaaaaaaatcattgcatttttgccatttttaactcagatttaaaacaactgtgtctggtagtaactggagaaaaatcactgttttgtgttctgttaagttaaaacagttaaaatcactttatgataaaatatggccaaaaagaagaatcatcttcaattaggtacttcaagatcacttgtattctctgcttctctttcagagcctgatccatgtatttcttaaacttcttcatcatatataaaatttcgtgtttataaaatttccactaaaacctcaattattagtttcatgaatcagaagttacaattagtttcatttctggctcaccaagatttgtcaatttctggataaaagggactccctattcagaatatccctttaaatcttttttaaaagtgcacctttgatgtgtacatgtttttatgttatttatggcttctgaaaatattatgcaaaaaaattgttatggaaacaacccaaatgtccacaagcaggaagatacattgtgatagatccatacaatggaatatcattcgttcataaaaaagaataaagtactgatgcatgatagaatgtgagtgaacctcaatatcaagaaaatggacgaagccagacataaaggatcacatattgtatgattccatttatatgaagtatccataataggtaaatccacagaaacaaaagcagattggtagttgccagggacttgtggggagtgaggaatggggaataactttttaatgggaagatagggtttcttcttggggtgctaaaaatgttgagaagtagatagaggtcatggttgcacaacactgtgaatataattttatgtgaattttacctcaattttttaaagaaatcagttgatttaagacttaactgaattctagaatttttgaaatgaaggtgtttctcaaggtcatccaacccaatctcctgtttttcacaaatgaaaaaactaaaactcatcaagattaaatactatatatcactaagattgcctagtagctagtccaaacccaggccagaatttgagtatctggatttttagcccagtgatttctttttaaactactgcatgctgctttattatcaattgctattttttttaaatttttttctgggaacatactacaagtgttagtttaaaagtaaactaacataaaagtaaatacaaaaagaagcatagcttcctttgtgccacatataagaaatgtagacatagagagtgtttattgcagtaatttgccaaaaagcaagccatagtttaaattagaagaggtttattccctgcagcactttcacaatcacagaaggcacctatattttaaatgtagtctacattggcctggcttatgaactgcaaccttctatgattgcaattcacttttttaaattaaaaaaaatttcaaaataatttttgcataattattagcacattctaccacttgataattttttgtttctttcaatagacgaaagcactcacattgtaaaaaaattatataaatgaccttgtcttgtgatgaagctagaagatctgttttcaacgaaactattctcagaggcatctagggagaaacatttgagtcaggttgggagttagagatagaaagcagcagcaattaaagcaagataatgtattaccccctggaaattgggtgttatactcaaatgtaaaggacttgtattgatttagtgctagcctcagaaaatagtcagatgtcctcattttaagggaaaactttaggaaatgtaattatatcgtttctttctctctaaatctgccttagttttcaatttctttatgtagttcgttactaagaggaagctacactctcattaccacactaaatggattttctattaatatttatctccaatgttatttttatctgggttgttgttttcatttctacttagtatgtattttcttctttccttttagttcagaggtcaacaaagtatggcctatgagccatacgctacaatagcagagttgagtggttgcaacagataccatgtggcctgcaaacctaaaatatttattggggcattttacagaaaacacttgccagtccttgctttagttgaccaagtagaaaaggaagagcagattctacagagtgaataaatatcaccagcaaaggaaaggatatagaaaggtacaggatttatacttaggctagctagaaactccatatggtcaaagtaagagttttgtggatgtgagtcatcagagattatataggaaagatagattactgtcagatttagaggatttttaatgccacttcaggaacttgagctactattgtttaggaaatgagtcatttaaggttttttgaacaaaggagctttgccagagcaggaaagtgttgcagtagggtttacaaagtaatgagagttatcaactaaagttatattaataggaaggatgacatagttccaggagttgctgtataattaaaattgataggaccttagacactgcattttgagacaaagagataatagtttaaagattaaaacttcattgggcagaaaaattattatttatacacatattagggaagtaaagagctaatttttgtggaaggtttaagttgatggagaaggattataacactacataggataagaaacaaaactgattactagttatcagcattactgaagttgttcactcatcccaggcacaggcaattttttactcgccatattttatctccagggcacccagctgccatcatcttgtcagggtccatctctttataaaatcctcttactttgctctccagaatcccaccctgatacacagatttacttacgctacctcatacagaataaagtacttccattttccaagtactctgaaccatgctcaagaagggctttagctctctcaaataaaaagacttatctcaaggtgtttaattcaagtagagccacagttccgaaactgtgcactgacaccccagggtactgcagcagactcacaagagtgctacaggatattttatatcggtttcaaaattaaattttgctacattccttttggatgatgtctttttaaaaaataattactgttgttgttttttttttaatatgtacctcctgaaaaatcaatgcagaatgggaaatgaaggtagcagtatccacttggaatacaaggcttgaagagtgtgcagtattccataagcatacatattcatttagtaaatacagttaacccttgaacagtgccgggggttagaggcactcccctcccccgggtagttgaaaatccatgtataacttttgactccccagaaactttactaagagcctactgttgaccagaagccttacctgtaacattaatcattgatgaacatgtattttgtatattatatgtattatacagtgtatttttgtaacacagtaagctagagaaaagaaaatcataaggaaaatatattcattgatatggtttggctctgcttccccactcaaatctcatctcgaattttaatccccataatctccacatgttaagggagggacctgttaggaggtcattagatcatgggggccatttcccccatgctgttcttgtgatagtgagttctcgtggaacctgttagttttataagtgtttgacagttcctctctcatgtgccctctctcgcctgctgccatgtatgacatgcctgcttccccttctgccatgattgtgtttcctgaggcctccccagccatgcagaactgtgagtcaattaaacctcttttctttataaattagtcagtcttgggcagttctttataggagtgtgaaaacggactaatacatttattgttcattaagtggaggtggatcatcataaacatcttcatcctagtagtcttcacactgagcaggctgaagaggagggtggggaagagctggtcttcctgtctcaggggtagcaggggtggaaatgatgaaggaggtggaaaggatggcagaagaggtaggcatactcagtgtaactttacagaaatacgttgtaatttctgtcttatttttcatttccctaaaaatgttactctaaaaatgtttctatatggcacctatccttccaccttttgcttttggttcagtgcccatatcatagaagggtccatgttgtaaaagaagtcaaaagcagtcttttgaataactggaatcattctgttatatggtctaatatgaatttgtttctggcactacttattctacatcttctttctcatcatctggcactgatttggaagcactcatctccatcaagtcatcttctgttaattcctgtgatatggtgtctgttagctcttgaattactccaagatccgtatcttgaaactcttcaacttccccccacttttttttttttttttttgccatatccacagtctcttttatgatatccttgattgactctgttgtaaatcctatgaagtcatatacaccattggacacagtttttctctagcatcaatttatttttttgggcttgatggctttcatggctacttttgtaacaatggcgttttccatgatttgattctttcagatatccttggtgttctctaagttgaggtctacttccatagcattgacaatcttttctatagattaccatgtgtaatgatctttaaaggtccttatgaccccctaatctagatctgaattagagatattgtgtttgatggcaagtagaccactttgacacctttgttgttgaactcctggtgtgggtgacccggggcattgttcaatatctaaagaaatttaaaagacagttccttactgacaaggtacttctttgtcagcagaagttacttctcctcttatccattttttgaagccaaacctctttctaaaaatgtcaagccatcctttgctgacattaaattctccagctttaaatccttcaccttccttttgctttaagttgtcatataatgacttcaagtcttactagagtatgcctttcttatagcaattctgtactcacattgtattttaaatataagataaaaagatattttacagaaacttcaaggttttcatgcctgctgtcgtagctgcagtgatggctccacaaagtcctcccccaaccacaatggtccttacactggattcatctatcttgaaatggtgggcaaccacagctgcagacctcaatctacggtacatatcaagcaagtcagcttttttttgtaatgatttttctctgcttcttgggagcacttccagcatcactagtgacatttcatatgggtcccatggtgatgttcaagatttacagtattgcactaaacatgatgaaaaataattcaagaaccatgagagatcactttttattgcaatatgcaatttactgtaagatgtagggttcactcagagatgattagcatcagatgtcattttcaatggatacaacacttgagctcactgcaaaagcaacaggtggtagttacaacgttgttacaatagtacagtatttactgcagttcattttatgcagttaggatttaatactgaatttttacatttgtttacatttctcttgactcaaatgctgccgtgtatggtctgtaagtgtttgcctgtgtaagttttgatagattttaactttttataatacatttttatagttttatgatagtgataaaatagtatctacatatactttatgagttcatgacatacttaacaatttttatcaatatttctaggctacacagtttgtctgtagagtatttcaaactatcacaaatttccaaaaaattttctgatatacttcttgaaaaaatttttacacacaagtggatccatgcagttcaaacccaagttgtacaagggtcaactgtattgtagttattttttaatgagattttaaaaacttttttcaatttatatgtatttttcttaactgagtattaaattctgaagctagtacttattaaattgtttggacttaacattaaacaggactgttaggcatttgttagcataccatgaaaaaatgaaaaaaataacaaaaacactaaaaacactgtaaactgggaaagtttcagattctctgaatttgagagagttgttcaactctaaaatgaatgcattcttccataagcatgtgaaaaggcagcagtctttcttttttctctttttttcaaaattgctttctagactgggcacagtggctcacacttgtaatcccagcattttgggaggctgaggtggacagatcgcttgagcccaggagtttgagaccagcctgggcaacatggtaaaaccccatctctacaaaacatccaaaaattaaccaggtgtggtggtgcacacctgtagtctcagcttctgtggaggctgtgaggtgggagaatcgcttgagcccaggaggcagaggttgcagtgagccgagatcgtgccactccactccagcctggtgacagtgaaatcccctctcaaaaaaaaacaaaaaaacaaatttgaaaacacattctagtgacatgggattttgtgtagcatcttaacaaaaatgtaatcacatatttaaaaattttctgtgctttttgctgtatcaaacaaaaaaagtaagaagtgctcttccctttaaggttatggtcaggtcagagtggtaagacaaatacaagttgcttatatcattaagtaaaataaaataattaccctcatttatttcataatatcacatattatgggcattcaaagaagaatgtgtacatctgttagtgggaatgaagaaagaatttgttagattttaaatgggcattgacatgttggtaaattctaacatgtagaggtagtggacatttcagatagaaggaaaaacataaaaactcaagatttattttgggagaagcaaattattctatatgactgaagcaaggacatatgttatgaagtaatgtagattacagctggtttactataagttggagtactatcgtggagcactttgaatgctggggtgtgaggcatttggattcaatttactaggaaaagaagagtgattagggtgattaatctgtcagcaagatataggatgattaaatcaaggagagaaaggaggcagggatagctttttaaaagggaatgatggattttgctttatgtatatgtatttcaaaggaaacaccaaactgttgatctttaaagagcatacttttgttcagcactgtaactaacagttgtaacataaaactcacttttctgatgggaggcagaagactttctaactttcttgttatttctagaggaataatatcaatacaatgtaaatatgtatggaatgcatactataggccaagaactatattaagcatttatttaattctcacaacccttgagagacattattattcccattttacaggtgagaacagtaaagcctagtaaagttaatgttgtccagagtcacatagttaataagtagacagattagcaaaaatttttaaaataagtttactagttggtttaaactaaggagaattgagttaattctccttgggtcttatcaaattatcttcatctgacttaggcatagtttctctctttttttatttttcatatcactcctgatctcttcccaccatgggtactcttaatgtgtttgatatggctcttacatttggatgtgtcctttaagactgtattgtgttattttagatgcatgcatatgtgtttaaattatacataatatataaaagggtaaattatagcttgtctgatttgatatatatgtttctactctattgcttttatatttttattttataagaaacacacatttttattttataagaaacaaggtcttgctattaatatgttaccaagaccagaatgcagtagttattcacaggtgtgatcattgtgcagatagccttgaactcctggcctcaccctatcctcccacttgagcctcctaaatagctggaactacaggtgcatgcagctgggcctggcttagtttactgcttttttaaaaataatttacaaataataattgtacatattcatggaatacattatgatttttttttttttttgagacggagtctcactctgtcgccaggttggagtgcagtggcgcgatctcgcctcactgcaacctccaccccctgggttcaagcgattctcctgcctcagcttcctgagtagctgggactacaggtgtgcaccaccatacctagctaatgtttgtatttttagtagagatggggtttcaccatgttggccgggatgatctcgatctcttgacctcttcatatgcctgcctcagcctcccaaagtgctgggattacaggcgtaagccaccgtgcccggcccataatgatgttttgatacctgtaatgtatagtaatcagacagggataaatagcatatccatcatctcaaacatttatcatttctttgtgttaagaacatttaatatcctccatctacctatttaaactatttaatatatttttgttaactaaatagtcatcctgcagaggtatagaattctataacttactcttatctagttgtaattttggtatcctttaacaaatttttccctatccttcctttccccctactttcccagcctccaatatcctctgttctaccttttacttctataagatcaacttttttttatcttctacttatgagtgaaaacataccatgtttaactttctgttcctaacatttcacttaacataatgtcctccagttttatctatgttgccatgaaccacaggattttatgcttttttatggctgaatggtttttctttgtgtatacattacacattttctttatccattcatttgttgttggacacctaggtttgttccatatcttggctattgtggatagtgctgcaataagcataggggtacacatgtcccttaaatataatgatttccattcctttggataaattcctagtagtaggattgctggatcatgtagtagttctacttgtggtttttaggaaactccaactattctccatagtggctattcccaccaacaatgtattaagagttcccttttctccatcctcaccaacatttttttttctttttgataatagccatcctaactggggtgagatgatacctcattgtggttttgatctgcatttctctgatgattagtgatgttgggcactttttcatatatttgttggccatttgtatctcttttgagaaatgtctgttcagatcatttacctattttttaataagattggttttttgctattgagatgtttgagttccttgtatattcttagtattaatcccctatctgatgttatgaatagtttgcaaatattttttcccattctgtaggttgtcttttcactctattgattgtttcctttgctgtgctaaagattttcagtttgatataatctcatttgtttatttttacttttgttgcttgtgcttttgaagttgtattcataaaatatttttccagatcaatgtcctaaagcatttcacctgtgttttcttctaggagggttatccttttaggtcatatatttagttctttgatcatttttttgagacagggtcttgctgtgtcacccaggctgcagtgcagtggtgcgataatgactcactgcagccttgacctcctaggctaaggcagttctcccgcctcagccagctgagtagctgggactacaagcatatgccaccatgcctggctaatttttatattttttgtagagatagggtttcaccatgttgtcgaggctgatctcaaactcctgggctcaagagatccacctgccttgacctcccaagatgttgggatcacaggtgtgagccaccatgcccagcctctttgatccactttgagttgatttttgcatgcagtgagaggtagaagtgtagtttcattcttctgcatatggctatccagtttgctcaggaccatttattgaacagactattcattccccaatgacaattcttggcacttttgtcaaaaatcattttgctgtagataatgtggataaatttctgggttctctatgcctttccattggtctatatgtctgtttttatgctggtaccatgctgtttgtgttattatagctttgtgatatattttgaggtctgatagtgtggtacctccagctttgttctttttactcaggattgcttcagctattcagggttttctatgtttccatacaaattttagaatttttttccatttctgtgaaaagtgtcattggtagtttgatagggattgcactgaatctatagatgtctttccatttatttgtatgcacttcaatttctttcatcagtgttttgtaatcttccttgtagaggtcttttatcaccttggttcagtttgttcccaagattttattttcttttctagctattgtaaatgaggttgcctttttgaattcttgttcaactactttgttgtttatgtacagaaacactactgatttttgtgtgttgattttatatcctgcaactttatggaattcatttatcagttctaagagttttttggtagagtctttaggctttttaatatgtagaatcattacatatgcaaatagggacaatttaacttccttcttctcaattttgatatggtttatttctttctcttgcctaattgctgtggctagtacttccagtactatgttgaataagagtggtgagagagggcatcattgtctgttccagttcttagaggaaatgctttcaggtttcagtaagatgctagctgtgagtttgtcatgttgaggtaatttcaacatgttattatgttgaggtactttccttctatacctaatttattaagagtttttatgaaggaatattaaattttatcaaaagcattttctgcttttcattgagatgatcatatgatttttgtccttcattctattgataggatataagacattcattcagtgacatatggtggaccatctttgcattcttgggataatcctcacttgctcataatctttttgagacactgttgggttcagtttgctagtattttgttgtggacttttgcatgtatgttcatcagggatattggcctatcattttctttttttgttttgtccttatctgtttttggtatcacggttatgttggcttcatagaatcaattaggaagtatttcctctgcttcatttttggaataatttgggacaaattggttttaattcaacagtgaagccatccagttctggactttttttttttttttttggtgttggaagactttttgttattaaatcaatcttgtttcttgtcattggtctgtttaggctttctatttcttctttcagtcttggtaggttttacgtatccaggaatgtgtccatttcctctaggttttcaaatttgttggcatatagttgttcacggtagtctctagtgatcctttgtatttctgtagtatcttttgtgatgtctccttttttgtttcctattttaattatttagatcttctctcttttttcttattctagctaatggtttgtcaattttgtttagaagccagctttttgttttgttgatcttttgtattttttttgtcttatttttgtttatttctacactgatcattattatttctttccttccattaattttgggtttagtttattcttttctagttctttgaggtttatcatcaagttgtttacttgaaatctttcttgttttttgatataagcatttattcctataaacttgactctgaatactgtttttgctgtgtcccataggttttggtatgttgtgtttctgttttcctttgtgtcaaagaatttttaaattttattcttaatttctttctttatccattggtcattcaggagcatattgtttaattttcatgtaatggtatatttctaaatgattctcttgttatagatatctaagtttacgccattgtgttcagataagtacttgatattttgatcctttaagaatattttgagacttctattgtgtccttacacacgattgatcctgagactgttgaatgggctgatgaaaagaatgtgtattctgccactgttggctgaaatgttctataaatatctgttgtatttagtctatggtgcagtttaactctgatgtttctttgttgactttttgtctacataatctgcccagtgttgagagtgggatgttgaagtccccaactgttatttcactttagatctaataatatttgctttacatatctgggtgcttcagtattgggtgcatatatatttacagttgttatattctcttgttggatcaatccttttataattatatagtagccctctgtcttcttttacagcttttgacttgaagagtgttttacctcgtataattatagctattcctgtttgcttttagtttccatttgcactgaatattttttccatccacttccagtctgtgtgtgtatacaggtgatacaagtttcttgtagatagcatataattgggtcttgtttttttaaaatccattcagctagtatgtatcttttaaatgtggaacttaatctatttacaatcgtgttattattgataggtgaggacttactcctgtcattttattgattgttttctggtggtttgtatatcctttgttcattactttctctcagtgttatttttgcagttgaatggttttctctagtgaaaaggtttgattcctttctccttctcctttgtacagcagctctatcagtgtgttttatagtttcacatattttcatgatggtgattattgtttttcatttccacatgtaagacccccttgagcatttcttgcaaggccagactagtggtgatggattcccttagttttgctagtctgtgaaatattttatttgtcctttatttctgaaggttagctttgctgggcgtattcttgggctaataatttttttcttctagtactttgactatattatcctgtcctctcctggactataggatttctgctgagaaattcactgttagtctaatggggattcccttatatgacttgatgcttttatcttgctgcttttagaattctttctttgtctttgacttttgacaatttaactgtaatgtgccttgcagaggtcctgtttgaggtgaatatatttgagctttctcgacttggatgtctctctgtctttctgttattatttcattaaatatgtttttctcacctttcccttcaccttctggagatatttatttgcttaatggtatcccataaatcctttaggctttttcattctctttttttttttaaagttagtctgcctgtgttatttcaaaagatcattcttcaagttcagaaattcttcttcttggtctagtctgttgtttagctctttattgtattttttatttcattcattaaattcttcagctctaggatttctgcttcattcttttttatgatatctgtctttgttgaatttctctttcaaatcataaactcttctcctgactttgttgagttatctatcggtattctcttgtatcttattggatttctttaagattattattttgatttttttcccacatttcatatatttccttatagtttggagtctgttactagataattattgttttccttttgacattacatgttttcttgctttttttccttcttcttcttttaagacaagttctcattctgttgcccaggctggagtgcagtggcacaatctcggctcactgcagcctctacctcgtatgctcgagtgatcctcccacctcaactccccaagtagctggaactacagacactcaccaatatgccctgctaatttttgtggtttttagtagagacagggtttcaccatgttgcccaggctttttcttgctttttcacggttgatgtgtccctgtgttgatttctatgcatctggtggaaaagtcacctcttttaattttatggaatagatttcataagaaagaatacgaatgagtcttgggttgttggtttggtggggtacattagccttatttctagatacagttttgtagtctctgagtaatttcttcagctgtaatccactctagtggcatttgtgagtttctcagtggcatgggctgagagagtttgtggcaatggtgatgccactttgccaggggtgggctcactagactgtttctcaggtctggggtatgtatgtgcacatagtaggtcagccaacttggttggtgagattggcttactgagactggggccacaaggctgttactctgaccagaaatacaagtataaggttgcttgggcaacctggggacatgcctgccaggagcagctttcaggtcggggacgtgggcttttggccacttggctggcttggagatattccctgtggcacgggggcagtctgcgggactatctctcaggccattattgggggtaaaggactgttgggcaggccaagggcgtgcctatgggggacctgtgtgtctgtttctcaggttctgattgcttgcaggtagccctactctgctggccctgggccatatcaccttctcagaggctcagggaggtctcctgcttagagaagggagcccagcagtttggccagcttaagagcaggcttgctgtgggtaggactggcagactggtttctctgttggtggtatggccatggttcttggttttcttgctgtgcaagaccagaataacagccagtccagggtccagccttcaccagcttggatcatggtgttcagaaacttgtttggagttggcataatgaagatggagccccagttctggagaggtgcagtggccactttccccccagaggagggcatactacacaggtggctattctcaagatgacgccatgttacagcagtttggctcacagtggtgggatggggagtacacaccttgtgctcttaatccaggtcagtgcgtctgcatgaattcctggcagctctccaaaatgggctcagggcttgtgaggactatgggattcttgtgtagtaaggccttcatgtgtttgtggtggcaaagaggctggtagggatcttctgctgacttttttccctgcaatagcaattccctcccgtctccaggcagatctgatctaggtggggaagatgggaccacgagtttgagtgcctctatgctgccttcctagatttccaatcaccacaggtgcatcttcattctatcagtgcaccccactactcttccttcacactccagtcaaatcttagctgtttgtttgttgccttgatcctttttttgtgtgtgggttagacaagcaccaggtatccctactcagccatcttgctgatgttactcctttattgcttttcttttcttttcttttctttttttttttttgagatggagtcgcgccctgttgcccaggctggagtgcaatggtgtgatctcagatcactgcaacctccacctccttggttcaagcgaccaagtagcctcagcctcccaagtagctgggactacaggcacccaccaccacacccaactaatttttgtatttttggtagagacgggagctcaccatgttggccaggctggttttgaactcctgacctcaagtgatccgcctgcctcagcctcccaaagtgctgggattataggctggagccactgtgcccaactcctttattgcttttaatctctgcatagtagtgtgtgtattagtctgttttcatgctgctgataaaggcatacctgagactgggaagaaaaagaggtttaattggacttacaggtccacatggcttgggaggcctcagaatcatggtgggaggcaaaaacagaaacccctgagaaaaccgtcagatctcgtgagatttattcactaccacgagaacagcatgagggaaaccaccctcatgattcaaattatctcccaccagtctctcccacaacacgtgggagcacaattaaagatgagatttgggtgggaacacagagccaaaccatatcagtgtgcattcaccacattctcatcttttcccctagaaatagacttctaggatttctcacactttatgttcaacagagctatataaatatgctcctatgtattcccttaaagcccatcttctttctactatatctttttcctcattttacttccttttttgagggagttatgtgggatagaagaaaaatggacttcttcatttataacatacctgaagttgggagtattttaatccttaaacagattaaaatgagctgggtgtggtggctcacacctgtaaccccagcactttaggaggctgagggaggcgtatggcttgagctcagtagttggaaaccagactgggcaacatgacaaaatcctgtttctactaaaaatacaaaaactagctgggcgtcgtggtgcatgcctgtagtcccagctacttaggaggcagaggtgggaggatcacctgagcccaggaggtcgagggtgcactgagctgtgattgcaccactgcactctagtctaggcaactgggcgagtctctgtctcaaaaaaaaaaaaaaaagagtaaaagatatgcagactatgtgattttctgcttccaaaaggaaccacatagacaggaagaagatccaagtgaattattctcttctatttctttacattgccttctgtcattggtaacataacctttatggcattcacaagtatatttgttctagctttcttcttttagtaattctgttgctgtcgtttgtgtgaaatactgcatattataacattgtaattataaatgatttatacattatcttaatcgttgtcagggccaacgtttttcttacaagcagataggaactatgctttgttgtaactcatatttgatcgactctgagaacaaaatgtattttatactttcttggagtagtcccacaaaacatgtaggacccattaagaggaagaaagcatgctatatggttgttatatttgttatttttgacttgtaatttattcattctctcagccctgttctctgactagtgttactatggcacctaagttatggcatggaaaacaagctaattatgttcttcagaacagacgacagtgatacatcttgagacacaagcatctggtagtcttagccctttcctcatcagtgctagtctaggcttggttgggctctctggttgtccaaatatttttctgttacaacacatccttctttattttatttttcttctataaatagtggtttatgctttctaaagcctctagtctcatatttagtttgttcctttttgagccttctgtctactcaaagaagtaatatagacttactcccagctgtgtatgatctactcttactcctgtttattgagttaagctttttactatttgtaaacatctcttggttgtgtagacacaaatacaccaaaactaaaaatggttaaattggggtgaaaacttacggatatttcttacaatttatttttcaaaattcagtgatgtagttagatggctctcctgataaaaattgtttaagagatatgagtaatcaatacttttttatcagaagtgacatctaaccatattaccaaattttgaaaaacaaagaaaatattagaattatccacaatttttgtacctaaacttaaccagttttacttttgtttattcccttataatcttttttactattgatttaatgtaggttataatcatactgtgtacacactatttgtatgtcttctatttaattgaatatttatgtgccataagcattttctactttactacttagttttcatcatcatcatcatttgtaatatctttaaaatattctctggagtggtgctattcaatagaaatataatttaaaattttccaggacccatatgaaaaatgtaaaaagaaacagcttaataatggattttatttaatctaatatatctaaaatatttattgtttcaacatgtaaaaattatataccgtattagacataaaaattattagattttaaccttcttttcatagtacatctttgaaatgtacctattttacatatataccagtgaattacgtcactaaactttcaatgtcaaaataaaatgtagtcctaccaaaacaataaagctccagcagaaaaatatgaaatgcttcaatttttacatttaaattaatgaaagtaaattaaaaatttagtttcacgatcatactagccacgttacttatgctcatcatgtacatgtagcttcttcatttaaatttaaattacatttaaaattcaagcctctctttgcactagtcacattttaagtgatcagtagtgagctttagagtatatagccaattcttgactgttcctctgtcatttttttacattgatttcaatgaaataagtacactgataagtttatgaatgtatattttcccatgttttggattactttcttaaagtagactctcagaagtagaattactgggtcaaagagtataatcaacccttcttcatcattgttaccatattgtttctttagttactagagaggaatatttctctacatatttatttactatgtatttctctttcaatggaatactttttaatgttatggtttatttatctattggtgtcctaatgtttgtttaatttttagtctacttttaaatttctttgtggactaaagatactaacgctttgtcttgtttttcctcatcttttgtttatttgtttgtttttttccttctgggagtaccaactgaaccctttacttttactatagcaaatatttagataatacttcctctgtaagcttcaaagtttttcccactctagaagtttgatatttacttctcttttatcatagattttctatgtatttttaaaaaatgtttttatcaaactggaatatatgattatgtaattgtgagaaaataaactaaattacaagttcttaaccttcagttgaatccagtgcttacccattatttttagataaagcctcattatatatagttgctgaccaccactgcatagttttacgcatatgtgtagttaatcaggaagtagatggacccaaatagattaaaatctactgtttcaaatatttcaaaataatatcatatattcttccctattatattctgatcagaatattgttctcagtaaaaacaaagtcttttttttttctatatcaccatgtatccacagttgattaattatagtcatggttattttacataggtttatttccttttgaattaatatagacttatacttccaagagttataaataactgaaatttacatagttgtgtatgcacacatacacatacacatacccctattcctcacataattggtaatagaaataatgaaaagaggttgtgttcttaggcaaggacaatttaaaagaaccccaaatgattaccttgaattaaggtaaacactggtaaaaaaaaaaagagcaaaaagggcaattttttcctttagtatattaaacaatgttgtttctaacattccctcacgtttagactactctgaaaaatccttagagtggttgtgtaatgtgtttaagttttttcgatttccaagcattaagtctggctccactaaaacggttgtttggttctattttagtctgtccctatctgtcctactgctaccactttgtgttgttttgttttctgttataatgaatacaacagtcccacttcattctcagttctaattaacgttatccagcctctaagtgttagcatctactttgcttttggttataggatcaacgataaacagctaactgttgtgcagactgaaatccctaattagtaaagcacaagattttattggttatatatttttctaaactatagacttgattttgttgcaaaccttacatgtagaaaaaaaattttgtaatggcactgtttttatttttggtgatactatagtctggaacatgtggcccagcaaaggttataaatctagcaagaaaaattatggatggcatcaattttaacagtctttgcgatctaacagagcataaaccccaaattgtttaaatactaaatatttacttaaagaaaaacaagagatcattcaaaaatagaatttaaatagtgaatttgccttttatttaaaagttgacaagttttgtatatttataaaattaacaaaattgacatcatactatccatatcacaagactcttgtgttgtattttaaaggaaaacacacacacagcatacatacatttggattggggccagatttagactccaggggcacagtgttctgtaccttaaattacaatcagatgtattttagcacagatcaaattttcagtctgaagttggtgagaagcctaattatttgaccaggttactatttatgtagaccattctgtggctggctgtggttaatccacagctggcagaatgctagctatgggaggtttttatttgatgctggaacagtttggggagaaatagagggggaaagctttaaaatcttctcattaaatgaaagactaaaaagcaagacagtacatccatattactatggagacaagatgctgtataaactgttcgttttaattctccaagtgacagaaatagcaaagcagcagcttggatgctcatagtttgcaagtgataggatacttggttaaaaaagaaagataaaaacatttaaaaataataactaagactaagatttgttgcctcttagaacacttgaatattggtaaagaattaatggattcaatttttaaatgatgagaaatattgttattatacaaaaacattttgtatttcactaaacatactaaaacatttagaatttcactagcagtactttaaagtgataagaggcagttgtaggggagaaaaagtaacatattttcctcatccatcgcaagggtcatgactgaaccctctgtaacgaaacagattaacaagagaaaagcataatttatttaacaaagttttacatgacacaggagccttcagaaattaagacccaaagaccagcaaaaactgtatttttatgcgaagtctgatgaaagacatggatagttgtagagaaacattagacaaaaggggtatgatctaatggtaataaacctagggttgaaggatgtggaagccagcaagtcctgtctgttagattattcttggccaccaggtataggacaggacccctttggaaaagggttttatggccagctttcacacagaaaggtgggagaaggtcagagtgaccttgcttctgcgggttttctcaattgctagggggccatattttggggtattgtattctgggccctgacacaattatagtagacgattctctcttaacgtctcagaatatgtataaaggcaataaacccttccttaaaagatggaccccaatacacatggctcctgccactaaattaatttttttagtcttcttattgtagtctatttgaaatttgaaagtaatattttaaaagatttttttttctttttaaacttttcagagtttgcattatggaaatcgttggtccctcagttataagtgaatatctcagtagcatttttgtaacttttaacagaagtttcttttatattttcaaggttatttcttccatttataagccagttcttctccccttctagtttccagtgctcccacttcctctagttctttgctctaattatcctctctcccttgcctcttcattcttctatttctccaatagatccttttctttgaaaagcaaaatctttccaactttccctgcccttaaaagcaaatctcttctttcctcccttccctgcccacccttccccgcaaaaaagcgtttgtgccttttcctcctcttattatctgctcaaattagcaacatatctggagtcatatgaatccaggcttcatcacatgtaagctgtgtgtcctaagaaacatctcttaacttctctatcttgctttatttatcaaaagaaactaatatgtccacctcataggtttgatgtaaggaaaaaacaataactgagttgctgtatagtatagtgcctgggacacaataattactcattacatttcagatggttttattatcattactgatgaagctttgaaaataattattcttaccttactttctcaccattccttttttaacaactacttctaccatcatactaagtgctttctgttaatcatcaaatcttatgacttttactcattcctttctttctctacttccccatagcaccttcttaaaatttcccttgcttagtttctccaccatcacttctcctctcctcatttggcctcctcttgttttctccttttccttttttatttcctctaatttttgttctccattttttccttcgtcgtcttttgttctgtgttctctgccttgggaattacaccacctctttgacctcacctctttcatgacctttcctctaagtccaactttctggtagatacttagagatcccttagaacctcaactgtagtatgaccacaactaaacactctttaccatctaagccagatcttattctggaattttccacttttattaatggtagaaccagattcaaaaatctcaatcatcttttgactcttttcttctttgccttccacatcttaaacaattgccaagtcctgtatgtagtactcctaatatggttttcttttacacagccaaatgtagacatttattaactgttgctgaattgttgctgcccaggttaactttgctttaaattttcccataagcttgttattccttcctttcacggaaatattcattacccatgatccacccctacccctcttgcacattgcccaccaaatagattcctaccctgccatccaaggccctttgtattcttaacttcgccgaccttttcaagtctctattattgccctttgtgtattcctttacttgtttgtgcaccatccaaactaatttcctgtatatacatgtatgtctttgcttatgctttcctctagaaagcatgaatatgttttaataagactttcattaatattaaagctgtacataaatagcattttaaatgcagctttcctgacatgaaattttaaagaaatttaaagaaaattttaaagaaaaattaaatatttttcttttgcattactgcattcttttctcattatttgaaaattctaattcagaatcttcctcaaaaatcaatttagatatttcttaaggtaacaagttatgattgattgattgattgatatagagacaaggtctccgtgtatttcccaggctggagtgcagtggtgtcatctcggctcacttcaacctccaccacctgggctatagcaatcctcccgtctcagtctcatgagtagctgggaccacaggcacacaccaacacacccagctaatttttgaaatttttgtagagacagagttccgccatgttgcccaagctggtttggaactcctagactcaagtgattggcccaccttggcctcccaaagtgctggaattccaggtgtgattcattgtacccagccagaagttatgatcttaattaacagattattttaaagtcacttataagaatacaaactcagccaggctcagtggtgtgcacctgtaatcccagctacttggagggctgaggtaggaggattgctttatcccaggagttcaggaccagcctgggcaatatagtgaaaccttatctcaaaaaatatatattccaaactgtttgtaagaagctaaaaggattcagtttgccttcatagtacaatttccctaattcgaatgtaattattgtcttgaatgagacctttcaaacattttttctttcatgaatttccagaattctttagtattgagcatataaacctagtatgaaataagtaatgctttattctctgaagtaatggcatgtatcaagcatatggtactcatatgatcaaatatccttccagtcaaatgttgctattttctgccttgcatcttataattgtattttatatacttttgtattttgtataggtttcttttattctcactgagagtgactgtggagatggtatttctaattttccctccttttttcttcatccagggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagtgagttacctttcctttttcaaaagaacctgggggttttttgtttgtttatttctgatgtgtgtatatatgtttagaaatatataaattaaatcctaaatttttgtgtaaatgtccttgagaattgtgcaacaaaattgcctcaatgtcaactgctctcagtattttcaatatttccttcagtatatactaacttctttcttagtgaagcatttatttatttatttttatatttttatttttttgaggtggagtttccctcttttcatccaggctggagtataatggcatgatcttggctcactacaacctctccttcccgggttcaagcagttctcctgcctcagcctcctaagtagctggggttataggcgcatgccaccatgcccagctaaattttgtgtttttagtagagacagggtttcaccatgttggccaggctggtcacgaactcctgacctcaggtgatctgatcgcctcagcctcccaaagtgctaggattacaggtatgagccactgtgcccggcccaacatttatttttttaaggtgtttgacgtttgatttacttatagtaagagtcatcctttttactgtaatttctgtgagtttttacagatggatacctgtcctgttactatgaccacaatcaggataaaaaagcacattcatcacttttttaagtctcttcagagtctaagtccatttgatatttgtttaataaattatgagtaaattttgatatattacatttatatttctttattaataatatttttaaaatattgtctgttatagttgaaggtgataaaatggaatttcatctcaacaagtacagttttttctttctaccaagaatgtattttcttccattctaaattatggaaatgcttatttacttaaatgcttatttactttgattgcttgtttactgtttatacctcttatttactgtttatacctctttaaaaatccatgaaagaggaaaaaatccttcagtgtgtcttcctatgacttggccatgtcacttgatggtttaatgtatacaatgaaggtattgtattaatcatcccagaagttcattctgattctaattccatagttctaacatagtttgaatatattcatcaattttatatctaataactgccatctgcctagaataacataaaaattgacctggaagtttacgagatcacctgggtaaagattaaaggatgatccatagaaataatatcacagtgtatctgcaaaggtgatggttacattggttataaatggtgacattggaaggaaatgctatattcttgataattcacaaattgagatactggcaagaaatagtggtaatagccaagtgccatataactgctagaagcctaatttgactaagatctaccatttagtttttccttattaacagttttattttgtaaagggtaaaagaagtaaatgggaaaagtgctattcaagccttttgaataacattaaagcattggtctcagtagtcttgagaatcattgggagaagttaacatttggtctcagagttctaaatagtcaagaaagatcagactggcagcacttaaataagttctctagagtttaagagacaaatcttaaaacttttaaaaaagataaatatgattccaaagaggccgggcacggtggctcacgcctgtgatcccagcactttgggaggcagaggcgggtggatcacgaggtcaggagattgagaccatcctggctaacacggtgaaagcccgtctctacttaaaatacaaaaaatgagccaggcgtggtggcgagtgcctgtagtcccagctactcgggaggctgagacaggagaatggcgtgaacccaggaggcggagcttgcagtgagccgagatcgcgccactgcactccagcctggacagagcgagactccgtctcaaaaaacaaacaaacaaaaaaaaaaaaacataaatatgattccaaagaatgaaactttggaagtaaagaaagcttagggagattgaatgccataaaaaatgctatttggactttatagtcacaaatgatcttaattaaggagagaatgtggagggaccttttgaaaaaatatagcagagcacgcagaaaactctttaataagagctcaaatttggaggataacgagatagctgcctctgcctttgccggtgcagtgagagcagcttcaggaatcttatggcctctgaatattttggcatcttcagcctaccaaaactgtgtcaaaaatgcctctcttatttctgcattgtccactggacgttttagtcatattcagacaccagttgtttcctccactcccagacttaccacatctgagagaaacctgacatgtgggcatacttcagcgatccttaatagagtggccctcttgcttccaagtgtcttgaagctgccagccagatctctaacatacgtcagtacaggaaaaggcaagagaaggattgtgaaagctgtcatctataggtttcttcgacttcattgtggcctttggatgagaagggctggttataagaaaaaattatggaaaaaggcacctgcaagaaaaaagcgattgagggaatttgtattcggcaataaaacccagagtaaactcttaagataaaatgacgacgtccttctggaagaggtgaaactggtatgtccatgatccttatcagaagtgtcatgatcgaacaaacctgaaagtatagatcagaagtttcacttgtttctcagttattgaatatgtatctttgtgtacatatctgcaaaaatggataagtaaaaatctcgatgtaaattgtatcaatgaatatgtaaacatacagtgacaacactgaacttataaaagttttaaaacttaaaaaaaaagctcaaatttgtaaaagacatgtaaaaagaaggtggaaaatgtatttagaatcagggaatgatgctaaaagtttggtagagacaaaagagaaaagaaagtcccaaaagtggtttaagtttgcagcagatgctgatgatatcaaaacaatcttcacttaaaaaaaaaaaaaagactccaaagtacaagcaacaaatggaaaaaatagataaattagacatcatcaaaattaacaatttttgggcatcgaaggacactaacaagaatgtgaaaagacaactagtggaatgggagttaatatttgcaaatcatatatctgataaaggattcatattcagaatatttaacacagtaacaactcaacaataagcaaactaacaacataattcaataatgatcaaaggaatttaataaacatttattcgaagaagatatacagatggccagtaaacacatgaaaagatgctcaacataaccattcaagaagtgcaaatcaaaaccaaaattagataccacttcacacccatcagaatgacaattgttttaaaaaatggaaattaacaagtattggtgaagatgtggagaaattggaaacacttgtgtattgctggtgggaatgtaaaatgggaatgtagaagacaatttggtggttcctcaaaatgttaaacatagaattattaccatatgatctagcagttctacttctaggtatattacccaaaataactgaaagcagggactcagataattgtacaccaatgtccatagcagcattattcacaatagctaagatagaagcaaatcaaatattcatcaacagatgaataaacaaaatttcatgtatatatacaatggagtattatttagccttaaataaaattttgatacatgctacaacatgaatgaattttggaaatactatgttaagtaaaataagccagacacatcagacaattattggattttctaagaagaattccacttacaagaagtatctagaataggcaaattcatagagacacatagtaggatagtgattacctgggagtggggtggggaggaatgaggcattattgtgtaataagtacagagcttctgtttgggatgatgaaaaagttctggaaatggatagtggtgatagttgcgccacactgtgaatgtatttagtgccaatgaattgcatacttaaaatggaaaattttatcatatgtatagtttaccacaatttttttgaaaaagttttattctacaaatcagtaaacttaaaagttggatcacagcttagcatagattattaaaggaattatttttccccacctagaagaggaagtggtaaaactgtaagctgctacgtggctgtaagtcatggggcaagaaaatcttttctcttttggtatgattattgttcatttgaattcgcttcaagaggtatttatatagtacctaagtacctattatggcagaccaataagcagtggatacatagtatattttagaacatctgtcattacgtggactatagaataataaagattggctataagacaattagaggtatttggtattttattgaagcagtctcaaaaggtctgttgataaataaattgatttctaggggtacgcctcagtgtttaccctgcctttgcttaagtaaacagtgatttagataaagctatatttgcatataattcaaatgcaaataatacaacaccttaatacatactaggtaagttgaaggtcaaaatcagatttttttaaatgttagtagactctaaatatcagttgagtgatgaaatttaatagggataataaaaattatatcgtatttgattataaaaagcaagtagagtaaaatgctttatccctttaatctcatcatccattgtttttctccttgaatactatagtgataatgttatcttcagttttccaggaaaaaagagacattttacttctaaaatgtgacgaaggataaaatatagttatcagagaatatacgtaggattctttaatatttcccccctcaaaaaaataaagtatactgtgtttagtataaatttttaaaatgtcaaaactcagctaaaatcaaacacacttggcccttattttctacatgtcaccttcctcttgtcagaggattgtacagtagtaatgatgatttaaaacttctgatagcctcaatatttaaaaaaaataataccttgtccacaaagattatttcttcacaggcaatgatcaatgatccctgtgagacaagaaataaataagataaacctgatgattaccccagctaactccttggagataatttccaggcaacagaagaaaggtaactaaggccaagcacagtggctcacgcctgtaataccagcactttgggaggctgaagcgagtggatcctttgaggtcaggagttcaagaccagcctggccaacatggtgaaaccccctctctactaaaaatacaaaaaagcctggcagggtggttgtgcgcctgtaatcccagctactcgggtggctgaggcatgagaattacttgaacctgggaagcagaggttgcagcgagccaaaattgcaccactgcactccagccagtgtgattgagactctgtctcaaaaagaaaaaagaagggtatctcaagtagacccttgcagtctcttttaatgaggagttggagccggaagttcaaggagtctaagacagctagtgtttgtaagttaaaagtaccagagaagaaatagctgaatagagggagaacacaggacatttgcagaatcccaacaagtcttcagctgagtatgaatcagtgcatttttgtgaagaaattaaggaagaccacaaaaagaaccacctaaaaagattgtagaagacaatcctcagtgcacacatgaggacctataaccattcctatcctactagtcagagtggataacctcgtaattcacgaggcttcaagtagagtattaaaaggaattttgtctcattagcaggttaaaatcagctctagactagatgttctggtccctcctgtcaatattattacaatatatttgacaacctttatgaaatggacaaatttgttaaaagacacaaagtactaaatcatactcaagaagaaatagaaaaagtctgtttagattattaaagaaattgaatttgtagttaaaacccttgctacaaagaaacttcaaaggctgaattgcttcagtgtttaattcttttctgtttgtttgtttgtttgttttgagacaaggtctcactctctcacccaggctataatacaatggcacaatcatgtctcactgcaagctcaaactcctgggttcaaatgatcctcctacctcaacctcccgagaagctaggacgacaggtgcaaaccaccacagctggctaatttttaatttttgtagagaggaggtctcgttttgttgcccaggctggtttcaacctcctgcactgaagcgagtccttctacctcagcctcccaaagtgctgggattacaagcatgagccactgcacttggcagtgttgaattttaacacagatttcagaaagatgtagtaccaattgtatacaaactgtcccagaaaattgaagagggagaaatatacctatcttatttcatgaggtcagcattaccttcataccaaaaacaaagtattgcaagaaaactacagaccaatatccctcataaacacagatgtaaaaattcttcaaataattttagcacatcaaaccgaacaatatattaaaagagtaattcatcatgactaggagtgtagaattggtttagcattttgaaatccatcaatgtaattaaatatgttaagactaaaaagaaaaatcacatgattatcctaaaagcttttgaaaaatccagacatctatttctgttaaaagccctcggaggctgggcatggtggctcatgcctgcaatcccaatagggattggtgagggtcaggagtttgagaccagcctggccaacattgcaaaacctcatctctactaataatacacaaaatagcagggcatgttggtgggcacctgtaattccagctacttgggaggctgaggcaggagaatcgcttgaactggggaggcagaggttgcagtgagccaagatcatgccaccacacgccagcctgggcaacagggtgaaactgtgtcaaaaaaaaaaaaaaaacccttggaatagtagaagcatgaaaaaatccagatttagaaagaaggaagtaaaactgtctctattatcaaaagcatgatcatcttcatacaaaatctgatgtcatcttcaaaaagctattagaactggctgggcatagtgcatcacgcctgtaatcccagcactttgggaggccgaggctggtggatcatttgaggtcaagagttctagaccagtgtggccaacatggcaaaaccgcgtctctactaaaaatacaaaaattagctgggcatggtggcacacgcctgtaattccagctacttgggaggctgaggcaggagaacccgggaggctgacctgaggcaggagaacccaggaggcggaggttgcgatgagccgagatcatgccactgcactccagtctgggcgacagagcaagactctgtctcaaaaaaaaaaaaaaaaaaaaagctattagaactaagtgacgtagcaagattgtagcatacagaataaaaaatttaaatctcaaatgtatttttctatattagcaagaaacaaccagaaatttaaaaatacgatttccaataccatcaaaaagtataacaaagtatttactttgggataaaccagaccaaagatgtatacactgaacactacaaaacattgttgaaaaaatttaagaagacccaaatgggagatatatcatgttcatagattagaagactctgtattgttaaatataaattctactcaaaataatctatagtttagtgtaattcagtcagaatttcagaagttttttttaaagtcaagttgattctaatatttatatggaaaagcactggactagagtagccaaaccaacgtggattttaaaaaccaaatcagaagacctttacatgatttgaagacttattacaaagctacagtaatccagacaatgtggcattggtgtaatgatagacaaatagtcaatggaacagaagggaacgtccagaaatagacctaaatttatttttcaacaatgtttcagaggctttttcatggaggaagaaaacagtctttttgacaagtcgttctggagcaattaaatatccatatctaaaaacgcaaacttcaacccacgtaacaaacaactgcacggctattagaatgtctgaaagtgtgaccataccaaatattggtaaggatatatggagcagctagaatgtaaaatggtacaactactttggagaatggtgttcttgtttcttacaaagttaaatatacatcctccaaatgacctagctatcccactcctagatattcacccaggacagatgaaagcatctgtccatgtaaagacatacacaggtgtttatagcagctttatttgtaatggccaaagtctggaaaacaaaccaaacatccacaactagtaactggttaaacaaattgtgatatttccatagaatagaatactactcaactataaaagaattgtactattgataagaaatgaaccaacagcatagaagaattttagaatacctatgctgagtgtaagatactgtaaagtacattctatatgattctatttatattctagaaagtgctaacaaatttatggtgatggcagatccattgttgtctggggacagggttatgctatgaggcagtgatcacaaacgggcatgaggaaacttttaggagtaatagatgtgttcccattgaggttgtggttgcagtactttatacatacgtcaagttttatctaattaaacacttttagtttgtgcagataattgtatgtcagttatacctcagtaaagctattaaaatgaatatatactttgattccatttatatgtttaaaagtaggaaacattattctaaagccattaagttccaaaaatacactgctaaaatgaagaagtgccaatttgttattttttgatcaccatatatgaaacttctgttatttccatggaagatccccttatatttaagtagcaatgtcaagccagaggaagagtgttttgatagtcctgggttctaatcatgacaactaaaaattatcataacctaccattgaataatgctttaaagttaaaaagggtattcacaaaaaccgtcatttaatctacaaggcaattccatgtgtttttctaatgcatgtaaagtttcagcttggctcatggaatatattctcaatttttgttaggtaatgttggtagtagttttaggagtattgatcatgttatctattaagtttcacttcactttaacttgctttgataactcacactcttcattcattcctgttaaaacataatgaatatagtaccaagtgcatgagggaaaactcacagctattgggctgctctctgctataccaccttacttctgttccaacaaagttatttgcttacaaaagttaattatgtttttcctaaacttggtgaaatttgtgttcattatttaattatttaacattatatattctgatgaaatatgaatgcaagtagaatgagaattagtttaatgagttaaggttggttccaaaactaaatacatatgagttatttttaatgttgctattgaattggatgtgggcatgaaaagtataaaagattaaaggcagtaaaaagctgtaaacatctgtattcaggagtgcttcataggtgtttttatgttttctctctgctttaaagaagttgaaactaggccaggaaccatagcgcacacctgtaatcctagcactttgggaggttgaagtgggaggattgcttgagcagaggtgttggaaaccagcctgggcaacatagttggaccccatctctccaattattttcttaaaattagccaggcatggtggcacacacttgtattcccagctattcgggaggctaaggtgggaggatcgcttgcacctgggaggttgaggctgcagtgagctacgatcatgcaactgcactccggtctgggtaacagagtaagaccctgtctaaaaataaaatttttaagaaagtaaaatgagaattcataaactatgaattctagatgtggttctacaagaaaaactctagaatgtcagtctgtaggcatgctcaaaggttttgaccctatttttttttttttttttttgagacagagtcttgctcttattgcctaggctggagtgcagtggcaccatcacagctcactgcaacctccacttcccaggttcaagcaattctcgtgtctcagcttcccgagtagctgagactacaggcgtgcacaaccatgcctggctaatttttgtatttttagtagagatggggttttgccatgttggccaggctgattttgaactcctggcctcaagtgattttgaactgcccacctctgcctcccaaagtgctgagattacaggtgtgagccccccacccagctgaccctattttaaatattagcaaatgatgtatctttatatattaaaataaaatgtttagattatgaaagctattttttgttcccttaatttaatcatcactctgatttatttatcaactactattccttttcctcatctgtaaattgaggggatttgcatagaaatactagataatcttttaaattttttcttaaagcttaaacatgttataaaactgatgattcattttttttccacattctaagattaatactgttagattttattataaattaataaagttcctcttttaacatgtaaaataatgcctgacatttcttttaggtagttctgattttttattatgagtgtagccttaactgtagtgcctttgaagctgaattctccccatttgtgaccccagtattccttttttgtttagtgaacctaggggaaatgatatttctctccaaaaaatacctgaaaatatttggttagacacgtgctgggacaaaaagtgaagtatccacagtaataccattgctatgttcttgtgatataaccagattataattactaaatgatacaatttactttctttttttaattctggtaaaaaaaaaatacacaatataaaatttagaccattttaactatttttaagtgtacaaatcagtggcattaagtacatttgcaatgttgtacagccatcaccactattcctctccagaactttttttttttttaatcaacccaagcagaagctctgtacccattaaacaataactcactatttcctgtttcctccttcctcctcacccttggtaactgttttactgtctatctatgaatttgcctattttaggtacctcatacaagtaggatcatacaaaagttgtctgacttaatttcacttagcataatctttttaaacttcatccatgttatagcatgttatcagaatttcatcttttttaaggctgaataatatttcattgtatgtgtgaaattttgttttttgcttcattttgttgatagacatttaatttgtttccacctttgattattatgaacaatgctactgtgaatgttaatgaacaagtatctgtttgagttcctgcttttaactcttttggatatatacctagatgtggaactgttggatccacaacaggtacaccattttacattcctaccatcaatacacaagggttccaatttctccacctcctcaccaacacttattttgcatttaaaaaataatagccatcctgctgggcacgaggtggcatctcactttggttttgatttgtgtggtttactttcagccaaggttcagaaatacatagtgacaaatttctgtttctttaatttaaaatctttggtaacctgttacattgcattttgtacttttaaattacacatctgaattgattggttatccttgttaaagtagttccaaaattactgtagtttaaaaactctttaaatattacattgtagttttaatttgtttctgacatcttcaaagtttgaaattttcccttcagcaacaaccatttgttagctacattcacacgaaagcagcttaataaaggacattctacacaaaggtaattataatccattgatgccccttaatgcaagctgctttgtagtcattatctagcagtagatgactaaagaacttgattattcttgtttttcatttttattaaattaagaaggtttttttaaattatgtcattttgcaaatggttcttaggagtaatgcctttcaaggctccataatcactagataattaacctgcaaggattaagtacactcaactttgcctcaggatgcttaactctcaaatacagtcaattatctcatgataataactgctttgtcaagagttaccacttaactccacagtgaaaagtcaaatcacccataccatgcactttaagatagtttcaataataaaataacagtttgaaatggggcagaagaattcagttaaattttttcatagggataagaatgatatgctttagataaagctccccctcatatctagtattttgaatttcacaaatgacttcaatttataaagataatataggccaggtgcagtggctcatgcctgtaatcccagcactttgggagaccaaggtgggcagatcacctgaggtcaggagttccagaacagcctggccaacatggtgaaaccccatctctaataaacacaaaaattagctgggtgtggtggcacgcgcctatagtcccagctgctcaggaggctgaggcaggagaatcctgagaaccctggaggcggaggttgcagctagccaagatcacaccactgccctccagcctggcaacagagcgagactccgtctcacaaaaaaaaaaaaaaaggtaatgtattgctctgcttcatcagtccttttgctggcagtgttcctgcattgcaaattttcttataggaaagccattttgtctgttaacctcacagaggattcaatatattaaaaatctctaatatacaccaagaaaatggaaattactttctttacatattgatttaacttttaaaaaatctcgtttatcaacaaacgaattacaaaacagtgagcaaaattctgcagtttgttgtggttgttttttgttgttgagtagcttcactcatatttggacaggatatgccaaaaacagaaagactgctagatagatcaggacattttgaaagaaaatataaaaatgtctttaggtttgttatccatgtcctctaagcctgaatgatgcttgtatctctttataagtaaactatcattatctttttactaaaccagatgggatacattggctttttcttctgttatatattttactgccatggggatgggaagagactttattgatattttgtttacacttttaaaccctttttaatgtttctaatagttaattaataatttgaaaccatcaattctttaaattgtaaataactttgatacaggttatcttatttttcagtttctatacttctgtaaaatagaagtcatttgctcttttaagataaaaaatctgtgtgaatctatgtgtaattatgtacaccaaatagtgctatacatgcatacaacttctttcagatattcttcttttggttaagagcctttttttctttgtaaaggtattattttaatttttagaactatttttctgtgcactggagcacatgtttgggaggaaaaaagaaactttctgtcaagtccctatacacagagaattcttgtttgaatttttaaaaaattttgtcaagtctagttcttttatttatttatttattatcagttagagacagggtctcactgtgttgtccaggctgttctcaaactcctggcctcaagcagtcttcccgccttggcctccctaaggttctgggattacaggcatgagcgaccaagcctggccaagtctaattctttaaaggatgtgatttccaagtatttccaggaattcaagactgttacctagatccgtattctgacaaaagagatgatcttttctttcttcatatcagaatatttcccccatgaattgagggaaatggggctgtatctaaaaatggtaactctgccctttaaagtatacagaagtgccctgtttcttcctaagagaggtggaagtcccctttctgagactgtgcatatagatctctttattcccctttttctgctataagtgataagaggggctatgtagacaaaatgtaaggttgttataaaatcatcaaggaattgggaaagaaactttatcggaggatatacataaccccttcagaaaaaaaaacaaaaacttatggtgctttttggaagaaattctgacatagttgtattttctgagaaggataatgaaatttcagttaacatggaactgtaacttcgtaaaattgctgctcagctcctagatttaactttctccctagggtttttctaatatatttactcatctgaaaaaagtgagattgactgtagcacaagggagacttctgatgtcagtggcatgttgtaaagatgtgctatgggaaagattcagaaaatgcaaaggctatttaactatatgctctgcatctctcttcctttctacatagctctctcctttctttcttactccttcgtctccctctttacgccaactacattgcctctctgaagatgaaatgcttttaaatcatccccaatctaacatccatcactggtaaaaagccatctaattattatgtgttgatttttaaaaattaaaaaaaattattagaaaattaagaagagcatttaaatgtttttaattgcaaggagaaaataaatacactcaagtaaagaaaaacactgtgtaatttgaaatagtttgaattactacggagataatcatattttatgcagtaatgcctttctattttattcactatttctattaatctttatttgtttcagttactgtactataaatttgtaagtgattattttggtattatttgtatagtatgccataatataaaaataatgaaaaatattaaatatatatttaatgttcttatttaatgcctttaattttttttttctttgagacaaggtctcactctgttacccaggctggagtacagtgatgcaatctcggctcactgcaaactccacctcccaggttcaagcgattctcaagtctcagctttccacatagctgggattacaggaatgcgccatcacactcagctaatgtttgtatttttagtagagatggggttttgccatgttggccaggctgatcttgaactccaggcctcaagtgatccacctgcctcggcctcccatgtgctggggttacaggagtgagacacctcacccagccaaaaattattgtttattaaaaatcatttaatgacattgacatccttataaataaaaactgtaaatttatatcacagtagaaaaagtgctagacctaaatttagaaaacctgtcttttatcctagctcttgagtttttcacagagaaaataggagtcaagaagccaaaattctgacatgagggaaataattagcaaaatttaaataggtgccattgattagtcaatggtattttatcaacattaatttttattttattatttatttatttattttgatatggagtcttgctctgttgcccagactggagtgcagtggcatcatctcggctcactgcaacctccaccttccgggttcaagcaattctcctgcctcagcctcctgagtagctggggttacaagttcctgccaccatgcctggctaatttttgtattactagtagagacggggtttcgccatgttggccatgctggtctcgaactcctgacctcaggtgattggcctgccttggcctcgcaaagtgctgggattacaggcatgagtcaccgcacccagcttaacattaatttttttagttttggtaattttaatatggctatatagaatgtttacatttggaaaaatcctaatatcctttttgactgatccagatccagtccaggttgctcacattgcatttagttaccacatttccttcgtctctttaatctagaatggttcttcagtctttgtctttatgaccatgacaattttgaagagtcctgactggttttttgtagaatgcccttcagtgtggagtttcctcatgattaatacattttttataggaataccatagaaacagcctgggcaacatagcaagatgctgtctctacaaaaagtaaaattcaccaggcatgatggcacattcctgtagtcccaactacttgggaggctgaggcaggaggattgcttgagcccaggagtttgaggctgcattgagccatgattgccaccctggactccagcctgggttacagaacgagaacccccacacaccccccccccctaaaaaaaaacaacacaacacagaaatgctattgtgtcttttttcatgcgttatactaagattttagtgtgtttcgttactggtaatactaactttgatcacatggttaagaaaatgttggcccagtttattcacttcaaagttactatttctggccaggcatagtggcttacgcctgtaatcccagcactctggggagccaaggaggacagatcgcttgggcttaggagttcaagaccagcctgggcaacatggtataaccctatctgtactaaaaatataaaaattagctgggcatagtggcatgcacctgtagtcccagctacttgggaggctgaggtaagaggatcgcttgagcccaggaggtcacatggtgaccttggaagcaaatgctccctcaaacacgagatgactgcagccctggtctacatctcagttgcagtcttgtgaaatcttgagtcagaggcactcagctaagccatgcctggattccttttcctggaaactatggagataataagtgtttgttattttaagtcactaagttttggagcaatttgttacacaataataactaatatgctgtgaaaaacaaatttactaagagctcaatatctgtgtacaattttttttgtctttagccttttgtgtatattgtcaaaacacaggcttttagttaaagttagttcctttccccttcaagtattttaattttttttaaatatgtgaaacatttatatggttcttaacatcagaactatatgaaaaggtttactcagtagtgtcgctcctcccttatccctcatcttcctcattccccattctgtctctattcctaccctgtttcttcctacctaccctctataaataatctcattagtttctggctcacatttctaaatttcttttagcacaaattagcagctaaatgcatattttactgtatcttctttgttacatgaaaggtagcacactatagatagatcctctttgaacttagctttttttcaatcaagtgcatcttagaaatcattccataaaagctcatagagatccttctcatttttaattttattttagttatttatttatttatttatttatttttttaatgagatggagtctcgctctgtcacccaggctggagtgcagtggtgcgatctcggctcacagcaacttccacttcccgggttcaagggattctcctgcctcagcctcccaagtagctgggactacaggtgcctgccaccacccacggttaattttttgtatttttagtaaagacggggtttcaccatgttagccaggctggtcttgatctcctgtcctcgtgatcctcccgccttggcctcccaaagtgctgggattacaggcgtgagccacagcgcctggcctatttcatttaaaaaaaaaaaaaaaactgagacagggtctcactgtgttgcccaggctggtcttgaactcctgggctcaagcaatcctcctgcaatccttctgccttgacctcccaaagtgctggtattacagacatccagccacaataatcctcatttttttagttggattttccccattgtgtgaatgtaccatattttacccagtcactctcttatgtatggacattaagactgtttccagagtcttgcacttaaaaacaatctttcaatgaataatcttgttcatacatatttcttgggttgctagaggtatttcttcagagtaaattccttgaaatggaattgttgggtcaaaggataagtgcatataacgttttgttagatgttgctaaattcctctccaaaataattagaaatgttttcattctcagcagtagtgtaggtgaatgcctgtttttaatggggttattttaatatttggttatcaattattaagcattgctatcaaatggaattcactagaagcatgtaaaattctagctttatttcaaatacttagttgaaccagccaattcattttagcacagtaaaagtaatccaagaactaaaaagtgatcattctttaaggtacagattttaaagactcttttatcttttttttttcttttttttgctattttatcagacacattagaggaatatgaattaatccccattatacactctttagtttcattttctggccctgtattttcatcttatacttctctcctacaagcacctcttcctttctcctgtactgcctaactattcatgttttcttatcatcaatactcatttcatatattccctacctcacattctccccttctttccctcccttctccactcccattcagttggttattttataaatgtgattctgtgatcttgtgtatataattacaatgcttacatgtttcttttacactagaatgtgttcctttacagcagtgactttcattcttcactacattctggccacttgattggtgatcactttctgaccggaagttccaattatttaatcacaaagttggactttctggtgaccacttcccatcctggggctgacagtgagtcgccccatcagcataacaaaggcacttttaacaatcaggaaattctgagggtttttgaagctctgtgctaggaatccagacaaggacttgatatattttttactataccagtttaagggttaatgataccatgtaacaactttattaatagattactatttatagaaacttgataaatgtggtgggaggtggtgcagaatcatgtgatataatcaattataaatgaaagcacagataaaatttgaaataataagagagaaataagaatgaaggttggccacggtggctcacacttgtaatcccagcattttggggggctgaggcgggcagatcacgaggtcaggagatcgagaccatcctggccaacatggtgaaaccccttctccactaaaaatacaaacattagctgggcgtggtgatgcatgctactcgggaggctgaggcaggagaatcacttgaacccgggaggtggaggttgcggtgagctgagatggtaccactgcactccagcctggggacagagtgagattctgtctcaaaaaataatgaaaaccgaggagttttttctttctttctttttttttttttgagacggaatcttgccatgtcgccaggttaaaataaactttcaattctcttctcttgaatatctctcacccaacaatgtttttttcatgttgatcactttactaaagcgaacaattggggttttaccaaaattgtgaaggattttattcttccatacttatgtctgtgttcagggtcatacagattctactttttccttttagtttaaggtattctcttggagatttaatgtacttaaatttgaccacaatttattgagagcatattctgtgtcagacattgcactctgcactagatattcaggaatttctaaaaagaatgttaacattgctgttacatagtcagttactgatcacattcttttcctctcaacttttttcaaaataggaatctgcggtatgttttcacgtatggagttcaggtcaggcttaggggtccctgacaatgtgaatagttttaagctgggcctcaattcgtggtacccttatactaatttaacaagccgtggactctaggttccaccaaaaatattttgttccatcctctctggtttcagtccatggtgtacagaaagaaaactaaggaacttcagccccaaattgtcaaattttgctacttaagaaacagaagatttaaatctatcattttgtcttatattccagagttgactggttcctcctgtctttaacttcttgtccttgaagggtattctaattttcattcagaaatatgacttctcatagggtttgtgttagatattttcagggccagatggatatgatgttcccatttctgttttattgttaaactactattccttttgagctgtaatgaacaattcattctgagaggcaatatatgttttcagtaattgacttgaataaaagtaaatgttaaacatggagttactaagttaatacagtgggtattagtactaatttgttcaaattaagatagaattcttaatttgataaatagaattcttatattacagcatcagtccaattggattgatagtttgtagaaaggtaatttcttacatgaggaaagacaggttttctttctcttagcaaggtattaatgcaaaaatgacctcttcatttcctaccagcttccagaagggaaatgctggttaggaggtaaattcaatttactctacaagcaaacttcacatctgttatgctgaagtcagagtttatctttcttgttatgtggaacctagaaatataccatgaggaatactgaaaaataaactagcagaaattttgcgtgatgctgaggatttttagatggctgcaaaatgggtgaaagtaatataaacttaacaaagaatgttgtcacaactctctggaacttagtactgtttttcaactaacaaatggaagatttgtgagactaggtcgacttaatgtgatttcaatgcagtaattactgtgtggcatgggcatggtaagagataggccttttctagaaatattctcatctctgttttttttagttgctcttacttagatttatattaactcagcttcacattttcatttctttttattttattttaaacaatgagaaaaatactccacgatgtcactgatttagttatcagatttgctttatttctgtatataataggtaatgtgagtacaggaaatatatctgaaaaggttacttgtacctaaattttaagttagatcatttaaaaattacttataagtctcttgagtgttttatatagtagggcagatggaaaaacttatttgatattcatttttggtacctcttaggaaaataattgggaatgtattcagttggaaaaaatgttgagaagagtgttttatataatgattatttagtaaaacattaaaaataatttcttattctggaggtttatagacatcaaaattgacaaagattcatggattatacatttcatcaaggtacctttaagcgattttttaaaaaaaattctgactctaacaatgcatgctcattgtagagcgttaaaaatacaaaaacatgcaaaagaaaaaattaaaattaacatgtgtcatatcacccagcattaactactctataatttttcctgtgtttccttgtagggtttttcccacacatttttatttgtttttatcatatttatttttattccacacactttttattttgaaatgatttacaatctaggaaagaattataagaagagtacagagttctctcctactacacttttgagcattcttgctttttctctctttctgtctctctaaatatatgtgcttaaccatagtacatattcagatttttctagctgtcccaagaatgttctttctagtgattttgttttccaggatcatggatcatgcattgccttaacttgtcatgtttctttggtttccttaatctggagttccttgatctttctccttcatgccattgcatttataaagagtgttgtcaactgttctgtgtatgtaaattcttaaccaattgaaatagattttacatcatttttcccactttatatatatatatatatttatttatttatttatttatttatttttattttattatttttttttttttttggagacagagccttgctctgtcaccaggctggagtgcagtggtgcaatctcggctcactgcaacctccacctcctggattgaagtgattctcctgcctcagcctcccaagtagctgggaatacaggcgcgcaccaccatgcccagctaattttttgttttgttttgttttgttttgagacagagttttgctcttgttacccaggctaagagtgcaatagcgccatcttggcccaccacaacctccacctcctggattgaagcaattctcctgcctcagcctcccgaatagctgggattacaggcatgtgccacaacatccggctaattttgtatttttggtagagacagggtttctccatgttagtcaggctggtcttgaactcccaacctcaggtgatctccctgcctcagcctcccaaagtgctgggattacaggcgtgagccaccgcgcccggcctaatttttgtatttttagcagagactgggtttcatcatgttggccatgacggtctcgatctcctgaccttgtgatccacctgccttggcctcccaaagtgctgggattacaggcgtgagtcaccacacctggccacttaatatattttcaacattttccaatgtctttaattatgtcaattataattttggattgctgtataatataatttattttcattagtcttctagtgttggaaatttttactgtttgttttcttttcagtattgcaaatacaattgggaaataaactttgtaaataaatctttgttgtaattttaatttctgaatctatcaagtatttgttaaaacataaagcaacaaaacaaaaatcctacagaagaggataattaaatgttaatctttttgattctgaatacaattagaatggaaatttggaaaaggggaaaattgccagataaagaggttgccagatttagcaaataaaaatacaggatgcccatttaaatttgaatttcagaagggacacacgatatctgggacatacttatactaaaaaattattcattgcatatctgaaacttaaatatgactgagcatcatgtattttatctggcaaccctaccagtggtttgagtattcgggaagacttcatggtagagataaagagagggaataaagaagatgttttacacaaaaggaatggttgagattacctccaaaacaagagtgaacatagtttatgtgaaatagtctccataaagataaagactttgtgtctcattcactgctgtatccccgatcccttaaacaatctgtacactgtagtcactcaataaatatttgttgaacgagtaaatgaatttgcactataaataaagccaggcaacttgggacaaagattacctgttgtaactaagtagataaagataaaatttccatgaaagtggaaaacctggcagaagaatttggacttcctgccttcccttatttattttataatgattcattaagtgactgttatgtgccacatgcacaggatactttggagaacaaaaacagacatggcttctaccctcatggattttatagtctgtattagaggcagacattcaatttataattcaattattcatttaatagtcaataaatttcaattcaattatagcgtacaacttataaaattgaatttttaatcattcaatttataaatatgagtactgtaagggaaaagtatataatacttacattctgaaatcacacacagtgagggggtattcttgaaagaacctgatcaagataaatgtacatggtgttgtgtcttagggatagatccaatcttttctttgaaatcttcattcattcactaattttccctcgaatttatagaacactctttggactattacacttatacatcttttaaaatctttttatatgtgcaatttagtttacttactagattgtaaattaattaatttatttatttatttagagacagggtctcactcacatcacccaggctggagtacagtggcacaatcaccactcagtggcagtctcaacttcccaggctcaggtgatcctcccaccttaacctcctgagtggcttggactacaggtgcacatcaccactcctgtcttatttttcatatcttgtgtagagatggggttttgccatgttgcccaggctggtttcaaactcctgggctcaagtgatccgcctacctcggcctcccaagatcctgggattacaggcataagccctgcacctggcctagatcgtaaattctttagtgagctgggggtatttcaatttgcttttatcccctattgtttcatgtatgtaaaatatacacaggcgttaattattgacatgttgattcattgaaattataatggggcttttaatagctatagatatgccatgagcacataaaagacgatttcctgattctttgaccctcttaaagaagtttatgatgcctacttgtcattcttgggtccttagaccttctgtggcaatattaggtcggggatagatgtctaatgatttgcagtcagggagctttgataaccattgtcacatgttagcataaatcagaacccaatcacttttttttttttttttgagatggagtctcattctgtcgcccaggctgcagtgcagtggcgtgatcttggctcactgcaacctctgcctcccgggttcaagtgattcttctgcctcagcctcccaagtagctgggatcacaggcatccaccaccatgcccagctaatttttgtattcttagtagagacagggtttcactgtgttggccaggctggtctcgaactcctgacctcaggcgatcctcccgcctcagcctcccaaagtactgggattacaggtacgagccaccacgtccagccgagaacccaatcacttttgactctgccttcaatatatattgcaaatctaactaccttttactacctctacttcttcccttctagttcatgatgccattatcacttgcccagattattacagtagtctcataattgctctccctgcctctggttttgcctctcccctccagcagtgataggaaataatggaagtttttaagtaagcatggtagtatcactggatctgttctttgacacagctggctagtagtgtttggtagattggaataggggcatagtaaatgtgggttgacatggtatagtaggtagtcaagacagtccaacaatcaatcttaaagacatttcattttcttggtagttaaagaatataggcctaccagtacttgtaattttaattttaattgatttatatcattttacttattaatattcatttgaatcttagtttataatatctataatcatatgctatgctcaaatgtaattgagttactttttagagacaaggtctcgctatgttgcaggtttcaccatgttgtccagggtggtcttgaactcctgcgttcaagcaatcctcctgcttcagcctcccaagtagttggatctacagggatggcatgcaccatcatacccagctctgaactattttttaagtaaaattttttttagatgaagacaagcttgtatacaagagtagttaagacagtgtggtactgactcaaggatgtactaatagacaaaggatagaaaacagacccacacacatacagtcatacagttacagcaaagatgccactgggatatagaggagaaaggatagtattgggatcagtggatattcatatggaaaaaattaactcctaccttataccacacaccaaaattaattctatatgattgtacataaatgtaaaatagaacaataacacctctagaagaaatcgtatgaaaatatcatggtcttggttaggcaaagctttcttacaaagaatttaaaaatgttaacaataaagaaaatatagtctggtccaaatgcagtggtatttacaactaattgatcacagccagttacagatttctttgttccttctccacttccactgctttacttgactagccttaggaaaaaacaatttttcaggaaaaataagttggatgtgtcaaaattgaggacctttccccagaagacattgtgaaagtgaaaaggcaaaatataaagtgggcttaagaattatgagaagttcagcacagaggactagtggaagaaaatatgtttgtacataatttctttccctataaccaatactaagaatagagaaccctatatttaactgaaggcagaaaatattttgaggccatatttgttctcattttatgccatttacttagtaaatgtacataccttatagattcatgcatataatatacagtcctcccttggtatcttcaggggattggtttcaggacccctctcacacatacacaggataccagtattcaagtcccttgcataaaatggtgaagtatttgcatataacctatgcatatactcccatgtactttaaatattaatctctagattctttataatacctgatacaatgtaaatgccatgtaaatagttgctataccatggttttttgtattattattattattttttattgttggatttttttcatattttcagttcatagttggttgaatgtggatgcagatacagtgggccaactgtatacatattttgggatcattttagtgggtagtaaaacttggttttccccaactgtttctgttaattcacagccagttatgaaatatgccacatttgtcctgattaaatagtgaaatgtcttagccctttccactgattatattgatagaaaagattaaaaagtggtggataaacctaaccaaaaaaaaaatgttttcataagccactgctgtcagcacttatttgagattttaaaacattttgtagttctttatttttaaatgaccttacattttcaaaagggtttgttaattcaaaaggtctcctatggttaaggcagttcaaatagtagactgagggtagaagagggattgactgtaaataggcatggaggtatcttttgggggtgatgtaaatgttctaaaactggattgtggtgatgtttgcacaaaatttgcacaaaagcattgaattatacactgaaagcatattttatagtgtgtaaatgaatgccttaataaagcttttttttttttttaaggataccattaagataatgaattgtccagccacagattaggagaaaacatttacaattcatgtatctgacaaatgattgtatccagaaatcaataataagacaaatcaatagacaaatagcataatttttaaaaattgggcaaaagacttggacacttcatagagggaaataatctaatggccaaataagcacactaaaagaggatgaacattattaatcattaggaaacacaaattaacatcacagtgagatactgacccatcactcatccacttgaatggttaaaatcaaaaggactactaattgttgacaaggatgcagaacaactggaactctcattctttgctggtgagaccatgcagtgggaccacacatttgaaaaactgtatggtagttttttattttttttttcctggtaaaaattaaccgtacatctaccctatgatccagcaagtcatttacctgagaagaacaaaaacatatatccacaaaaagagttgtgcaagaagattcatagcagcaaacaggcatgttcattaacaagacaatttttcagcacattgtgtttttttttttttttttttttttttttttgagacagagtctcactctgtcaccaggctggagtgcagtggtgcaatctctgctcactgcaacctccacctcccaggttcaagcgattctcctgcctcagcctcccaagtagctgggactagaggcacgcaccacgacacccagctaatttttgtatttgtagtagagatggggtttcaccatgttggccaggatggtctcgatctcttgacctcatgatctgccctcctcggcctcccaaagtgctgggattacaggcatgagccaccgcgcctggcctatgtattcatttaacagtacactactgggcaataaaaataaatgaactactactacccccaactacatggataaatctcaggaacattatgttgaacaagaagagtcagatgcaaaacagtatttgtgttctacattataccattcaaacaaacaaaaacagtctataatagaaatcagaaagtagtttcctttttgttagggggtatagggattgactggtaagagacagtagaaaactttctgggattatagaaatgttctatgtcttgttttggataaccatttaagatccgtacatcgtattttatgtgatcatacctcagtaataagaatgcaaaatgctacaaaagcaagtcaacccaacatctctactaataaatctcaccattttaaaaagaacagtaaatcctacatctctattttgagaaaaaataattataattttatttaatgctatttaacatatgcttatatatgacatataaattgtgaaaagattatttaaacaaattggctaaagaaacttcatgaagaaggtgaatcttttgccttattgcatatgcttttatattgagtaaaaccaaagtgatttcccatggtagcttcttatactctgttctcatactctttcttgtgataaaatggaaactgatgttcttcccatgaaagggtaattatacattaatgtactctttttccctcctgtcctttttttattatgaaatatttcatatatcaaagaatatgtctaacatatgtgtattacaaagtatatcctctgcctccctcctcatttgaagatcctgccaatcctctgcagagctaatgcttattctgactttggggttttcatttcctttcatatatcccttatatatgtagtcctagtaggtgtatacatatgtatatcatgaatagttatatatataataattgcaaatacatcctgtttatttaatgggttatgtttctttaagttccaatacaatattttctaaattagaaaggtattacaattttaaaaaatgtgccaggacaaaattaataccaaattacaagaatggtaaagcttagaacattgtcattgactataaataatagctgcaattctattgttggtttcttttttcactagtccattttgataatatttcttgttgtggccaggcacaatggctcatgcctgaaatcctagcactttgggaggccacggcagatggatcgcttgagctcaggagtttgagaccagcctggacaacatggcaagaccttgtctctatttaaaaaaaaaaaaaaaattgttgtagtgaagcagtgttttctttcccacagaatatcgttcttcatttatttataaaaatatgatttggtatatatgcaaatgtagcttattttatatataaccatactgtaatagtctttgtggtaagcaattcagttaatatgactacaggtttaagatataatgtgaaatttggaatagattttaacttttaaaaaataatttatgttaggctgggcacggtggctcacgcctgtaatcccatcactttgggaggccaaggcaggaagatcacttgagcccaggagttcaagaccagcctgggcaacatagggagaccccgtctctacaaaaaaaagaaaattagccctgcatggcccatgcctgtagtctcagatctccagaggttgaggctgcagtgagccatcaccatgccactgtgctcccacttgagcaacagagcaagaccttgtctcaataataataacaataataatataacttatgttaagggctggtctttctttttctatatttaactgattaaactgattaactgtttgttgtttttttttatgtcataggtgtcagatccagctagcagtgccataagccagaattatagatggaagtgggggagagagagaattgtcagaaaaacttactaagatttctatcctggccaggtatagtggcttatgcctataattccagcattttggaaggccaaggtggaaggatccctggaacccaggagttcgaagctgcagtgatctatgatcatcccattgcactctagcctgggatacagagcaagaccttgtctcgaaaaaaaaaaaaaaaatctaagtggcttcatacagaaagtttaaagttaaatgtatactgttatgaatatcttattaaaatgcaagacaatcagagactgatctaaaagtaatcaaggatgatcatgtcttgggagtatcctgtttctcagttgctctggacagaaagcacctagaaggttgagataattcaatgcaaaatcagagatttccccccatgtaatcaacctcagaacttgagttggtcctaacagtagactcaaccccttggaaaagactaggcagagcaattttcctattgactacatctgagacgccattcattcttgtgtcacatgagacatagcatatactttttaggtctctaataatagcagttctctaagaagcaaactgggatgaaagacactattcacttattttcttaaatggggaaggcattaaaaggagtgaaggtttattaatgccacttttaaagatataaatagtagatttttattctaataagtcatacatcaataaaatttgttattgcagctccggggcagcaattacttatatattgacaacttatacatgttttacatgcccatttgctctccttttcactactgaaatgtagttaccatagcaatgaacacatcacatggttcctgtgctagttctaaaatagagaacagcaatatgccatatgagctctgcttattttctacgtaaggactgcatatacaacttgaggctattccataaccttctcagtgcagatagcttatcattgatttagaaagctttcaaagtaaaaagcaattggcagtaatatatttcaagtctctagcttctcttgtactgttatttgccactgagctaaaagaacagtttcactagctttgaccaccagggactctgctgttgtatatttagccatagattgtctatggaatagcagtgccacttagaagattggtgggagaggcatatatagcattcatggacacattttctaagtcttactgagcaattcttaaccaatcttagcttttctcctactgtctcccttaatgtttcaagtttttaaaaatataggactctgttttagaatttgaggaaaggaagatgccaggcacaactggaggcatgctattagttccttttatgtccattattgttgtgtaaggttttaaaatgcattggttatatagcagtttatctatagaaaaggacttcagatttcagtgcctggtggtatcaggccgtatttatgccttactatcacatttagagtgtgttgtaggctgtcagacctccagaaataaagtaggaacatacccctcttactgtgactcttaccagatacttatttgaaacagtccaagcactggcatattagggaatggtgctaactctttctaaccattaataagcaaaataaatttcaatgtgagcttttggctatactatacctatggtcaagtggcactacaaattcaaaattttaaatattctttattgaaactactaggaacaactgttttatatatagtagaggaaaccagggctttattctcttgactgaaacgtgtaagaagtgattcataggtcttcaaacacaaattagtaaatttaggaagctaaaaaggcatatatatttgactactgatgggggcaatatgttgattgtgtaatatttttatctaccctttcatctcagttataatttaaaaaccatttatatactacataaactatgtaatattggatacttctgtgtctatataatttgcaacaaagtagaataaatggccagagatgttattgtaatcttatggttgaatgttatttcttttttctaggtcattgtttaaaatctggacatcatagaaacagataatgcagagagaaaattctttcataattccaccacatctcaatctttgttattagttttaaaatatgtccttctagacatattttattgtaaaaagtatttaaaatactcattttattttattgccgcaagagagagaagggcatttattgtagggcaccaagcaaggaagatgggcagctcatgcttaagacccaacctccctgctggcttacaagcatgggtttttaaaggcaggggtacatttcaggaaagtagaagttacaggcaaaattgttaatcaatacatagaggttatacatgggttggctcaaaaaggagtaaggttttgagtgggggcttacaggtcatcaatggattaggagattctttgatttgcagttggttaaggaagaaaggctttgtctaaaaacttggggtcagcagaaaggagtgttgaggtttggccttaacataggttagttaggataaggaaacctgttaatcattatggggtgctatgtcagggtcaaggtatgagagcaagccacgatgcactgggtcagagtgaccagtttaggaaattgatagcccacaggtgtgactctctccaggcccctcaggaagcaatttagaacaaagagcagcagtcagagttcagtcttcagtttccctttatcaaaggtctatgtgacagcagttgacattttcttttttctgttttcttaaatttatttattaaaagaagtgtctcattctgttgcccaggctggagtgcagtggcacgttcatagctcactgcagtctcgaactcctggcctcaggcaatcctcctgcctcaacctcctgagtagctaggactacaggcacatgccactgtgcccagctcatcattttctatctggtgggtatgctggcatgttggaggaaggacctggcgagaggtgcttggatcatgggggcagttttccccatgctgttctcatgacaggagtaaattctctcaagatctgatagtttaaaagtgtgtggcagtttcctgctcgtgctctctgtctctcctaccactgtgtaagatgcaccttgcttctccttcaccttcagccatgattataagtttcctgaggcctccccagtcatgtggaactatgagtcaactaaacctcttttctttttaagttacccagtctccggtagttatttatggcagtgtgaaaacaggctaatacacttggtttctgaaaagtaatttggctggctttgaagtggggatgggccatgagccaaaggatgcaggcacttctggaagctagaaaggcaagaaaagattatcccttggagcttcaaaagaaatcaaccctgcatgcaccttgattttaccctagtgaggccgggctggacttctgatgcttcagagacaagggttcctccctcatctgtctcaggaagacttaggactaactttaggctttgaagtaaacagaagctgaaacatttgaatgtttgattttcatgatccagaactcaagcctcataggtcccatgcattccctgaacccaataggatgtcacagtctgcataccttcacaccatggcagtctggcttcttccctctcaggcctgcagcctcatgctctgggcttccctggaagctggtgttgtgggggcctgcagttgccaccctgctgtgtgtcagcactgctccctgacgctgttcatccactgacctccattccttggcccagctgcccaggcatggcagactacacgcaacctgggttgtggggaccaggcggagccagcagcactaggacctgatggccaaaacactcattttaatgaaatcatactttaattctgttttgtatcttctcacataaaatagctagatctcttttcctagtagtacaaacttatctatctgccttattttgtataagagtggtattatatgaatacatcattgtttattcttctattgaaagcttttatgttgttttctgggtttttgttattatagttctgtagtaatatgtcttatgtacttttgtgtaaatagttctataggctcaatctccagaattgaactgccaattcttagtaaaggaaaatttaacttttgatacattttaccaaactgccccttcaggggattctaccaaatcatattctctgtttaaatgtctttttaagctttgccaaactgatatatttaaaatggtattttattgtttcaatttgcagttttagaggtaatgttgtaattctatatcttttcatattatagtgcatttatattttcctcttctcttaactccttgtttgcctagctttctttttcttttggttggttcaatttttccaactaagttttttcatgttgtttttttttttctttttcctttgtatttgggaaataaatccttacttgtaaatacttcttgcagtttgtccattgactttttttttgagacaggatcttgctttgtcgtgcaggctggagtgcaatggcatgatcacagctcactgtagcctcaaccttgcagccctctggccacaggctcctgagtagctgggactacaagtgcgcaccaccatgcccagataatttttttaaaaaatttttttgtagaaaaaggacctatgttgcccagactagtctcaatctcctgagctcaagtgatcctccctccttggcctcccaaagttctgggattgcaggcatgagccaccatacccagcctgtctgttgattttattttcggtgctttttttgtatatggaactttttctattagtatttagtcatatttgttagtcttgtcctttatcccttctagcctttaccttatttagtaatatcagatgatgtgtttcatatgggtctaatttatgcattcattcacttacagaagctaatcatttgagtcctagtgtaccaagtatcttagatgatgggtcattgctgactgtacaatctaagaagaatcttatttgcaacaatgatgctttagcgtagcagcagaccaaattctctaggatgattagcagctaattctgaatattgctgtaaagtcatagtagcatgtaacatgtacagcaatagtaaaaacatgtaacagtttgttccttcctaaaattttgttaatttagtcttttatgtgtccttatatttataaatattagttttgtggctaaaatgtgtacatttttccaagttatagtattgagaagcatagctagtagcatttcacccaacagaaaaaattcctttagataaaagccaaatcacagttggcctcattctacatactgttctacaaattacaaaatcagtaaatgtttattgggtacctgtttttattgctaagctcttgcaagagaaagagagaggtggtaggatttttttaaggtgcgagctattatcctatttttaaagagctcataatctagtttggaatgtttggcataagtacatccaaaggtaaataataaaacaaatgataattgctcaacaatatgtaaagacccccctctccaaaccaaaacaaaacagaacaacaaaattgtcagtctcttctgtgagcagtattatctgctgaggacatgttactggtcgaagagctttggctgcagtcattcctagaatgcaaaatgaaatcatccaaaaaactgagagtggccagttttactagtcaaatggagtaagtggtcatctgtgagtttgtgaatctgtctgccagaatatatttattttcttgcttattccaccagttactccttcttgttaaagctttcaccgttattaaagagaagtacctcctggaaattttagcctgctagatgttgtcaaacctgatagcacagtgtgataggctaagattctttgttcatttgttttggatagggaaggaaagacacaatgaaaagactaggagtctgaggtgagggaagatgatgaagaatatgaatcaagggatcaggcatcaagataaccgttcatttatttaaatgtagactttatctgtcttgatcaggcatcaatataacctacatttatttaaaagtaaactttatttgtctaatgtatgtgttcctaatccctgaatctattcatttcattgaaattgatgagtactttcaatacaaatagttacaatattttaagatgttcactgtttataacatcattatatgagtccatgttaaaccagagaagcagaaccagtagacaatatagatttagagatttgttacaaggaattggatgatggaagtatggaggctggctaagcgagtccaaagcccagtcaagaggaaagcaggctagaaacccatgggcataagctgtttagagtccctcagctcagggaaagcctaagctctctttcaaagggctcacctaactttgccttgtaattttctataatggattcctagagtttaccaactaatatgacggtctagagttacatttaagtgaaatttgattgtgagattgtattcttaactgtctatatctggtgctcttgagcacgtatacaaccttctcgccttctctaggtccctaaaagtcatttcttaattcaaaaaatatttaaatgcctgctatgtaccaagcacttctcttgatagagtggtgagcatgacaatctagtagaaaagtgagacagggaaacaccaacattactgtggaaaacatagttacaggggaagtagaaggacattagtcatgtttttttcttcatgacccactgcctaacacatagtagatgcttaataaatgccttttaaataaataagaccacatggcatttttaaaggagtaaggacctctttaaaaataagtatatatggggaaggaaagagatgatgagaagactaggagtctgagtcttgctacagaactagggtaactggagctagtagaaaagcaaagaagcttctgatttggggatggattcaagagtatattgggatgggtgcaaacactttcactgattagcagtttacatatttccttcaaggatagtcttactctccttgtcctaacttttaacctttgcttcaaattagtttagcagtttgtactaagaggaattgccagtgaccaagtgaatatgatatacatataaaagaacagagaaaatcaagtctttactatgttgctgtatcactaattcaggcttccagctaaatgccagaacataaattaggtcccttatcaaatctggcacaaaaatatttaggatcctttttaatatagtacatgtgctttcaataaatgcctgctttggcaaaaaataaaaccagtgttttttgtgtcaagtacaagctgttgtactctgtaacttttaaactgtccttgtgaaccaggttgagggtaaaattaaatttggattttgtattcagttttacaatcaacaaataccattttttttctttgtgttgtgttgtcttatgggtgtttgttttattttggtttggttttggtttggttttcacttagaacaaaattcaaaatctactaaatactccctagccacactggcctgttttcagtttgagatttttttatttttaattttttttaaagatgacatcccactgtgttgtccaggctggagtgcggtggctattctcaggcatgattatagcacaactacatccttgaattcctgggctaaagaggtcctcctgcctcagccactcaagtagctgggactataggcttgcacctccacacctgacttctttctgtttttaagacagttgagctctttcacctgtcccctcaaactgtttgtacatgctcttccctctgccttgacctatttttacatcatgttcagtgttactcacccatcttactctcactaatttattaagtctcaaatattttctcagagattctttcttcacccatgcctccatatctcagttagatctcccttaaaaatctcttctgtgttactagttcctagcatatagtggatgtgtgataagtgaaaggatggactgaaacatagagcacatacaataggtatattctagtcattataaaatgtcctcaaggaactttcttaaatctgagttccaaagggccatgttattttgtaaataatattcttacttttactttagggaacaaaatcagcatttttaaatgaaatagatttaaaaatataggcatgtacattgtataaatgcatgtatacatatgtctaaatatggcaagttgcaaagtaacatgaataccatgattgctgtcataaaccttgaaagccactgtgttagtggatactgttgtataataatctccaaataagcacgtctagaaaacaacctgttttacttatcaatttccccaaacatctctctggtgactgcgtctttggcttcttttttatttatttatttattttttattattatactttaagttttagggtacatgtgcacaatgtgcaggttagttacctatgtatacatgtgccatgctggtgcgctgcacccactaactcgtcatctagcattaggtatatctcccaatgctatccctcccccctcccccaaccccacaacagtccccagagtgtgatgttccccttcctgtgtccatgtgttctcattgttcaattcccacctatgagtgagaatatgcggtgtttggttttttgttcttgggatagtttactgagaatgatgcgtctttggcttctaagagttctttgctgagagtaaagagccagaatctcagaaatcccccagaaagacgatttaagttaaatgcacccatcaagctttgaaggaaggcggcttaaaaaaagaaaaacactatattacattctacttttaattttcaaaacctgaaaaccttctcaaatccaggaaaactaatggtatttccatctattctctttgatagcccacaattcctatgattttcttagcatcccataatacattttgcttttatccttttactgtttttcttcctagaattttctttcaaggtccaacacagaaatcctttttctcaacaaacctttcctgactaaccctgtttccttttttaaaattctttgcattttctcaacagtttttgatatttattttttaacgtttgtatacaatactataatacagtcagttatttataactttattttgtgttagaagtaggttttttgtgtgtttgcattcttcctaattttacatgtgcaaaaagttactttaatcttatttttcttaaatgaaataatccaattttaaatccctttcctggagaattaaatataagtcattttgggggtgctttccttcacctcccccagaatctcacacaaaataaaacattcagagaattaatcgcccctgccccaccccaccctaatcttctgtccatgttggctgtcctgagttgtccactgttaaaccacataatcccttatagttcagtggctctgttgcttcttaggacatgaacatcttggccaaggcttcaatagctttctgtgttggatattttctcctggcatctccagatagactttttactcttttctttccctattctgtgcccaaaggccctgagaaaattgctaagtattagtaacatggagaaaaaagggatatagtttctgggactgtaaattattcaaaggatagttttaaagctctgggaaagtttggtgaaagttaaaaacgtgttcagagaggaggagttggagcctagtcaagtcacaaatcttctaattcagccaagctctagtagcactcctgaaacattactactatatccttaacatgtgcttttttagttcatgaaacaatattggcataactgttcccctaacaacttaatgagaaagttaaagattttaacaactcaagattgctgcctatgatacttatgatttttaaacaagttgtcatatcaataataataataaaaaaaccataaacctagctgggcatggtggctgacgcctgtaatcccagcactttgggaggctgaggcgggcagatcacctgaggttgggagttcgacaccatcctgaccaacatggagaaactccatctctactaaaaatacaaaattagctgggcatggtggcgcatgcctgtaatcccagctactggggaggctgaggcaggagaatcgcttgaacccaggaggcagaggttgcagtgagccgagatcatgccattgcactccagcctgggcaacaagagcgaaactccgtctcaaaaaaaaaaaaaaaaaaaaaaccatgaaccttcctttaggaaatagagcaatgtagtataaccccacttgcaattttatttttcagattaatgaatatgattaaaattaagatggaataaaaattaaaacaattaaataaaatacaaattggttgtataataaagacaaaattgttatcttgagacacatgttgcatctttccatatgttctaaaattccttaggaacttggcacaagtgctgctgaaataatttctgactgataagtggcagatgccttatcttttattgtggtattaattctaaatcccatcaaataagacaatgcatgatacaaaggataaatttataagcatttgcctcccaatttagacacagaatcattatcatagtacattcactttcaacttgtttctatgttctttctctccttcacatctggcctcttcatgtttttattttctctctctctcttttttttttttttttttttttgtggagacagtctcactctgtcacccaggctagagtgcagtggcacgatcacagctcactgcagcctccaactcctgggctcaagtaatcctcccacctcagcctcctgagtagctgggaccacagacatgcaccaccacacccggctatgtttttgatgtcttgtagagacagggtctcactatgtgagaggctggtcttgcactcatgggctcaggcagtccttcctcagtctcccaacgtgctgggattacatgcgtgagccaccatacctgggcctgttttctctttcttttcattctaaccataatcacttatctatttatggtttttgtttctatttctgaatacatttaaatgccagttataaaatcagaaattcttatttgtgcttaaacatagtaagatttagcagtagtttgaacttcaacatgattattaaatgtggattttaatactagtgatgattcacattttccaacttttatactttacaatttgtttttcttgatgagagtttaggtatctatgaatgaggagaaaagttaattgaattttggcttctagaaacaagtaattaatcttttcctgttaccttttaaaaagatactttactttttatagaaagatagcagtagaaaagaacaggtatttaaatctactcactgacttagaccaattatttcataatggaatctctacttctgtgaatatgtgttttgcttaacgagacctcctaaaaactcatttttatggtcattgaattttagagttagaaaagactttagaaagtgttattagcctctcattttttaaaaacagtttgtatcttgcccaaagtcacactaggggtaaagtaagaggcaaaggaagaactggaattcaagtttctagattccaagtccaggactctttctttttatctcattattttatgaaacatggagagcaagctgattgttcatttaagttcattacactgtatcttggaatttgtcatttctatgcttcactatttaaattaaaatattttatgtttatcacctgttttttgatctgccatgtaagaattttcacttattgtcttccctttaacattgagtctgcatactgctgctaaataatctttctacagtatagtcctaattatgtccctcaaaaaccataatatatctcaccccttctatcagccacatagttaaataaattaaatccaatcatttaacccattgcagactaaatctgcctttcaaatcttagtactttccactcctctgctcatattttatgggccaggcaaatggactacttacttgctattctcaggacacacgtctcatttttcataccactctatcctttcttatacatataacaactttgcctaaaattgtgcccatttgttgagactttgatcaaatttcacatttcccatttcttttgttctctctctctctgttttttttgttttttttgtttttttttttttttttgagatggagtctcgctctgtcgcccaggctggagtgcagtggcgcgatctcagctcactgcaacctccgcctcccagattcacgccattctcctgcctcagcctcctgagtagttaggactacaggcgcctgccaccacgcccagctaatttttttgtatttttagtagaggcagagtttcaccgagttagccaggatggtctcaatctcctgacctcgtaatccgcccgcctcagcttcccaaagtgctgggattacaggcctgagccaccgcgccaggccctattctctctctttttaattccaattacagtgtagtacaagcttgtccaaactatgacccatgggccacatgcagccctggatggctttgaatgcagcctaacacaaattcataaactttgttaaaagattatgaggtgggtgttgctgggtgtgtgtgtgtgtttagctcatcagctgttgttagtgtttgtacattttatgtgtggcccaagacaattctttttcttttaattgtgaccaaaggaagccaaaagattggacatcctttatgtattatattctgactttaaatattgctttccccttaatttttttttcattgtcatctcctcactttattgcaagtacagtcagcatcaatgttgagaactttttctcctaggaggtacaggatttggctctgatacggtgttgcctccacagttgctcagaatctaggctccatctgttacaggaaaggggtcctaatccagaacccaagagaaagttcttggatcttgcacaagaaagaattcagggcaagtccacagtgcaaagcaaaagcaagtttattaagaaagtaagagaataaaagaatggctactccatagacagagcagccctgaggactgctggttgcccatttctatggttatttcttttttttttttttacatgttctattttttaataaaaatatttatttggtcttatgaatacagaattattttatttttatttcaaatgcctaggtattataattctgtataatagttatttgtactttttatatttttatcttttttttattatactttaagttttagggtacatgtgcacaacgtgcaggttagttacatatgtatacgtgtgccatgttggtgtgctgcacccagtgactcgtcatttaacattaggtatatctccaaatgctatccctcccccctcccccaaccccacaacaggccccggtgtgtgatgttccccttcctgtgtccatgtgttctcattgttcaattcccacctatgagtgagaacatgcattgtttggctttttgtccttgcagtagtttgctgagaatgatggtctccagcttcatccatgtccctacaaaagacatgaactcatcattttttatggctgcatagtattccatggtgtacatgtgccacgttttcttaatccagtctatcattgttggacatttgggttggttccaagtctttgctattgtgaatagtgccgcaataaacatacgtgtgcatgtgtctttatggcagcatgatttataatcccttgggtatatacccagtagtgggattgctgggtcaaatggtatttctagttctagatccctgaggaatcgccacactgacttccacaatggttgaactagtttacagtcccaccaacagtgtgaaagtgtttctatttctccacatcctctccagcacctgctgtttcctgactttttaatgatcgccattctaactggtgtgagatggtatctcattgtggttttgatttgcatttctctgatggccaatgatgatgagcattttttcatgtgtcttttggctgcaaaaatgtcttcttttgagaagtgtctgttcatatccttcgcccactttttgatgaggctgtttttttcttgtgaatttgttggagttcattgtagattctggatattagccctttgtcagatgagcagattgcaaaaattttctcctattctgtaggttgcctgttcactctgatggtagtttcttttgctgtgcagaagctctttagcttaatcagatcccatttgtcaattttgacttttgttgccattgcttttggtgtcttagatttgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacttatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactatagccttgtagtatagtttgaagtcaggtagcgtgatgcctccagctttgttcttttggcttaggattgacttggcgatgcgggctcttttttgattccatatgaactttaaagtagttttttccaattctgtgaagaaagtcattggcagtttgatggggatggcattgaatctataaattaccttgggcaatatggccattttcacaatattgattcttcctacccatgagcatggaatgttcttccatttgtttgtatcctcttttatttcattgagcagtggtttgtagttctccttgaagaggtccctccttgaagaggtccttcacatcccttgtaagttggattcctaggtattttattctctttgaagcaattgtgaatgggatttcactcatgatttggctctgtttgtctgttattggtgtataagaatgcttgtgatttttgcatattgattttgtatcctgagactttgctgaagttgcttatcagcttaaggagattttgggctgagacgatggggttttctagatatacaatcatgtcatctcaaacagggacaatttgacttcctcttttcctaattgaataccctttatttccttctcctgcctgattgccctggccagaacttccaacactatgttgaataggagtggtgagagagggcatccctgtcttgtgcccattttcaaagggaatgcttccagtttttgcccattcagtatgatactggctatgggtttgtcatagatagctgttattattttgagatacgtcccatcaatacctaatttattgagagtttttagcatgaagagttgttgaattttatcaaaggccttttctgcatctattgagataatcatgtggtttttgtctttggttctgtttatatgctggattacatttattgatttgcgtatattgaaccagctttgcatcccagggatgaagcccacttgatcatggtggataagctttttgatgtgctgctggattcggtttgccagtattttattgaggatttttgcattgatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcagctgtgaatccatctggtcctggactctttttggttggtaagctattgattattgccacaatttcagagcctgttattcgtctattcagagagtcaacttcttcctggtttagtcttgggagggtgtatgtgtcgagggatttattcatttcttctagattttctagtttatttgcgtagaggtgtttatagtattctctgatggtagtttgtatttctgtgggatcggtggtgatatccccttattttttattgcgtctatttgattcttctctctttttttctttattagtcttgctagcggtctatcaattttgttgatcctttcaaaaaagcagctcctggattcattaattttttgaagggttttttgtgtctctatttccttcagttctgctctgattttagttatttcttgccttctgctagcttttgaatgtgtttgctcttgcttttctagttcttttaattgtgatgttagttttgagcctatgtgtgtctctgcacgtgagatgggtttcctgaatacagcacactgatgggtcttgactctttatccagtttgccagtcggtgtcttttaattggagcatttagcccatttacatttaaggttaatattgttatgtgtgaatttgatcctgtcattatgatgttagctggttattttgctcgttagttgatgcagtttcttcctagcctcgatggtctttacaatttggcatgattttgcagtggctggtaccggttgttcctttccatgtttagtgcttccttcaggagctcttttagggcaggcctgatggtgacaaaatctctcagcatttgcttgtctgtaaagtattttatttctccttcacttatgaagcttagtttggctggatatgaaattctgtgttgaaaattcttttctttaagaatgttgaatattggcccccactctcttctggcttttagagtttttgccgagagatctgctgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtgtttgctgaatctgaatgttggctgccttgctagattggggaagttctcctggataatatcctgcagagtgttttccaacttggttccattctccccgtcactttcaggtacacaaatcagacgtagatttggtcttttcacttagtcccatatttcttggaggctttgtttgtttctttttattcttttttctctaaacttcccttctcgcttcatttcattcatttcatcttccatcactgataccctttcttccagttgatcgaatcggctcctgaggcttctgcattcttcacgtagttctcgagccttggctttcagctccatcagctcctttaagcacttctctatattggttattctagttatatattcatctaaatttttttcaaagttttcaacttctttgcctttggtttgaatttcctcctgtagctcggagtagtttgatcatctgaagccttcttctctcaactcgtcaaagtcattctccatccagctttgttccgttgctgctgaggagctgcgttcctttggaggaggagaggcgctctgctttttagagtttccagtttttctgctctgttttttccccatctttgtggttttatctacttttggtctttgatgatggtgatgtacagacgggtttttggtgtggatgtcctttctgtttgttagttttccttctaacagacaggaccctcagctgcaggtctgttggagtttgctagaggtccactccagaccctgtttgcctgggtatcagcagcggtggctgcagaacagcagattttcgtgaaccacaaatgctgctgtctgattgttcctctggaatttttgtctcagaggagtgcccggccgtgtgaggtgtcagtctgcccctactgggggatgcctcccagttaggctgctcaggggtcagcggtcagggacccacttgaggaggcagtctgcccgttctcagatctccatctgcgtgctgggagaaccactgctctcttcaaagctgtcagatagggacatttaagtctgcagaggttactgctgtctttttgtttgtctgtgccctgcccccagaggtggagcctacagaggcaggcaggcctccttgagctgtggtgagctccacccagttggagcttcctggctgctttgtttacccaagcaagcctcggcaatggcgggcgcccctcccccagcctcgctgctgccttgcagtttgatctcagactgctgtgctagcaatcagcgagactccatgggcgtaggaccctccgagccaggtgcgggatataatctcctggtgcgccattttttaagcctgttggaaaagcgcagtattgaggtgggaatgacccgatcttccaggtgccgtctgtcacccctttctttgactaggaaagggaactccctgaccccttgcgcttcccgagtgaggcaatgcctcgccctgctttggctcacgcacagtgcgctgcacccactgtcctgcgcccactgtctggcactccctagtgagatgaacccggtaccccaaatggaaatgcagaaatcacacgttttctgcgtcgctcacactgggagctgtagactggagctgttcccatttggccatcttggctccgctactttctttctttttttttttttttttttgagaaagattctcactcagccaccaggctggagtacagtggtgcgatctcagctcaccgcaacctccatccacctccgacattgaagcgattctcctgcctcagcctcccaagtagctgggactacaggcgcatgccaccacgccctgttaatttttgtatttttagtagagacggggtttcaccttgttggccaggatggtctcgctctcttgacctcgtgatctgcctgcctcagcctcccaaagtgctgggattacaggcatgagccactgtgcctggccattcttgctactttcatagcaaaacatttggctttggctttgctattctgctttattgtactctttgatatccagtatctaccagtaatgtctggactgcatacatcgttgaaaatacaactgtaattaaagatttaaatgcaatattctttcaggaaaatctctttccctgattttgtttgatattggaaatgaaacaataccataatccttcaggataacttcccacagcaggacaactgcaggaatggcacaaaatatgaattgcataaatactcttatagaacacatcagactagcactttcccaagtttttagtcagatctttgctaccatccctgaaactgttaatgcatatgagtagaaaaattttttacctttgtaagcaaagattctactactagaataatcaaattaactcattctaatgcacatttacttaattcatactatgtgtgaggcagttttaggatgtgatagaaaactttgttttgaagaagctgataaactaggtgggggggaaacagagtacaaataaattataatgcaacataagaaatagcataatagaagaatattcagaccactaaagtcagtcaactctgatccccaaaattaagtatgaaccacaaaaaaatcaagtcagtgtcaatctaatgcagatttatttgagggcttctcttttcttctttgcttaatgtaggtgagtgctttatccttgctatttggtaaatcagcaaggatttattatctattctttgcagagtagtatgttagatgctttgaggatactaaatgaaaaagagtttctgcaccaagaatgtataatctagtagaggagataagctatctatacaaataactgtgtctgcagtctgcacataattgttataaaagaagcctttacaacttgagccaaattcttttacaatgcagaaagccactcctggaggtagagaaaggagagaacatgaacaattcaagaagacttctgttatgcaaaagatggctgaactaaccctggagggatgggtaggattttgacaagagtggttgaaggtattctaattcacttagtacctacatgtgcgaggcagcatgaaggcaaaaaagcctggggcatgttcagagaatagcaagtattctagtttgagtggcacctggtacgtatataagggaatagtaaaagatctggctggaaaggaaaagtaggggcaggttacgaaggacctctgaaagtcagactgtggaactggaacttttatcaggaagcagtagttagttttttcaagcaaaagctaattagagttgatatttaggaggatgaatctaacagttgtgtgcaaggatgccttcaaactgagtgagactagtactggagactggttaagagactacaacaataacctgagtaagaattaatacaggcctgacctagttttgagtgagtaggattggaaacaagagttttaggtattataggatttatgcatataaaatggacttgacagaacttgaagaaagagaaagtgtcaaaaggacacagaaagtgaggcaggatatcttacaatgttaaaggaaaggaataatagaagttaccccccaccccagagaaaaaaaagtaaagagaaaagattggaaagttaaaaactgaacttttagagaaagactgcatttagggaatgtagcaaataagataagcaacagaaaagtgagagaatgggaataaagatatgcaacagaaaagaagggaagagagttcctaggaaagggtggggaaattcaaattctaaaatatcgatgaagtctcatttttcatgtattaaattatccagtggagttggaagatccaaaagagagcaattaaatatgctagagtgcatggggaaaattgacaaaagacctaaaagaaaaatatttaaccacaaaatgaaaagtaataggagatgctaagaaattttggatgggagttaaaattaaatctctgaaagaataaaagggaattaatactcaatttatatcttaaataaatatttctaaatgttacactatgcagaaatccttcttccctggaaaaaatgagatcaagtcctattcaaaaaggtcaagaagaaagactgaggttggtgacccgtgagaaaagtttctgagataagtgtaggtggaatttgtagtattatttatcataagtcagatggctgttaacaaaaagttaattttacatctcatctgttagcccagtcgctttataatgttcggtacaacagaaatgccactactttgtaaccacctaaatgctgtattaccttcaatttccattgtgttgttgatacccaagcagaactcattctttgtcatggagactacagaataccacaagcaggcactaaggttggataatgtgttatctcacattctgaaaggagggtctacatggtagatacatttcttgattctgttttgggataattggctcctaagataattggctatttcattattaaatgcagtatgaactttgcagaagtattcagtatctcttaaaacctgtttcttttccatatagcagtggtacctactttcaatttagtatttattcaccatctactacatgctccacttagtgttttgtattatttctctgtgtgtgtgtgtgtgtgtgtgtgtgtgtgtgtgtgtgtgtgtagtctaacttgtacatttggccaatttctttttcaagcatgttagatttttctctctgacttctttgtagatgtggggtagttttgttttttacttaagagacctgtattgattatttctatggctgtccttgctaattcccactggccattgtgaaaaatcttgtctatggtgtatttgtttctaagacagccacattacaatacactctgtacataattactatgaatcagctggcaagaaagaagaaaataatactggttattggtaatatttgttgattttatatgttagctttattaaagatttttttttcttatcttttttctttcaactattgctacctctgaagaggcttttggtagtatttagatgggttgtgctatccataggtaaaaattctgacctgggggatattacctttatttttcactagatgtaggaaagtagatgctgctctgtttttactccattttgttacattaaaaaaaaattacaatgtagtcctataagtttctttttttattttatccagtactattttagactgtgaatattactggaatttctagttctattccctcttctccctctaaaaatcaaaagtgccaaagagtagtagaccttttgtgatatgttctagtcaaaatagctaaaaactagcgctctctctttaaagttcatattcatctagaacatctcacaccttactcttaccactttactcacagtagtttaaaaaataaaactgtaccctgtatatttgttcatttttgtgttttatgtagagtttccattttgtttttactttttttcaagagtgaattttgtaaaacttccagagtagagtaagttacggccattagagtagccctggaggatgagacttatagtggcaatgattatcacaccttgacaacttgggaagggccatgggatgtggatgtggaaaatatataaaaggacattggttcacatttgaacaaagtggaaggaattattagaaaagcacttaacaagggtgctgatctctccccatctgaggtcttctttcttcttttcatctaattttaagcactgatcagtgaattctttctcattattttacataagcaggtatctaaacttataaaaaattgattatttatcttgtcttttagtgcctttttattaatataagttatttggtttttaaattgtgttgccaatgaatgaaggaagtcctgtcaaaagatatacattttacttatcttaaggctaacagccaccatgtccagcctagcaaacattttttttaatgaaagtccaagtagtatggtctctgttaagctactctacttcaactctgtctgtggtagcataaaagcaaccatagataatatggaaacaaatagtcatttgctgtattccaataagactttataaaaacaggtggcaggatgaatttgtcctataggctgtaggttgctgatcctagcataatgtattgattatacattatggtagagccctctgttggttggaagagaggaccagggaaaaaaaagtgaagatgtattagctatacagaactttctagttggtaagacaaaaagcaagaaaattacagtaatatagaatatgtaaaataaaggaggattcagaactgagtaggtaattcttcagagcatgtcaaatgtagattatggtaaagtagaatgtttatggtttaatacatcaagaactatatccttcataaaataaaatgtagctggacatggtggctacatcttagccaccatatttttacatgtacatgtttggtacaggcttatggtggcatgtaattccaacattttgggaggccgaggcaggtggatcacctgagatcaggagttcaagaccagcctggccaacatggcaaaaccccatctctactgaaaatacagaaattagccgggtgtggtggcgtgtgtctgtagtcccagcttctagggagactgaggcatgagaatcgcttgaaccggggaggcagaggttgcagtgagctgagatcatgccactgcactccagcctgggcaacagagtgagaccctgtcttaaaaaaaaaaaaaaagtgaagaacaaggtaagacacatttaatatatctgatcaagtggtcttgtccaaaaaatgtcctgatacatttttttaaactaataaatggaggattgcagacttactgaatatggcaggatcctttagcatgtaatactttaaaatggatccacactgaacttctgctggatgtactggagtaagagtggccagatttatcctccctcctcaaacaatgcaaaaaccagacaaggtatataacataagagtttttagacactagacaatactgggcagtgatccctgagagaaaatgaatgaggcatccctacaatttccatagcattctgcctagatagcttccagtctgtagtctgcaggaaggagatccaaaacagaaagaacccagtggcccaactgaatggagacaaagccaaggtggctagaatttgcatgagacagtgcgagagaagacagagctccacagagatagagcacacacactggatatctgcagagggctccccttgatttttaagccaagtactgaaccacataagtatgctaggaaactacttagggacagggataaagccactggaaaggaataagtggaacatttcctgaactcagataagattaataatagtttatagccccaataatcacagtggaaaagcctctaataaattggacatcttttttagtactcaaaagaatattacatcagttggggacaatattagctctagattaagagctgctctcatctcacctagtaaagcttctaaataagcttgtaaagaatcaagttgtttttgagtaaccaactgaatttcagagtaaagttagggccattagagtagccctgaaaatatataatgagaaacaaaatatttgatatggtttggctgtgtccccatccaaatctcaccttgaattcccacgtgttgtgggacccagtgggaggtaattgaatcatgggagcaagtctttcccatcctattctcatggtagtgtataagtctcatgagatctgatggttttaaaaagaggagttcctggccaggcacggtggctcacacctgtaatcccagcattttgggagtccaaggcaggtggatcacttgaggtcaggaattcaaaaccagcttgaccaacatggtgaaaccccatctctattaaaaatacaaaattagccaggcatggtggcacacgcctgtaatcccagctacttgagaggctgaggcaggagaattgcttgaacccagaaggcagaggttacagtgagctgagatcatgccattgcacttcagcctgggcaacaagagcaaaactccatctaaaaaaaaaaaaaaaaggagttaccctgcacaagctctctctctttgcctgctgtcatccatgtaagatgtgacgtgctcctccttgccttctgccatgattgtgaggcttccccagccacatggaactctaagtccaaataaacctctttcttttgtaaactgcccagtcttgggtatgtctttatcagcagcatgaaaatggactaatacaatattctacacctaaaacataaaattcataatgtctgttatccaatcaaaaattacctttcattacctgagaaaggcattgttaaaaaataaataagtaagccaggcacagtgacaaatgcctgtagtttctagctacttgagaggtggaaacaagaagatagcttgagcccaggattttgaggccagcctgtgcaacacagcaagaccctatctcagtcaatcaataataaatacacacacacacacacacacacacacacacacacgtatatataaccattcatgcgaagaagcaggaaaatacaacccataatgaggagaaatattaatagaaatggatttagaaatgatacagatgttaggattcgttgacaaagatgttaaaacagcatttctaaatatattatgtatttcaagaaggtaaataaaaacataatcctattaaagagtaatgtgggaaatgtaaaaaaagacctaatttctagaaataaaaaataccatgtctgaggtgaaaagttcactgggtaagatgtggcactacagaagaaaagattaaggatcttgaagacatagcaatagcaattgttcaaaatgaaacacctagagggaaaaaaagactggaaaaacaagcagtgtcactgtgagctgtgagacaactttagatgatcaaatatataaagactacggatggggcagggagacagaaaaaatatttgaagacataagggctgaaatttttccaaatttgataataactgtaaacccacaaatccaaaaagctcaacaaaccaaaagcagaagaaacactgaaaagctacaccaaggaacataatcaaattgcataagatcagtaataaagaaaaaaaacttaaagtagctaggtttctaaaaacaacaacaacaacaacaaaaatgcattacatacagagaaacaaagataagaatagcagcagtctcctcaacagaaacaatgcaagctagaccttggaacacagaaggaaagagaatattaacccagaattctagacccagtgaaaatacctttcaaaaacaaaagcagaatactttttcagacgtataaaacctgaaagagttcatcagcaggagaccattcagaaagcctcagatctaaatgctgcctgtaacaattacctgctgtatggccttggacatacttgaatctctctgaaccttcaaattttcatctgtaagataaaaataatgctaatttttaggggtttcgtgagaatccaatgatagaaaggaaaagaactgacattcattgaatgtcttctttataccaaccacgtattatctcattaaaaatggaaataacctgcctgggcaacatggcaaaaccctgtctctacaaaaaaatacaaaaattagctgagcatggtggtgcatacctgtagtgccaactgtttgggaggctgaggtgagcctgggaggttgaggctaaagtaagctgtgatcctgccactgtattccatcctgggcaacagagtgagacccaatctcaaaaaaaaaataaaaaataaaaatggaaataaaattcccaataatagggctactatcctaacatttttcttatgctagcctctttcttcttgttctttaatactaaaaacttgggttgttctgaaagaaattagtctaagtagcttgtctgtcttacgttttgatgaagcactttttcctaacttaatttgttctttagttaccagattaaatatgcttaaaagtgggaatgaacaactctccttgctagaatagacaagtcagttaatcactttgtgaaacagttaagtttcttgtaaactgcactttatttttttgcctgtgttttggctgcttaatttttttcagttatgtttattgaggtataatttatatactgtttatctaatttttattataaacctattggatagaggcatgagtgtctttatagctgtgcattgccccatagagtttttggcactcaataaaatgttaaataatatttttattcagcattctgtagacgggaagcatatggtaacaaatgtcagagcacaggttgaaaatctccaaaaagttatatgatatattctttggaaaagctagtagagatacttttgtgaatgaaatttctcttaaaaggggttcccagactcacattttatgcaacaaatttctccagccttcagttactttatttacaaattaaagtttttccttatcagaaataatgcataagttaaaatagtataatactaacgtggtatcataagaaagtatataaatggtttgatagataacataaagtaaaggtaactcatagtttgaaggacagcatgagaaaatatttagaagctttagcagtataagtctttatgttgtgatatattgtatgaaaagaaatacacagtggatagttctttattgttaaatttcagcatgacttagttatgtcactgctacagctgttgcagacattctagtggtaggagactttgactcaatattgtttttctcacctgaggattctagcactatttaatactcttattttagtgtcagaaacaatcattgcttcagaataacagaagacattgtgaattaaaacttcaaataaatttcatgcaaaggataatatctcccggttaatctgtgttgaagaaatggttgaccataatcaggtatacaaagccatttagatagcatatatctaaattttctttccagaatttgcttaccctctgatttgctgaccacacttgctttgaagttttggtttttgttgtcttgctatgttgcccaggcatgtctcaaattcctggacacaagcaatcctcccacctcagcctcccaaaatgttgggattacaggcatgagccactgcacctggccactttgaagtttttattaacataatttgaatgtgaaattacctgagtttttcttgttaacctcatgtataaaatgtgggatagggaatccaggcactgcttacttagcttggtgcctctggctctcataagacttttaataaaggtgtcaaccaggtttgtagtcatcttgctgctcagctaggggaggatcttcttccaagcccactcatgtccggtcacagccctcagatcctcactggttattgatcatgcaccactccatagtcctcacaacattgcaacttatttctcctagagcgagggctcagagagagaaggcttgtgatcaagaagatgaacaaaacataccatcacttttgtcatatatttgttaaagcaagtcactaggtctagagcacattcaaggggaggagaatgtacaaggatttgaataccaggttcaaggatcattgaaaaccattttgaagactgcctcctacacatataatccacagatgggacagatcattaaagtactctaggtgctctgacactcatttgtttatcctgagatcttaacaagaacttgaattcaataggcaaaatgatttcagtttcacataaagtatttcatttattcctagcaacaatgcaacgaaataggtatggttaaccccaatgttattgatgaagaaattgatgtactgagtgactggctcaagattacatagcaaataatttgtaaaactgggaccttagtgtaggccttttgattctagaccctgtactctttccattggctataattgcttcctaccagtactatgttgcacttaaagccattcaaggagaatattatacctctaaatttatatacaattatatgaatttttattatacagagatttttatacatatatgtagagaaagacagacacccccctgtcttaatctctaacctataccactccgtttaggagttatagtattattgagtcaaagtctaatatcattataaggcctgtaacagctgtagcaatgacacacatgtacacagatgctagcagcctaaaactacacttaggaggtaaatgtttgttgcatggagagatgaagaagcaaagtaagaaaacagacctggtctggtggctccattcccccttggcttgtcagtatacagaaatcattgtgtttctatataactagtaacaaataattggaattgcagtgagtatgggcaagttatggttttagtttaatattgattatagataattctactttataagtaagaacttgtgttatcagatgaaatatagagaaagttttctcctccatagttgtctttcatatacgcaaacatgcacttgagtttctttcctttcctgcataatctgaggattgtgctttttaatagtggcttgctgatccctttaaatagctcttaatgtaagtattccatagttttcattaatctgattaacatagtttttccctaacctccattcaaaaactatatttggttgttgttttaccctggttgctgaagcagcaagcctactgcaaaacctaagtggtgtggtatagatgagagtctaagactttaattatatgtcattttattcacaacactcaattccaggaaggaaaaaatgggtctgtttttgtaaaggacatattatgtgagtatcattcattgtaaaccaaaaatgatactgtattatagcatagacaacaatgagaactgattctgaaaatgtgacctgactgagaaactgagtaatagtgaaagttatcaaaatggaaaaaaagcgttaatgtgaaatccagccttctcagaaatactctttcctggcctgtttagttttgcttttgttgcttgtcatgcatgaatgaaagtgctgtactctcaggggagcaggaaagcctctgtgtcggttgtttatttccttaatccctcctcctttgtgatttttgatgtcagatctaaaatggaaagcctgtaaatataatgattatcacacggataatcacctgcattaggaaccgccctgcttttctattctaacccgagctgttctccacatgtcacatccactctgtggttggattttaacctgactgcttcattagatttgtgaaactcagtacgaggcgccctggggcagcacagatggggacttgcttgttttcttttctcacttttactgcaaaggcacactaaaaagtccttttcaatttagtgcgatcagttcacttggaattatctctgatatttggaacctgtcttgctcttctgcccaccaactatgcctattctttcttccttactttctgacctaatgtcttttctttctgcctctgcatgtcatgaatctgacaactaaaattctgcttacaattcttactgggtcaaactgttcccccgtgttgttttgtttgttttgctgacagggaaaaataaatgttgttccatcattgtacctacaaacaccttcagatcagaggttagctgtgggaaagtctgcagtgatatgagccagctgccttctctaatggagtgacttggggcaccagtccaagatcagaggaaggtgggaggaagtcagaagataagatcattttaagccacagaacaacaagcttagcttttctagtgatagggcacagctcagcaaacctgtgtgagggggcactaagacaaaaaattgagttgactttttttaagtacatctttcctcagtcagaaatatgttgatgcttgaaatagtttacagacatggaagtgtcctagggcctggtttccttaaaagataatgatttgacatttatatatgtgtcttcttgcagttagtcagctccataccataacagatcacagttaatttttaaaaataatttttttgggctgggcatagtaactcatacctgtaatcccagaactttggaaggccaaggcaggtggatcacctgaggtcaggagttcgagaccagcctgatcaatatggtgaaacccccatctctgctaaaaatacaaaattagctgggcatggtggcacacacctgtagttccagctactcgggaggctgaggcaggagaatacctttaacccaggaggcggaggttgcaatgagctgagatcgcaccactgcactccagccagggctacaagagcaaagctctgtctcaaaaaaaaaaaaaaatatatatgtatatatatacacacacacatatttatatacacatatatatacatatacacacacataaattttttacagttaatttcttatatttgagcaaaactggacattaaaaaaattttactgtatgtgaattttgagcatttatggcttagtgcaattttagtcctacacattcttcctttgaactttgtcttacagtcccctggggttctctcatgtctctgatgaagttccatataaataagtggttctagtatagcttttttgttgtctttttcatataagaatttgcttggttcagagtgacagcttgggaagcactacatcaatagcttttgaaccttttcctattccttgatatcaccgccagcaaatgttactgactatgtgatgtacaaagttctaaccttgcttgcacaaattgaccagttgtcaagatcaatatttatttgcttatttttgtctacatgaactaagggtaacttggtcaggcttatgtttctctagtaaatagcgtaaggagttgtactttcaacttaacacttcctgttgacttcagtgtttagctgtaatcatacattttgacctttctaaatcctcaaaatggttctctaacctatatgttattagtacattggaccataggtgcatacatgtatttttttcccaatgttttcccaaatttctgctgaagacactgactgtactttctgccttacatggcttgatgctacagtcgttttagttgagttggatctgctcactactcaggctcaaatcccatccttctattaatatctcttggcaaagataattttggaagaatgtgagttaagatgtagagactcttgacagttgtctgcagttttttttttttttcattttcaagagggaagtagagttgaaaagtaatattgcctcccttttctatctgtcctaaaattaaagtataagcacaaagagtgaagaaagggaaaggatttgattacacatatgtatttttgtcatttagtaacctgttataagagccttagggtatataataatcattagattgtgtccttaagatatttaaaatctagaagaactttgcatattaaaattttttaaccatacatatttttaatgctcaactgtttttaccctgtcatcttatattaaagaggatttttggactgtttattataaaaaatttcaaacaaaaaaggagacattggacccctacatagcacatacatctagatttaacacttgttaacattttgccacttttgcttcattttaatttttttctgcagtattctaaaataaattacatatatcatgacatttcatttctaaatacctcaggattcatcttaagaattaaggacttttaaaatcaaactgataattcctaatattacctaattttcatttcagattcaaatttctccccttgtcccaaaaatgtcttttatagctggtttgtataaaccaattaaggtttatacattgttcttggtcattttcccttttctactttacattacattgacttgttaaaaacattaagctagttgtcctacagaatgtcctaccctatgaatgttttcagttgctttctctgtgtatactttaacttgttcccctatcctctgtatttcttatagactgcaagttactggactaaagttttgattaattcatattaaagtatttaggttagaatactttataggtgatggtgtgaacttcacactgcatcacaacagaaggcaaagaatatttggtgatcccactattagtgatgataagtgatagcatcgatcactgggttaaagtgatgacagcttgatccttccattataaagttatgctttgctcccgtgaccagcatataatctgagatactttgattccatggaaatacccagttccctatcatcctttttacccaatgagtttaacatctactgaggatccttgcctgcataaatttcgttatgaggattgcaaaaagatgatttttctgaatttatacatttattagcaggcattcttctctacataagagctttttgagaggtattgttttaattaaaaacacaaccaccagcatattccttggattgtctttctttgctgaggtcagaacacctgaactcactgtggcagctacagtaaaaacatgtactacatcttctttattccaacttgtgaagtgtgttgacattaggctgcctttttttattattattattccaagggaaaaaagaaatctttattgctgtaagaataaaaattgaactatgtgggtatattgagataattgtgtaaagaagaagactgaatgagtttcaaaaaatggattatttcttcattaccgagcactttataattaactgttcttttttttttttatttcaggaagctgccacttttgctagagagcaaggctttgaggtgagttaacccacaattgcacactaaacagatcctaaaggttttttctagctgataatgaagttcttttggacagtgattgatgtgctattatactctcagagcctcgcagcagttgccatggaaacttggcagtcgtcatggtttctttgttctgccagcacagtgttatgacgcactctgctaggtctgcacccaacatcgcctacagatgttatttattgaattttgaaaagcctcttgggaagccaagaggttgggcacggtttcaagctgcctctgcagatatggggcctgtcagtttgttcagttaaaaagctacctcattagctgcattacatttcataaggattcactgctaaagcagtggtggaacaagactaaataatgaaatataatgtcgtttaaataatttcagccctatcacatgtagattatcattatgcaaattaatttctaaaaggttgtacttaacagttgttaggaactgattaatttaaatcctgcttttataaacttactctttgaacctatcttttcttctctctccctctttttttctggggagacggaggtagcataaaatatacatacattttctgaaataaaatatcaataattggatttaatttctaggtcctaattctgtttttctgatataagtgttatcctgtcaagattcaaaactccatgtggttgttgttggcaaaactgagataaccgtgttttttatctgtataatacccctcttccaactgattgttagaaaacactgactaatatgaacccaggttaactgacagagaattaactaagttggagttgtttatgactatgatatttattgagtgaactatgtagaatgctgtgttcttacagcaacttaaagtgttacagggtagtaatttttaaaaatttaatctaaccacagccgaaatgtaggaactttctttttatttgcatattcagtattgtctatcaaacagggaagaggtgagtggtgattgaatagtatcagtaaggactagtaagctcactttgaactctagagaaagatattatatgagtttgtgaaactctttttaaatgtagtaaaggcagattatcaagcagcaaagtaatacatgttcatgttattcatgtcatcagacttgacaaacgagacatagagcttcctcttcatagaggaaagacaaggaacatgtgatacagatattctgttctgaagatcctataaaagaactactccagagtagggaaacttgcttctttgtactcaattattaggagctgtgatagtttcttacaagtttgcttttttatgctttaccatattatagtaaatctaggtttaagtcacatttagaaaaaggatttccaagtggtgggtttttttctaatttaagtttcacattttaatttcccaaactggcaattatatgtaggacaaaatgtaatcatgggaatattcaattaaaaagtcaaatgttttgatcatgagaatataaataaaaattttcaggaattttttaaagttttactgattttaagttttaatattacaaaaattatattatctgttgatacatcagaattctccatagaagaaaactttcagaacatacatttgtatcctgtcagtttactgtgttaccataaaaaatgtatttttggttctataaaataaccaattttgcagatacttagaaatataatttgttatataacatgatcatgatcctgtagtatctacatagcagtttttaaaaaatagtttattaagcctgattaatacttttatttcccccttgagctacttgcttttcatgtgcctggtttacattcagtcatagcaacaaactactttttctattttccattaactagcactatattcacctttccattagttcttacttactgattcttgaattgtttttgccataaatctgccataattgattacagcatataagcaaaatgataatgattataatcacataccttattacctcctgacatagcaaaactgctctgtcagtgatattgacagtgatatgttagactaaataaagcacatagtgtcttgatgtgtctcttcgtagattcccaaaaccatcacaagcattgcagaatatatttgaaccatgagtagggtaccctcaaatagatatttttaatcaaatgtaatccatgtatggaacactatctagagaaattcaatgattttataatgtcactaaagtttcctaggtcattagacagaaatggcagagcataggtttgaaacttggtattcttaaggaataaaacaaaaataaatcactttatcttaatagttttctgtgtgaaaatgcattaatactcttggctagtgtgacaaactagacaaaaatctgcattttatcccttctaactttaattttgactctaaatttggagcatgaatgagaagaaagaagtgaaaagattaaaagaaaggaaaggtgagtattttttccttccatcagtgccgctgtcctaccctcattttctcctataaatcccaatcagttccaaaagccactgagtattgccactagtgatctggctgctgacagaccaatccaagcgcctctaaaaataaccagtgtttattcgtcaggaaatattctcagtggcattttttttttaattgattattattctggttagcttctctgcaaattttacttttgtaaaaaaaaaaatctttaaactgaattcggcagttttcagtgagaagcagcagcttaggagagcactggagaatgagataaaaactggagctgggcagaacacaaagcataagagaggatttttttatatatataggtgatggaaaattgcatagtgcctgatttaaatgacagacctgctaagaatttaaaatgacaattcttggggtaaaaagttttataaggccttttattattctagaaaatcagttcagactggagtgtgtttttaaatctagcttttcttgagccgaactgattaaatgttcgtatttttagaacataaataaaaataaggtgctcaaaagcatgtttcattataaagccttttttaaactattgaaaattgatttaaataaagtgaagaaaatacctcaaaacctaaatatatatattctctatcttttcattgtctctgcaactgagtaaatgacaaatgatgaagagaattcataccttctctattggatcatttatttccttttactccaagtaataaattttagattttttttaaattttagatctctaagaataatacttctgctcataggggaaacaaagcaatccttttcgcctttttcacttcctccatagcccctgactacccagaagatcctagacttgtagtctttctctgaccaatgaggattctttcatcttacaccactgaaagagaaaagtatggaattgtgctatccaatacagcatctactagccacatgtggctatttaaattaggattaattaaaattaaataaaatttaaaattcatcacttcttggccttttggctaagatcaaatgtaaaattttaaattcagtccttcagtcatactaggcacatattgagtactctatagactatgtagctaatgactactttattggataatgcaggatagaacatatgcatcatcacagaaagtttcattgatcagcatggatagaaagtctacagagaatgtattcaggcagtgttgattaccaaagaattaccttaggtgacttttaggttcctgtgttcttcacaaatataaatagtgcaatgaatgatcactcagagtttcagagtttctgaaaataagaccctaaatcaggccctgctggctaagagagtgcagtgttgtttttgtaggtgcctgaaccccaaaagaggacaattttagaacagttcagttaagggaaagcaataagctagtcttctaattctcttcatttaatcatttatttattcaacaaatatttactgagttcttactatgtacataccactttgatagaccccaagacaaggtggaagtgaccagagagtgtaccatgaaagagcatgtgggaagggttcccattttagctatgatggctatggaatgaccctaaaaatatgaatatctagcaatgacaaaaaaaaagcgacacaaacagcaaaacaaatttcaaacagagagaacaggactataaaagtctctgaacgagagagaacttaatgtactatgtactccaggaactgacagaaggccagtgtgactggaatggagttagtggggacagcatatgagatcaatctggcactgacacatcatataaacagcataactattaaaggagtttctatttggaaaacaaaacaaaatggtatggctagatgactcaatgtgtggaaacactacagttggttttctacagaactaggtagactgtgacaggattgcttaacctttgtataaccagctggttaaaaatagaataaagattttctttatccagtctatcattgatgggcatttgggttggttccaagcctttgctattgtgaatagtgctgcagcaaacatatatgggcatgtgtctttatatcagaatgatttataatcctatgggtatatatccagtaatggtattgctgggtcaaatggtatttcttgttctagatcctttaggaatccagttcatgttctttgcatggacatggatgaagctagaaactatcattctcagcaaactaacacaggaacagaaagccaaacactgcatgttctcactcgtaagtgggaattgaacaatgagaacacatggacacagggagggcaacatcatacaccggggcctgttgtggggtggggggttggggagggatatcatcaggagaaataactaatgtagatgacaggttgatggctgcagcaaaccaccatggcacgcgtatacctctgtaacaaagctgcatgttctgcacaggtatcccagaaattaaagtatgattaaaaaaaatttctagtaatagtaacactactagtaattcaaatgaagtgtgtgtaacagaagaaataaaaaaaaaattaaaatgctacatctgaaaatacctatttcatacaaagcaaggaggtaaagaagggatagaacatatttttttaaaatatgacatatggaaaacaaatagcaaatggcagatattaattcaactgcattaataataatgttaatctggagtaaataatatgataaaaaggcagaaattctcagactagataaaaaaactgaggtctaactatatgctgtctgaaagagatgtatcttcaattcaaagatacaaataggtaaaaaaaaaaaaaaagaatgaagagagtatgttctttgatttggaagacaatgtgatcaccaatgacaataaaaccatatttctacatttataaaatgctcacagtttataaaacctttcccaacatatcagtaatacattcatacttgcacaaaccttgagagataggtagggcatgtattgccatatcagttcaacagattaaaaaaataggctatatggccgggtgtggtggctcccacgcctgtaatcccagcactttgggaggccaaggtgggtggatcacctgacatcaggagttcgagaccagcctggccaacatggtgaaaccccatctccccttaaaatacaaaaaaatagccaggtatggtggcagatgcctataatcccagctacttgggaggctgaggcaggagaattgcttgaaccaggatgtggaggttgcagtgagctgaaattgcaccattgcacaccagcctgggcaacaagagccaaactccatctcaaaaaaaaaaaaaaaaaaaaaggctctatgactttttcaaagtcatatagctaatacattatgtagccagaaccagagctcagctctctatgtctggtgctctttactataaagcacacagctttctctcacacattctaacatgttggaagaggagattagatttcaaaatgactttgagaaatgaaaaatacctttttttttttttttttttttggggagggggtttggctttgtcacgccaggctggagtgcagtggcgtgatctttgctcactgcaagctccgcctcccgggttcactccattctcctgcctcagcctcccgagtagctgggactacaggcccccgccaccacatccggctaattttttgtatttttagtagagacggggtttcactgtgttaaccaggatggtctcgatttcctgacctcatgatccgcccgcctccgtctcccaaagtggtgggattacaagcgtgagctaccgcgcccatcgccatatcagttcaacagattaaaaaaataggctatatggccgggtgtggtggctcccacgcctgtaatcccagcactttgggaggccaaggtgggtggatcacctgaggtcaggagttcgagaccagcctggccaacatggtgaaaccccgtctctactaaaaatacaaaaattagttgggtgtggtggcgggcacctgtaatcccagctactcagaagcctgaggcaggagaatcacttgaacccaggaggcagaggttgcagtgagccaagatcgcaccattgcactccagcctgggcaacaagagcgaaattccatctcaaaaaaaaaaaaaaaaaaaccactgaaattcgctggagtaaaaatatgagccaaattaattaagaaaaaatagcaaacttaaacacaagatcaggaatgacttgtgaatgtggtaggaaaatggtttaggatgaacatgctatagttttgtgataaaaaaaaacaacaaaaagcacattgctagcatttatagaagcactataataatggttaagtgtattatccttggagtcagactgtgggtgctagtctgttctccactacttgtatttatgaccttaggcacattacttaacgtctctgactcagtttcttcatctataaaatggcatattgtattagtacctactgcctagagtagttcagatttaatgagtactttattttattgattggttgattgattgttttgagacagcctcactctgttgccctgactgaaatgcaatgatacggtctcagctcactgcaacctctgcctgctgggctcaagcaatctgtagattcaatgcaatccctatcaaaattccaatgtcattctctctctctctctcttttttttttttgagacagggtctggctctgttgcccacgctggagtgcagtggcgtgatctcagctccctgaaacctctgtctcccaggctcaagccatcctcccacctcagcctcctaagtagctgggactataggcgcatgccaccacacctagcaaatttttgtatttttttgtagagatgaagttttactacgttgcccaggctagtctcaaactcctaggctcaagcgattcacccgcctccgcctcccagtgtgctgggattacaggcatgagccaccacgccttaccttaatgaatactttagagctttatacatggcttttagtttcttcatctataaaatagggataataatagtacctactgactagagaagttaagatttaatgagcactttagagctatgtacatggctcacagctcaattttatgagctttcaactcatacttcttactcctccctgtcttcatcttcttcgttatagatactataattgaatgttccatattcaaaactcttgaagccctttctagcgattttggggcaacctaagtatgtaaccattttagagagtattaaaatgagagtaattagaggaaataaattaatatttaagttcttagcatgtgctaaaattgcattaagctatttcacttacctcatcttctttcatcctcacaatttttaactttttattttaaaataactttagtcttagaaaaattacaaaaatagtacagaattcccacatacccttcacccagtttaccctaatattaacatcttacataaccaaagtataatgaataacagaaaattaacattaaactacaataactgaactatatacaggctttattctggtttcaaccgttttttctctagtttcctttttctgttccagaatcgaatcccacattgcatatttgtcatgtctccttagtctcttctaatctgtgacagttcctcactcttgttgttcatgaactttatacttttgaaaattattggtcagtcattttgtagaatgtccttccatttgagtttgtctgatgttttctcatgtacattgagattaggcatttttggcaggaaaaccacagaagtgatgttcctttcttggtgcatcatatcagggaggtacacagtgtcacagattcttattgctggtgatgctaaacctttatcactaggtttaggtggtgtttgctagtttatcctctgtaattcccattgtatttaataaatatcttggaggagatactactttggggctatggaaacattctattttatccactaattttagcatcactaaactaatctatctggcttaaggtgatgtctgtcaattttctctactataacattatgatttttccttttgtaatgaatatcttagggggacatactttgagactgtaaatatcctgttttctttaatttttgcccactaatcttagcatacttatccctcaaaatcttttaatgtgaacattttcttagttttgtagatgaggaaatggatcttagagaggtttattaacttgccccaaatcatacaaatagtaaatccaagcctgtcatattctaaaagtccttgtaatttcattgtttgttaagatgtgtgagcttaagtgtaagggagaagaacctattggggacagaggagaggaattactgtagaaggagaaataaagttttacatacatctgggaagaattatgttttgtacttggaaagtttattttgtcctttaattgccattttatgaggtttaatttgagacataagaaacatttctttgattaaattaccaaagctctcaacaaaatatgtcttctcacagggttggtagaaagcaaccatggaatcttattcctttttttttttttttttttttttttttgagatggcgtcttgctctgtcaccaggctgcagtgcagtggcatgatctctgcacactgcaacctctgcctcctgggttcaagcgattctcctgcctcagccctcccaagtagctaggactacagacacgtgccaccatgcccaactaatttttgtatttttagtaaagacgggatttcaccatgttagccaggatggtcttcatctctcgacctcgtgatctgccctcctcggcctcccaaagtgctgggattacaggcgtgagccactataaccagccagaatcttattcttaatttattccttatatcaccttgaagaaagactttcttttaaagaacatctagtacattcataagattctgctttcaagatgatgaagtgaatgtgtttttctcttatctttattaaatatgagctgtacttaatcacaagcaaaaatcctatagtagtaaaatatatttgtgctaaggaaattgccaaaatatacatgagtcattttaattatatgtgtacacttatttaggtgagtgaagacattgcatggcattttttggtcctttcagctgttactagtcatttctaaaagtctgtctcctgaaactgagggaatttcttctcatcttatcagagttcagacttagttctgttctaaaataagcaaccgaaagcgaaatagtcagcatgtttgaagtcagcagcactgtcctactacaaatggctattcttttcagaaacaactgtcctctagaagtcatcctgttaggtatattagaagcttagcttcatatattatctggaatttattaaatattgagtgaacaaacaatataaaaatatttcaccactaattgtcatccctttaaaaatgccagtttctggtgacgtttgtaacgattgcaaaccattgtgacttgtctgctttgcttgcctaaatgttctctctcatatattctatttgttctcttatatatactttatttatgccactcagctatatttccgctctgataggtgtttctttctctataactatttgaaactttgcatagtgatagaataaactagttttgttagcaaagcccaaaactatggacagttttaaaagcccactgaatacagacatggattttcaaattatccaaaatggttgaaaagatgattctaaaacctctgcctttagctcaaggttaggtttcaagatttcagaaaacttcaataaagatttcagtaaaactttatggcctatgtggtgtgaaaaacagcatcagagtttgacaattagtttgtcattttttaaactttatcttttttaaagaaaattaagtctttgtaggaaaggattagcatttctttctctcaaatcagtcctttgaaaaattgacattataagaactgtattttttccaaagtcagcataattatgttctgtaaacctctaaaataattaaattttcctctttataaaaacctctctttaattgggaatttgaaaactgcctggatatttgctgatacttagtcattgttaataatttttgaagtatgataatagttttgtggttatgtttatcattacctttcaaagatatatactaaaacatttatagatgaaattatgtatagttcttggagtttactttagaataatttgaaaagcaagtggatgaggatataggtgaaataagattcatcatacattttaaatttgtgtagatcattgatgggttccttggaagtcactgtgctattctatttacttttgtatatggttaaagaaatttttaatgtctcttaatagatatgcaggtctcttattttgatcaatagaagctaaattgttaatctactaataaagttttgttttattttattggtcatgagaattttttccttccttctattaatagactaaagacattaaagagatagccaaaaagacacaagccctgccaaagatgaactcaaagaggcagcgaatcgtgatcttcacccaagggagagatgacactataatggctacaggtacatgtgggaaatgtgtgatgaatctagtattatggagattaatcaattacaaaaaaaaattctgtattctttctattataatatatacaatatacatatacaatatatataaaatgaaatattttattttaataaatatttctaccctgtatctcagtagaaaagatttcatgttcaagaagatagtttattaacatttagttaaataaaccactttgatataatttatttacttagttatcttggggattttgtcaatcaagaaatatctttcctgaaaaaaagaatacatttcatttataaaatacctgcactagagtaaaataaatttactcaattatgaacaaataaaatccagaactaagttacattttccatttttccttcaagaagaaaatctcattttttgttttatttcaccatctattttatagcactcataaaacaggaatttcatctagtaagcaaacatgttattgattaaaatgattaatagtgttaatatggagctacccactattaaaaatataaatgttttaattctgtctgtaccattcagattaaaaccaatcagttgattagttattgtaaactggagcaatttagtattacctatgtgtttgttcagtactctgctgaacactgaaatataaaataggaaccttaaagatctaactgggaattaatattcataaaatataagtacaaagtaaaatataattatagttcttatctattggtgctaactatatggattgtattgactcaggagatcagtaaatcttgaaaaaagatgttatagtgaatatgaagtacatttgtgttgaattaaatataaagcctgaaataggccaaagatgaaattactgtcaagatattttctttcttttttaaaataaattttattctttatatttgaggtttataacatgatgttataggatacatagatatatatagatcaactttcttatttcagaatggtcaaaagcaagattcagagatttgtttcaaaaaatatttgcttcaaagtagttcagtgagtggtagataaagtgagggtataaatgaaatgagactggtaatgaattaattgttgaagctagacagtggatatatgggggcatcattatgctattatctccacttgtggatatgttttaaattatccataattaaaactttaaaaaaagaaagaaaagtttttttttttaaatttcaaacaagattcagagatgttgagtggctttcccaagatacattgatatccttgctaatccttaaattctaggaaggattaaaagaaaggaggacaagtgggcacagtggctcacacctgtaaccctagcaccttgggaagtcaaggtgggaggattgcttgatcccaggagttggagaccagccttggtaacagcaagacttcatctctacaaaaaaaaatggaaaaaaaaaaaaaattagctgagagagtagtggcacatgcccatagtcctggctacttgggaggctgatgcaagaagatcacttgagcccagaagttcgaggctgtgttgagctatgatctctccactgcaccccagcatggatgacagaccaagaccctgtctccaaaaaaaaaaaaaaaaaaaaaaaagaacggagggcaatggagtcaaagaggatcaagtaagcaaaggcacaagtactagcaatcttttattgtgatggcaagaagaaccaccttgttaatttgtacaagagagaaaagaaaccatgaaaagatatccctgcactgatacaaactatctgaattgctttcttcctatagtataaggattattcctgtcttagcagtggacagtttagaaaagtgaaaaacatacaggcttcttataggaattgtagtactaccttcagatttacaaaatattctttggttgctctttgtggagacattcattttaagtctttgtatattctagatatacatactgtacaagtgtcttccttattgtgaatttgcagttttcccaaaattgaaaattaacctccccattctgtgactgtatttccttgtgaactcattttattctttattaaatctattaagccattcttaggaatgcttacaagctggaatttatttgaggaaagacactggctaatctttgctgttcctaccatatgaaaatgaacttaaatcaaaggatgcactatatctgcaatgcatgataaatacaagatggatagagaatctgttcagtggtgtcagctacaaaagcaaacatgataaatgttaatgcagttttgagccctgggataagctattcagtgcacaagtgtagctgaatctctttgctatgttgttattcattgcagccaaataaatgtcaataataaaagagaattaaagattttcatttcccagaggcagtcctctaatacggcttgatctttcatttcatttgtaattcgttctcatgtcaggatgcaatcattcgccaggctctgggtgtcatgttaagccatttaataatgattaagaacataaaaatgcttggcctgtggggcaattcacaaaagagatgccaatttgttattgttttccctcctttcctcttgaatatggatcagctttttcccacctcctagcattaaaatactaatggaagatagggagggaaagtgtcccttaatttaccataagtgacattccagaatggcacaaggcagtgctaacacacatattaaaagactaattaggaatcattgtgccttaaacctatttttttttaatgatactttaagttctgggatacatgtccagaatgtgcatgtttgttacatagttatacacatgccatggtggtttcctgcacctatcaacccatcatctacattaggcatttctcctaatgctatccctccctgagctcccccaccccccgacaggccctggtgtgtgatgttgccctccttgtgtccgtgtgttctcattgttcaattcccacttatgagtgagaacatgcagtgtttggttttctgttcctgtgttagtttgctgagaatgatggtttccagcttcatccatgtccctgcaaaggacgtgaattcatccttgttatggctgcatagtattccatggtgtatatgtgccacattttctttagccagtctatcattgatgggcatttgggttgactttgctattgtgaatagtgctgcaataaacatatgtgtgtatgtgtctttatagtagaatgatttataatcctttgggtatatacccagtaatgagattgctggatcaaatggtatttcctgttctagatccttgaggaatcgccacactgttttccacaatggttgaactaatttacacttccaccaacagtgtaaaagcattcctgttcctccacatcctcaccagcatttgttgttttatgactttttaatgatcaccattctaactgacatgagatggtatctcattgtggttttgatttgcatttctctaatgaccagggatgatgagctttttttcatgtgtttgttggccgcataaatatctccttttgagaagtgtctgttcatatcctttgcccactttttgatgtggttgtttgttcgttttttgtaaatttgtttaagttctttgtagattctggatattagccctttgtcagatggacagattgcaaaaattttctcccattctgtaggttgcccgttcactctgatgatagtttcatttgctgtgcagaagctctttagtttaattggatcccatttgtcagttttgacttttgttcccattacttttggtgttttagtcatgaagtctttgcccatgcctatgtcctgaatggtattacctaggttttcttctagggtttttatggttttatgttttatgttttaagtctttaatccatcttgagttaatttttgtataaggtgtaaggaaggggtccagtttcagttttctctatatggctagtcagttttcccagcaccatttattaaatagggattcttttcccccattgcttgttttttgtcagatttgtcaaagatcagatcgttgtagatgtgtggcattatttctgaggcctctgttctgttccattgatctatatatctgttttcataccagtaccatgctgttttggttactgtaggcttatagtatagtttgaagtcaggttagcatgatgcctccagctttgttctttttgcttaggattgtcttggctatacgggctcttttttggttccatatgaaatttaattttctctaattctgtgaagaaagtcaatggtagcttgatggggaaagcattgaatctgtaaattactttgggtagtatgaccattttcacgatattcttcctatccgtgagcatggaatggttttccatttgtttgtgtcctctcttatttccttgagcaatggtttgtagttcttgaagaggtccttcacatcccttgtaagttgtattcctaggtattttattctctttgtagcaattgtgaatgagagttcactcatgatttggctctctgtttgtctattattggtgtataggaatgcttgtgatttttgcacattgattttgtatcctgagactttgctgaagttgcttatcagcttaaggagattttgggctgagatgctggggttttctaaatatacagtcatgtcatctgcagacagagacaatttgacttcctctcttcctatttgaataccctttatttctttctcttgcctgattgccctggtcagaacttccaataccatgttgaataggagtggcgagagagtgcatccttgtcttgtgccggttttcaaaggcaatccttccagcttttgcccattcagcgtgatattggctgtgggtttgtcataaatagttcgtattattttaagatatgttccatcaatacctagttttttgagagtttttagcatgacggagtgttgaattttatcgaaggccttttctgcatctattgaggtaatcatgtggcttttgttattggttctgtttatgtgatggattacgtttcttaatttgcgtatgttgaaccagccttgcatcccagggatgaagccgacttgatcatgatagataagctttttgatgtgcttctggattcagtttgccagaattttattgaggacttttgcatcaatgttcatcagggatattggcctgaaattttctttttttgttgtctctgccaggttttgctgtcaggatgatgctggcctcataaaataaattagagaggagtccctctttttctattgtttggaatagtttcagaaggaatagtaccagctcctctttgtacctctgatagaattcagttgtgaatccgtctgctcctgggctttttttggttgataggctattaattactgcctcaatttcagaacttgttattggtctatttagggattcaacttcttcctggtttagtcttgggagggtgtatgtgtccagtaatgtatccatttcttctagattttctagtttatttgtgtagagatgtttataatatccactgatggtagtttatatttctgtgggatcagtggtgatctcccctttatcattttttattgtgtctatttgattcttctctcttttcttctttattagtctagctagcagtctatctattttgttaatctttgcaaaaaaccagctcctggattcattgatttttggaagggttttttgtgtctaactccttcacctctgctctgatcttagttatttcttgccttctgctagcttttgaatgtgtttgctcttgcttctctagttcttttaattgtgatgttaggatgtcgattttagatctttcccgctttctcctgtgggcatttagtgctataaatgtccttcttaacactgctttagctgtgtcccagagattcgttgggtctctgttctcattggttttaaagaacttatttatttctgccttaatttcattatttacccagtagtcattcaggagcagattgttcagtttccatgcagttgtgtggttctgagtgagtttcttagtcctgagttctaatgtgattgcactgtggtctgagagactgtttgttatgatttccattattttgcatgtgctgaggagtgttttacttccaattatgtggtcaattttagaataagcgtgatgtggtgctgagaagaatgtatattctgttgatttggggtggagagttctgtagatgtctattaggtctgcttggccagagctgagttcaagtcctgaatatcgttgttaatttttggtctcgttgatctaatattgacagtggggtgttaaaatctcccactattattgtgtgggagtctaggtctctttgtaggtctctaagaacttgctttatgaatctgggtgctcctgtattgggtgcatatatatttaggatagttagctcttcttgttgaattgatccctttaccattatgtaatgcccttgtttgtcttttttgatctttgttggtttaaagtctgttttatcggagactaggattacaacccctgctttttttttgctttccacttgctttgtaaatattcctccatccctttattttgaacctacgtgtgtctttgcacatgagatgagtctcctgaatatagcacaccaatgggccttgactctttatccaattccccagtctgtgtttttcaattggggcatttagcccatttacatttaaggttaatatattatgcatgaatttgatcctgtcattatgatgctagctggttattttgcccgttagttgatgtggtttcttcatagtcttgatggtctttacaatttggtatgtttttgcagtggctggtaccagtttttcctttccatatttagtgcttccttcaggagctcttgtaaggcaggcctggtggtgacaaaatctctcagcatttgcttgtctttaaaggattttatttctcctttgcttatgaagcttagtgtggctggatatgaaattctgggttcaaaattcttttctttaagaatgttgaatgttggtcctcactctcttctggcttatagggtttctgcagagagatcagctgttagtctgatgggcttccctttgtgggtaacccaacctttctctctggctgcccttaatactttttccttcatttcaaccttggtgaatctgacaattatgtgttttggggttgctcttctcaaggagtatctttgtggtgttctctgtatttcctgaatttgaatgttggcctgtcttgctagattggggaagctttcttggataatattctgaagagtgttttccaacttggttccattctccccatcactttcaggtacaccaatcaaatgtaggtttggtcttttcatatagtcccatatttcttggaggtttgttagttcctttccattcttttttctctaatcttgtcatgatgctttatttcattaagttgatcttcaatctctgatatcctttcttctgcttgatcaatttggttattatatttgtgtatgcttcacgaagtgttcgttctgtgtttttcagctctatcaggtcatttatgttcttctctaaactggttattctagttagcaattcctctaaccttttttcaaggttcttagcttccttgcattgggttagaacatggtcctttagctcggcggaatttgttattacccaccttctgaagcctacttctgtcaatttgtcaaactagttctctgtgcagttttgttcccttgctggtgaggagttgtgatcctttggaggagaagaggcattctggtttctggaattttcagcctttttgcactggtttttccttatcttcgtggatttatctacctttggtctttgatgctggtgaccttcggatggggtttttgtgtggacatcctttttgttgatgttggtgctattcctttctgtttgttagttttccttctaacagatgcctctgctgcaggtctgctggagttttctggaggtccactccagaccctgtttgcctgggtatcaccagcagaggctgcagaacagcaaagattactgcctgttccttcctctggaagctttgtcccagaggggcacccgccagatgccagctggagctctcctgtatgaggggtctgtcgacccttgctgggaggcatctcccagtcaggaggcatgggggtcagggacccagaggcaatctgtctgttaggagagctcgagcactgtgctgggagatttgctgctctcttcagagctggtaggcaggaaagtttaagtgccgaagctgtgcccacagctgttccttcccccaggtgctctgtcccagagagatgggagttttatctataagcccctgactggggctgctgcctttctttcatagatgccctgcccagagaggaggaatctagagaggcggtctggctacagtggcttttccaagctgcagtgggctccacccagttcaaactttttttgcgaactttgtttgcatctttgtttacactgttaggggaaaaccgcctactcaagcctcggtaatggcagtcgccccttcccccaccaagcttgagcatcccaggtcgacttcagactgctgtgctggcagcgagaatttcaagccagtggatcttagcttgctgggctccgtcggggcaggatccgctgagctagaccacttggctccctggctttatccccctttccaggggagtgaacagttctgtctcgctggcgttccacacgccactgtggtatgaacaaaaactcctgcagctagcttggtgtctgcccaaacagcagcccagttttgtgcttgaaacccagggccctggtggtgtaggtacccgaagaaatctcctggtctgcgagttgtgaagaccatgggaaaagtgtagttatctgggctggagtgcaccatttctcatggcacagtccctcatggcttcccttgactaggggagggagttctcgaccccttgcacttccccggtaaggtgacgccccaccctgcttccgctcgccctttgtgggctgcacccactgtctaatcagtcccaatgagatgagccaggactctcagttggaaatgtagaaattacccgccttctgcgttgatctcgctgggaggtgcagaccggagctgttcctattcagccatcttgccagccacccaaacctatttttaaatgatcacactgttaagtttgcagtacttagcaataatgtatcaaaatgtttccttggagttttattctacagacctatctccttttgagatatgatatacataaactactttgtcttattttataaatttaattctttaaattgcctgtaaatctaaagtattttccgctcaccctgttttatgggtcatacctctttcagattgagtttccatctaccctagaggttctgtcacataccaatcattgtttcagtccttgcaggttaattgagtttcaaaaaaattttcaagggagtgctgggcactgaagaatattaagagtaacaggctgggcaattccacagcagagtatatgtccaaaataattgaagcaggaacctaaacagatatatgcccacccatcttcatagcagcattattcacaataaccaaaaggtagaagcaatcaaagtgtccatcagcagatgaacagataaataaaatgtgatatatacatacaaaggaatattattcagctttaaaaaagaaggaaatcctaacatgcactacaacatggatgaaccttgaagacattatgctaagtgaaataagccagtcacaatgggataattactgtgtgattccatttatgtgacatacctagagtagttagctttatagacaaagtagaatgatgttagccaggggctgggggagggctgaatggaaagttattgtttaattggtaaaaagtttcagttttgcaggatgaaaaagttgtaaagatgggtagtgataattgcacaataatatgaatgtacaatggcactgagctgtatattcaacaatgcttaaaatgttacattttatgtatatttttattttttaagcatatttttcaatttaaaaaaaattaaacataacctaaagagtaagatgctgggggtgaaggcagaaaagatgactgtccattttgatcctctttataaatgttgaatgaatctgttgaataacatggcagtaaggtgaaggaaatcatttctgtgtttataaactggaaaaactaacagtgttctttacctgttggagagcaactactaatgagatcttcatacaataaaaccttattatattaagcatggtagtaaaaaagtaaatatatatatgtatgtaaatacatatatagtgctttatagaaagtttaaacttccccaagtttctatactaaataaatcaccaaaaattggagaaagcaatacaacttttgttctgaattggaaataatgtgtttccaattaaataggtccactgaaaaataaactgtagatttttctgtttcgtttgttttaagaccaggcctcgctctgtcacccaagctggagtacaatgacacaatcatggctcactgcaacctcaaccgggctcaagcgatcctcccttcccagcctcctaagtagccgggactacaggtgcctaccaccctgcccagctaatttttttgtattttttctttggtggagactggattttgccatattgcccatgctagtctcaaactcctgagctcaagtaatctgccttcctaggcctccctcctaaaatgctaggattacgggtgtgagccaccacacctggcctaaattgtagacttttctgaacactcagaattcttatttgaattgtaatttttcacaaagggagaaaatatattaagtcagatgttttcaactggaagactggtgctatcacatcaaaatcacctagtgagtttttggtaaatacagtcctaccttttttttttttttttaattttagaattgggggagggtgtgatactttttcagggttgttacatggatatattacataaggctggggtttgggcttctattgaacccatcacccaaacagtgaatataatacccaataggtagtttttcaactcacccccacccacttcctgcctccccctttatgtccatgtatacccattgtttacctcccacttataagtgagattgtggagcatatggttttctgtttctgggttaattcactttggataatgtcctctggctgcatctatgctgctgcaaaggacattatttccttctttgttatggctgcatagtattacatggtgtatatgtaccacactttctttatccaatccgctgttgatggacacttaggttgattccatgactttgccattatgaatagtgctgtaataaacataagaatgcaggtatctttttgatagaacaatttcttttactttgggtagatacccagtagtggggttgttggattgaatggtaatcctgtttttagttctttgagaaagttccaaactgctttccacaggggccaaactaacttacattcccaccaacagtatgtgtttccttttctctgtatcctcgccaatgtgtaatttttttactttttaataatagctgtgctaactagtattatgatatctcattgtggttttaatttgcatttctctgattattagtgatgtggaacatttttcatatgtttgttggctgcttgtatgttcccatttttaaaaattgtattgatttatttgtattttatagagaaagtgtcttgctatgttgctcaggctggtctcatacttcctgaggctcaagcagttctcctgcctcagccttccaaagtgctgagattacagacatgagtcaccatgcctagctgtatgtcttattttgagaagcatttgttcatgtcccttgcctactttttaatggagtaatttgggtttttcttgttaatttgtttaggttccttatagattctggatattagtcctttattggttgcatagttagcaaatattttctcctaatctgtaggctgtctgtttattttgttgatagttacttttgttgtgcagaaactctttagttaagttacaatggtcaatttttatttttgttgcatttgcttttgaggtcttagtcataaattctttgcctaggcctatgtgcagaatagtttctcctaggttttttctaggatttttatagtttgaggttttatgtgtaagtctttaatctatcttgagttaatttttgtatatggtgagaggtaggggtccaatttcattattctgcatatggctagccagttttcccaatatcatttattgaattgagtgtcctttcatcactatttatttttgttgactttgtttaagatcagttggttgtaggtttgtgggtttacttctgggttctctattttgttccattgatctatgtgtctatttttgtgccaataccattgctattttggttactataccctagtagtatagtttgaagtcaggtaatgtgatgcttctggcttcgttttttgcttaggattgctttggctattcagctaccctgccttcttaaaagcacctttctttcaatctgatacaaccctgtgaggagtattagaaaatacaacttcaaggagatgtttgagaatgcgggcagtacagtctggggcaaggggagtgtaggattatgtatggttgaaaatgttccctttggtgatatagcaatgctgtctatcctccacctgtcactttgagaatcactggattaggtgatttaataatgctgcaagttccgtaatctgctggaaaaacgaaaacagaactttttaacagctaagggtctagttcttcaataactcaggccttgggaaatgcttcttttttcgatccttcaaaatccatccacacttacaggcaatctacagtttactttaaatagtctcctacttttgaggtgcttataatttaacatagttacatcccaatgccctttgtcattttattttaagtaaatggggttattgacgttacttgtcttcatgttcctgagtccttaaagaaacgtgttacctcatctgctagttaagttttcatgttctatgaaaacactcaatgctgcccattactctgtaagaaaaggtcagtgtgatttgcaattctggtagacgtaaagttcagaaaatgtgcgttagaaaatgcaaactctaaaggaaaacaatctcagcattggaagaataatgtcagcacatgatcccaactcaaaatattaatataaatcattttgaaaatgtctctactacagccaaatcaattttaaatgataaccttgttggcttagattggtgatggtaaagatagaataaactaagtggcattcttttaaaatgtcttgtatggcattcatagaaaaaagttcttaccaggtaagatcttagagaaaatatatttctcacctatgaatgtaagttactaagttattagctcatggtccatttttagattattgtaatcacaaaagataaactcctttaattaattggtcaaaaataatttagaataacatgtggacctgtcacatttttgacaaagtagtatctttgggatgtggttcatttagttcagtgatctcaagcctgaagaaatgagacttctttcaactcccacctttttattgaaaaggatcctgctagaaggcaaaataagaggcaacctatcctaagcagatataagccctattatagcactgatttctggagggatgtttaagtcagatttgttgagatatagattacatatagtaaaatccacaaatatgttactaaataacatgtaacaaccaccacagactatagaccaccttgtacagtttgtattgaagtataatgtgcatacaaaattgatacaacttttcattaagtggatggacctgtgtagctataaccagatcaggaaatacaatacttatagcacttaagaagcttctccttgtgccccctcctaatctttatccccactgaaggtaaccattgtcttagcttctactactgacagttagctttgcctgtttttgaaatggaaccactcagtatgtagacttttgtctgctctatctccatccatttttgtgcactttcttactttttgacaacataagatcccccgggctcacgttgtattttctccacttcagtcctataatcaactatttctccaaggaaccctggttccctttattgaagaatggtttttagaaacctgtaactgtgctctagatatgctctttgttccttgagtgtctttgcttctaggccctcttagcaaacagaacttggcaatatatgtatgtataataacctatgtatactcactcatctatatttatttctgtatctatatgtttatatatttttaaaacatgaagtcatactgataaattttatttcagtccagcagcacaaggctcattctagccttcattcttccttttgtacaacttcttcctttgacattgaaaattctggctctcattatctaaaatgtatttacttatttgttttatcctaaagtagttttgaattgcttgcccatacccttgtatgagaaagagatttaccctttagagtataatatttgcttacagttctttttttctgtagcccaatagtgtccagtcaatatatagttatccaaagtaaattagctcttttatttcatccactcattatggttacattattcatttgtaatacaggtagggtcacttgttaagagtattccattttggtttcttttcacatcctgattggggttttattttctcaataaaattcactttttgtagtgtcaagttctgtgggttttgacaaacacataagatcatgtaaccaccaccatagttatgataccaaagagttacatttttcagctccggatttgcaaggatggtaccaatataaactcccccaattttatgagacggcactaattgttccacatctctaccaatatttgctactatccatctttttaattttagccattctggtgagtatgtaatagacctcataatgattttgattggaatttttctgatgtgtagtgagatggagctccttttcatctgcttactggtatttgtttttttgtgtgtagttttgttttgttttgtttttttgagatggagcctcactctgtcgcccaggctggagtgcagtggcgggatctcggctcactgcaatctccacctcctgggttcaagcgattcccttgcctcagcctccctagtagttgggactacaggtgcccaccatcacgcctggctcatttttttatttttagtagtgacggggtttcaccatgttggccaggctggtcttgaactcctgacctcaagtgatccacctgcctcggcctcccaaagtgctggggttacaggcgtgagccatcgtgcctggccttgcttactggcatttggatatcatctttgattgtattgttgttgggttcttttgcccatattgagttgtcttattgatttagaaatctttttacagcctgtatgccagtcttttgttagataaatgtattgtagatatctcctgctactctgtggcttgccttttcactctcttcatggtatcttttgataaacaaaagttcttgattttaatatagggcaattcataatgttttccccttatgattaatgcttcttatattccattaaagaaaatcatggcagatctcaaacttgtgaagatactcttctgttgtttttttctaaaacttctattcttttacttttttcaactagcacaattcatctaagattaatttatatatatatataaggtgtaggatagggagaatgattcatttattttgcccatatgaataaccaattgacctggcatcattcattgacaggaatatcctttccctaactgcattacattgacacctttgtcatgtttcagatgaccttatatgggtgagtctttttttaggctatttcattgtcctcattctctatcctttaccaattgcacactctcatgataacttaggtttataatcagtctttttatctggcaatgtcagtcttctgagtttgttcttcaagattatcctggcttttcttggctctttgcatttctacttaaattctagaactggcctgttaattgtcaccaaaggaattttttaaaaattccttactagagttttttcagattatattgaatctgcaagtcaatttggagaaaacttatttctttacagtattttgtcttccaatccatattttcctctatttatgcagtctttaatttttctcaggatgtttttttcttttcagtgtaaaggtcttgtatatgtatcttttgtaagattcttaggttttcgatgctatctatttttaaatggcatccttttaggtttctgtttctatttgttttttactggtatatagatttctaaataatgatctttttcacatattaactgcaataacatatcagataattattttggattttctatgcatataattataccatctgtgaataaaaataatttgcatttctgcttttccaattctcatacagtactttttttcttactacactagttagcacggtaagacatgtagaatacaagtaaattgaaatggttatagtgagcacctttgtcttattcccgatatcagttgaaaaaccatcaatattttatcaaaaaggataatgtttgctatagtctctttgtagatactctatcagataaaggaaatttctttccattaatagtttgctaagagtttttgttttgttcttaagagattttttaaaaatcatgaatagttgttgtatttcatcagataatgtttttgcatgtaaaattactatatgattttttcccttttttcttttaatgtgtgaattacagattgattatggaaagatatttcacctttgcattcttggaataatgccaacattgacatatctttttaatgtcttattggatttgatgtgatgttattttgttttctgtttgtttttttgagagagggtctcgtcttgtcacccaggctggagtgcagtggtgctctccaggctcactgcagcctccacctcctgggctcaagcagtcctcccacttcagcctcccaagtagctaggattacaggcacgtaccaccacgctaattttttaaattttttgaagagacgaggtctcactgtcttgcccagactgatcttgaactcctgggctcaagcaattcacccaccttgggctcccatagtgcggggattacaggtgtgagccaccatgccagccttgctttatgtattttaaagctatcttaactaagtgtatataaatttataattctcacgtcttcctgatgcattgaaccttttaccttatgaaatgtccttcttaatctctaatgatgcatcttgccttaatatctatgccagctttctattggttagtgtttacatgatatcttttttcattcctttattttcaacctttctgtgttcttatatgacttttgttgttttttaattaattctgacaatcttcatattttaatcagcctgtttatatttaatataagttactaatgtatttgtgttcatatcttacatcttactctttttgttctgtcttacatgtgtatcttcttttttctctcctttcctgctgtttttggattgatcaagtatttttttctttttcttctcatttagcttctcggtcttgccctgttgcccagactggagtgcagtggtgtgatctcagctcactgcagcctccaccttccagtttcaagtaattctcatgcctcagcctcctgagtagctgggattacaggcatgcgccatcatacccagctagtttttgtgtttttattagagacagttttgccatgttggccaggctggtcactaactcctgacttcaagtgatccgcccgcctcggcctcccaaagtgctgggattacaggagtgagccatcgtgcccagcctgaattctcagtttttgtttgtctgaaagtttccttttgcctttcaatgtgtatagttctctatgttgggagttatactttttgagttctttataaatggctttccattatcttttggattctcttatttttgttgagaagtcagctgttactcttattctgctcttttatatataatatttttattttctctagctgctttttagaatttgtcaaactttaactttatccttagttctggttttccttttatttatcctgctgggatttttagtgcttcttgaatctgtgattgatgactttcatcagatttggaaaattctcagccattatctctttagatactagaactgtttatacttgggaatctagttatacatatactaggtcttttcattgtatcccatatgccttttatgctctttgtgtgtgtgtgtgtgtgtgtgtgtgtgtgtgtgtgtgtgtgtgtgttttaccccttttcctccccgagcttcaggctgtatattttgcactgacctggcatttagttccctgattctctcttctgctttgtcccatctgcatttcaaaacatccagtgaggctgggtccagtggctcatgcctgtaatcccagcactttgggaggccaaggcaggcagatcacttgaggccaggagttcaagaccagcctggccaacatggtgaaaccctgactctaccaaaaatagaaaaattacctgggcatggtggcaggtgcctgtactcccagctacttgggagactgaggcaggagaattgcttgaacccaggaggcagaggttgcagtgagccaagatcgcaccactgcacacgagcctgggagacagagcaagtctctgtctcaaaaaaaaaaaaaatctagtggatgctttatttcaatagtcccttttttattttctaaagtatctgattatttcttattcatcctagttctgtagtataatcctctaccttgtcatctatttttttctaacatattaatcatagtagtaataaattctgtgtctgaaaactacaatatctcagtcatttgtaggtctggtttttaaagattttttttaatttccacataataattgcaaatatttatggggtacatagtgatgggtttggtgttttaagagagggtcttgctctgtcaccgaggccagaaggccagagtgcagtggcgtgatcacagctcactgcaacccgtatcttgcaggctcaagagattttcccaactcggcctcctgagtagctgggactacaggcacatgccaccacacctggctaattttttttatttttattagagatgaggtctcgctgtgttgcccaggctggtctcaaactcctgagcttaaacgatcctctcaccttggcctctcaaattgctgggattatgggcgtgagccacaacaccctgcccatcgtgatgttttgatacatataatgtatggtgatcagagcagagcaattagcatatccatcatctcaaacatttatcatttctttgtattgtgaacattcaatatcctccttctcactatttgaaactatgtaatatattattgttaactgtagttatcctacattgctgtagaacactagaatttattcctcctatctagctctaattttgtatacttttaaaaatctctccctattgcctcctccttcttacccttcccagcctctaatatcctctgttctactttttacttctgtgagatcaactttttttagcttccacgtacgagtgagaatacatagtgtttaactttgtgttcctggcttatttcatgtaacataatgtcttacagttccatccatgttatggtgaatgacaggatttcattcttctttatagataagtagtattcgatcatgtatatataccacactttctttatccatttatctgttgttggacatttgggttgatttcatgtcttggctatagtgaataatgctgtagtaaacatgggggtgcaaatgtctctttaacgtactaatttcctttcctttggagaaatacccaatagtgggattgctggatcatatggtagttctgtttgtttcttttctctgcatcctcaccagcatctgctttttttttctctttttaatgatagccattcttactggagtgagatgatacctcactggttttgatttgcattttcctgatgattagtgataatgagcttttttcccatttttttggccatttatatatcttcttttgagaaatgcctgttcaggtcatttgcccttttttaaaacagagtagagttttttgtttttatttgtttgtttgtttttttactgttgagatgtttaagttccttgtatattctggatattaattccctatctgattagatgagtaagttgtatgtatttttttctattccataggttatcttttcactctgttgattgtttcctttgctatacagaagcttttcagtttgacataatcccatttgtttatttttgcttttgttgcctgtgcttataaaaggttgtactcataaaacattttcccagaccaatgtcttgaagtgtttcccttatgtttccttctagtagttttattgttttgggtcttacatttaatccattttgagttgatttttacagagggtgagagctaggagtctagttccattcttatgcatatgactagatgcatatttagttttcccagcatcatttattgaagaaactgtgctttctccagtgactattcttggtgcttttgtcaaaaatcagttgactgtagatacgtggattaatttctgagttctctattctgttccattggtctttgtgtctgtttttatgccaataacatgctgttttggttactatagctttgtcatatattttgaagtctgatagtatgatacctccagctttgttcttcttgctcaggatgttttttaccatttagggtcttttctgattccacagaaattttagaatattttttctatttctgtgaagaatgtcattcgtattttgataagggttgtattgaattggcggatcactttgggtagtatataggtctgtttttttgtttttgttcggtttggtttctatttccttttggggcttgtttcttggtttgcctgataattttttatcaaatgttaaacattgtccataataaattatagagcttctgttagtgtagagtccaattagatctaggactaagccacctcaaggttgggttatagtttttgtaagacccagtctacctctcatttgcttccacttctataccatggccctcctggaatctcagctgaaatcctggtgtttttatgagatccctactcattaatgggttctgaactccaaattttatctgttttgtgtaccatacaactagcacaatcaccactctgccttatggatgccttatacttggtgtcttggcctcttgtcctgcttcctgacaagtgtggcaaataccttgagtagagtatttcctctcctgagtttcaggcctactttattgttttcccctcctcttcaggatcatgaccctcagttctgtctgtcttgacagtcccaaactcgaatttttgtcttaccacccactagagattgcaaaaagttatgttggcttctctgcctcttagtagtagtccattgcccagattctcagcctcttacccgacacaggaatttgcaaataccctagggagaaaacgactttttgaatgtcagtttagctctttaagatcctcttctctctgagaccttctcttgtcaaattttgactaccttgtcagctctctcatcccttctttatttaaaaaaaaaaattaagcttttctgcctttttatggtctgggaattggtttactacaagctatggcattagagcctaaccaataggtcccttattgaatacatttttttattattaaatagaaaaatacatagcccgagaaagttaagtgggcttatctgtgtattaaggaatactgtttttaggaatgtgacttaggaatactgttcttcataccgcactttgggaactgctggattaggtcactttcccaaggtctcagaattagaaacaaaagcagctagattagaacccagcctcggcctggtgcggtggctcatgcctgtaatcctagcactttgggaggccaaggcgggagggtcacctaaggtcgggaattcaagaccagcctgaccaacctggagaaaccctgtctctactaaaaatacaaaataagccaggtgtggtggtgcatgcctgtaatcccagctactcgggaggctgaggcaggagaatcgttagaacccgggaggcggaggttgcggtgagccgagatcacactattgcactctagcctggacaacaagagtgaaactccgtctcaaaaacaaaaaacaaaaaacaaaaaaagaacccggcttcttgaatcccagactagtccaatctgttccataccatgttaactcattggcttacatctgtggttttcaaccagaaacaactttcccccttcctttcagttatgacaactggctggtatggaagagttgggtcttccactggcattttgtgggtaaaagccagggatgctgctatatatactataatgcacaagacagccaatccacaataaagaattatctggcccaaattattaattgcctcaagattagaaaagccctgtcttacagtatccctcaaaatttatatatttaaaggatcactggctgattcctctttacacttaatcataaggtcaacaccaataggctttagtaggataaagcatctttatcctactaaactacatccagaggccctttgacccaagaaaatgtccatatatgatctagtccgtacttgcttaactgtgtttctcaaagcttttgccaaatatgctccaattctaagacttctctttagttagaatttgttagagctggaaaactttctggtgtagaattgtgcgtgcatatcttgtaaatgcattttgtatgcatgaatggatatctagatgatagtgacatttacctacacatttatagattttatttatatatatacacatatatacataatatatatgtattctaggcatatatatatatatacacacacattagtctaaatggttcttagaaaatttattcattttggtttataactctaatcaatttctataatcaaaagctcttgaaaatgtaatacaaatagatatttaattaaagaggtatattaccaaatgtttttcagaataattattgtttgtaccagtgagtatttctttcagaaattcaattagactctaaaattcatttttcagagcattacaacttggcggcaaaattttcttttggctgaaacactgcatgcaagcttttggctcagaaaaaaatctttggaagtatagctgaaaagtctgattcagataactgaatggctaaaattttccttgtttaaaaggaataaactggttacacgtgaaatattaaaaactgtatttaaatggatagttaactattgccttatttcttttaagtcttaaccaagctggcttatcctatttcaactgctctagaactcacatcatttttgattcattgattttttttttttttttagtatcccaatagaagccatcatttctaaggttccaccccaactttgctgagccttggcccagaaaatttgtttagcttttctctgctgttgttaagctattttaaattttaaatttttgtgtttttaaacctttctgtgtttttaaagcctttctggtttaataaacaattctaaaatctcaagaaaatatccaaattcttttgttaataatttggcacttagccatctattcaatttatttatcatggtaaattttgcttatacttaattatttcctctagtcctagaactccaccccttaccataataaaggggcagtttataaaacaggtgtttttgtaagtaatttacatggtttagtatgcaaaaagtacaataatagagctgtttagctgtcagtacttgtgaggaagtaagcagttttttcgttattaggatgaccatataacttattagaaaaactcagatgcttttgagagtgaaagagtggggtgctattaataatactaggacagttctgggcaaaccagcccatatggtcacactaatcattatagatatttaaacaaaaatatttggtaaaatgaatttgtgtattggttgaggtttttggctgtgtttatttctaacatttcttccagtgaaaagattcttgatcatgtgctaagtatatgccaggtaatatagaacttaaaaaaaacatgagaacctctaatctcaagcaggacaagttggagaggcaagatacttatagataatgcagtaatgtaacagcacaaataaattcaattcattatggttttattgagtgcctactgtatgtcaagaattgtggttataaagatgaacaaaacaaaaactccttttcttgaaatctagaagagacatacttaaataatatgatgtgaaaaatgatattattttcatgaactaatttttatagaacaaatggaacaagaagttggggaaagcttttcaaagcaagtgatgtatgaactaggccttgaggaatccttacaattttggcaagttgagattacaaaggtattcaaagttaatgaggtaataaaagcaaaaggcagagtccttcatatgatttgttacaagaaatggcagaagggagatatggggcaaccatctctgaaatggtaattgtgatgggatttaaatgctatgctgggcaatacattattaagtgcttaaagtatatatatatatagagaagacatcctttggactgagaaacattttgtgatcagtttaccgtaattccataaaagaaaggaatcacacttccatttgtttataaagccctgtttcagagggatcaacaaatactaaagatgaaaatcctttttttaattaaatgctaaagaataaaagctgcaataatccctctaaaaagtattagtgatgaacaatcccatggggttatagtgagacaaatgtgatagggttagaaaaattgtagagaaaaattatggtaaaagcactagggaaatgccttagaaaattaataaagattggcttggtttaaagacggtaaataaagactaatgcaaaaggctaatgaattcagtcatggagaaagtttatactatagtgtttgctaaaagaattaccactagatgggattttattaagcatttttttattcaaagaaaaagggtaactcattaataaaatgtgtagttgatactaaataaataaatcaactagtgtagttgatactaaattaggagatagtgtagttgatactaaataaataaatcaactagtgtagttgataataaattaggaagatactgtagctgatactaaattctagaaattctggtaatagactctagaaatagatgtttgaaataggtgtttaaaataatattttaaagaaaatcatattcaccccattttaaatccacatagaagcagcagttaacattaaaaacttgtgtccacttccaggagatagtcatggtttaagggtccagaaatcaatggtagaatcacctgaaatttagaacagtagaaatatgtcttcactaaagagtctaaattttttttttttttttttggaggagtcttgctctgtccccaggctggagtgcaatggcacgatctcagcccactgcaacctccacctcctgagttcaagcgattctcctgcctcagcctcttccaagtagctggaactacaggtgtgtgtcaccatgcctggctaattttttgtatttttagtagagatggggttttaccatgtttactaagctggtcttcaactcttgacctcaagtgatccacctgcctcagcctcccaaagtgctgggattacaggcatgagccactgcgcctggcccaagagtctaaatttataggatgtatatgattaaaagtgacttttgtgaacatttaaataaatatttgtgactgaattttctatggaacatttttccttcagtggcttgcattttaatgaaggaattattttaaaattaccttattccctcccaatgttgtttaaatatctagagggtatctagggcttaaggaagattggatgtggaacaatgagtggaggcctagagaacaagggtagtttcctgcaacagttatatggatccctagcaaggttcatatttctgtctatactgctggttaatctgaatattcccataaattgtggaacataatccatggccttggttttctgtttcttgtagtaagatttatcattttatttctaccataaattagagatcattacatgattactatgaaggatctacattgctatttgttatgatcaaataaacagtatttttgcagttgactattcagggatctgttaaagcatttagaccttaggccctcatagcatatatatataagctttttggagacttggctctcactactttgagaatttggcacacagggtaatcaaaaaaaaaagctttcttggctcttgcctgtaatcccagcattttgggaggctaaggcagaaggatcccttgagctcaggagttcaagaccagcctgagaaacatagcgagacctcatctctactaaaaaataaatagtaaaaaattatcccagcacagtgatgcgcacctgtagtcccagctaatcaggaggctgaggtgggaggatcacttgatccagggagtttgaggctgcagtgagctatgattgtgcacactccagcctgggtgacagagtgagaccctgtctaaagaaaaaaagctttctttcgaaatggcctcaggtttatcgatttttaatttaacattgctctacagatttattttgttgagtttttttttttttaagtactaagagtgttttgggcaggggaaagaaattcacagtgtttttttgttgttgtattttgttttgttttctgagacggagtctcgctctgtcacccaggctggagtgtgcagtggcacgatctcggctcactgcaacctccgccccctgggttaaagcaatcctcccacctcaacctccccagaagctaggattacaggtatacatcacctcacctggctaattttttttggtattgttagcagagatggggtttcaccgtgttggccaggctgatcccaaactcctgacctcaagtgatccacctgccttggcctaccaaagtgctcggattataggtgtgagccaccacacctggcctaccacaatgttttttaactgaacagttggctgcagtaagcttttagaagcctacacgttggtatttgagcatacgaggtggatcataatggggatcattaggtttctttgacaggtgatattaagaacccaacccagcatgccacttgtaaaccatctatacatagagacatttgtcaccattgacagttgtgacatttaatctgggatctatttgcaactcagcttcctatgtattactatgtatttaacagtctcaattcaggctcaaagcatcagcttttttcttctagtttttctaggttttacttaacaaaggaaaatagaaatatctgtttactattgaggtgatcatttctcctcagatgagtcatgccagtcacgattcttggatgttgacctcttgtgctgtttttgtagttcacaagccaaagctgcactaaataggattatggaaattagattaatggtccaggaatgaggcatagtgctttggttgaataggaaagtctgtaaagtggagccagtagtacctgaaaaaaacttaatccaggtgaggcagatgttctgaagaatctcactcgtctcacctggattaagtttttttcaggtcctgctggctccactttactgactgctattcaaccaaaccactatgcatcctttttggagcactaatctaactccaaaggggtacaacaacctcatcacttctaatatgaatacaaccaagatattgtgtgagctgagagtggcagaagaaaactggaaaaagctctctcttagatagccagtgtcacttggagaagtctattcttatgtaaaaggagttatattggtcttctaagaagaaaggttgtcaggaactggcaagcactaaaatgcctaaccaacaccttggagttagagcagtctagttttagaaggcagagactaggagggataatcagtcatagctaaagatagggaatctagaccaaagctcattccagttcctaggattagtgcagaatacaatttattaagctagaacagaagctttgcagtcacaattagatcatcacaacgtacatctggatgtcagaaataattctgcaccctactcttttttttttaagttaaagagactgtctcccaggctggagtagagtggagtgatcttagctcacttcatcctggaacacttgggctcaaacaatcctcctgcctcagcctcccatatagctgggactacaggcacacgccaccatgctggctaatttttttctattcttttagagacagggtcttgctgtgttgtccaggctgatttcaaattcctggcctcaagtgattctcctgctttggcctcctgagtcactgggattgcagggcaccctattcttgatttttattcttcccttgtcaggactagcttagaactgttaccccaactgtataagtaagtgcatccttaactatcaagacccaagaaagatatgagcagagcaaaatgaggagctcacgcaagcaaaattaagacttgaaatgtcagcagataaggtatctgaacatgtctatgacaggaagccagttgcaacttaactactgcagtgctaaattaaaccactgctatgtataccatatttgaagtaataattggatacaaaggtatatggcccttacttcaaagagcttatacttgtgaagtgtacactagaagacagtatgtagaaattttaccaaatttttatcaatttacagtatgaattttaccaaaaaattcactatagaaataatgcatgacttcacatcacactggtgatcagagaaacaatgtattttaaaagtgacatatgaactggtttgtgaaatacaaatgaaattttgatgcaaaatataactagaaatgaccttagatatcagctggtacatcttagaaattcgagaaaaattaagacccactactagtgggataaatgttggtgtacagtttttcttggtgacagcttgagaatacatatcaaaagccttaaaatatgcatatcctttgactcagtaactttacttacaaattaatcctatggaataatttaacatatgcacagatttacatgcaagaatgttcttcatagcattggtcttaaattttttaatttttttaacttctcattttgcagcaaaaaaaaagttgtaaaaatagtagatattttccatatatccttcatccagctttcccaaacattagcattttatataaccagagtacatatatcaaaaccaaggagttaataaataggtagaatttttgtcaaataaataaataaaattttaaaaccagcaaactactatagatgtgatactattattgaagctacagacctttttcagatgttcccaattatcccacttttttttttttttggtccaggatacaatctaggattctactctgtgcttaataggtaatcatattcttttattctgttactatctggcataattcttcagtctttttttctcctccttaacattaacacttttgaagagtactggccagttattttatagaatgtctctcaatttttgtttgactgatgtttccctgtgataaaattcagattatgcatttttggcaagaataccacagaaataatattatgctcttctcagtgaatcatattcaaagacgtgatactaattagcctcgatagtagtgatgttgactctgattcactttacttggttaaagtggtgcctgccagttctctccattgtaaagttagtattttttctttcttattgaataaatatctcatggggaggtacttcaagatacgtcttccatacatacatggattaatcttgcctgaaataattattactgtggtattagccaaagaattatattttatttttattattccttataaacttctcaattcaaaattatacacttattaatagagaagagctttcccctttttttgtttattaatttacttatgtcatatggactcatgaatattttattctattatttaaaatatattactatcactatttattgtgtttctcaaattgtcgtagatttgaccattggaagtgccctcaagttggttcttatgaacttccaatgtactacagttattttctgacttccttacattctgcgaccacaagatctccaggttcagcttgtgttttccttgccccagccatgaaataggaatttctccaagaagccctggtttcttttattgtacactaagaatttatacacacatctatatctgtgtctatatttaacctgtgtgcgtgtgtgtgtgtgtgtatgtgtgtgatatatatatgatttatttatttttttttttttgagaaggagtttcactcttgttgcccaggctggagtgcaatggcgcaacctcagctcactgcaacctctgcctgctgggtccaagcaattctcctgcctcagcctcccatgcccagctaattttttgttttgtttttttttttttagtagagatggggtttctccatgttggtcaggaatggtctcaaactcctgacctcaggtgatccacccgcctcagcctcctaaagtgctgggattacagacgtgagccactgtgcctggccctgtgtatatatttttaaaacatgagtacacagtagtatcacctattgcaatccaataccacagagttcaggactggcttagagctgttaccccagctctgtaagtgcagcctgaaccatcaagaccagggaaacatataagcagagcaaaatgaggagctcacacaaccacacatcctggttaattttaattaagttttttaaatatatagaaaattaccatggttctaaaagtcaagaactattcacaaagatagagtaaaagaagtgtcacttccctgacattactttttcgccattcttgttttagcgttcttcccaccctgttcccacctacctcttgtaggtaaccaatctcagttttttacttatcttttctgtatttcttctttttttttctaacagcttcactcagatataattcacacaccatacaatttccttatttaaagtatacaattctttttttttgtatattcataggttgtgcaaccgtgaccacgatcaattttagaacattttcatcatcccagaaactgtctctctccagcttcacccatcttctcccaaccttaagcaacgattaatctactttctgcctctatgcatttgccttttctggaaattgcatataaatggactcttacaatatgtggttttctgtgttaggcttctttcacttaacataatgttttcaaggttcatccacattatagcatgtgtcagttttttacttctttttattgccatgtaacattctattgcatggtttattcatttcctagggctgccataacaaattaccacaaagtgagtggcttaaaagaacaaaaatttattatttcacagttctgaaggctagaagtccaaaataaaaggtatcagcagggccttgtaccctctgaaaactctaggaaattgttccttgtctcttcctagctactgggctcctggaaatcaattcttggcattccttggcttgtagctatatcacttcagtatttgcctctgtcttcgcatggccttcttccctgtgtatatctttctgtgcccactccttttattttaaagacaccaataattggatataaggcctaatctaatctagtgtgacctcatcttaactaattaatctgcaaagactttatttccaaacaaggtcacattctaaggttccagatggacatgaattcaggggcaacactatttagctttctacatatagagatacaacattttatttacctattcttcagttaatggaatttcattcctgtatttatttatgcccagatgagcagatacatgagcattttcttatttctccttcctttttatttgaaaagtggcatactgttgatatgtttgttttttccttttttcagtttataatatattctggaagttttttcatatcacttcacagagctctagctcattctaatctaaatattcagccatagagaatttattaatatatacataagatggaaattgatttagtattttaatttttatgaacatggaatgatgtatacaatatattggggatgttttcttctataggttttttaatctgtgttttcaaggtattatattcacacagtatgaaattcctccttctagatgttacccatctaatcagccctttcccagagtgaaccaatgcttccactgaatgtcagctatacacattgttccacaccttgcctttttgcttaatatatcttagagattgttccatttttttatagctgtataatatttcattttcttgtcacatcatactttattttactaatcctcttttggtacacatcttggtatttctagtcttttgctacaacaaatataacagcactatttgcaatgaccaaaataattggaaacaaccccaaaggtccataaagagtaaactgaatatattatatatttatgtgatagcatacataatgaagagagaatgaatggattaccactcaactcaacaatatcaatgaatataacaaacataatgtggaacaaagtcagacccaaaagagtgtatacagaattccaaactaaatagggtaggaatagctcatgtcagaacagcccttcttcaggtagcaattataactcttaacaaaatattacaaaaccaactacctggagacactggagaagaatgaaaatcaggcagaaactgaaggagagtctatacttggaggaggagaatggccttgagtacatttcctatttttatgactctttctctagggccagcccaagttggcaccaagtagcatgcctaaaagttggtagaaaacacgcagtcttactggcttgaagatccagaggaagagtttaggtaaaaagtgagtgaggaaatttcagaaaggagaaaaaccatacagaggtagccctaaattctacatacagaccttatccaaatctctggatgacccctcaattacgcatatgcagagtggattcctagcagcccagctaaggctaaaagaacttaataaagatgtctcattgtccattgctggggtgcagagtttggaatttcattctagccaagtttacttgtctccttaaaaaaacaataataatcccctccttagaaacatttgagtagactgtacaacagaggtcagcatttttatttattttttttttttgagacgagtctcgccctgccttccaggctggagtgcagtggagtgcagtggcgcgatctcggctcactacaagctccgcctccccagttcacgccattctcccgcctcagcctcccaagtagctgggactacaggctcccgccaccatgcccagctaattttgtttttctatttttagtggagacggggtttcaccgtgttagccaggatggtctcgatctcctgacctcgggatccgcccggcctcccaaagtgctgggattacaggcgtgagccaccatgcccggctggcatttttttcttaaaggaccagagagtaaatattttaggttcacagggtactctttcagtaatttaaatatgacaaggagcaaacttgaatataggtatgtagaaattatcaagtgtggaaaatgaagagaaaaaaaacaatgaacatggccgggtgcagtggctcacacctgtaatcccagcacttttggaagccagggtgggtggatttcctgaagtcaggagttcgagaccagtctggccaacatggtgaaaccccgtctctactaaaaatacaaaaattagctgggtgcagtggcacacgcctatagtcccagctacttggtagggtgaggcaggagaatcactagaacctgggaggtagaggttgcaatgagccgagataatgccactgcactccagcccaagtggacagagcaagactccatctcagaaaaaaaacccacaaaaacagagaacagagcttccttgacctttaggacaacagcaaaaggcctaaaatgttcataattggagtctcaaaaggaaaggagctagagaatgaggcaagataaatatttgatgaataatggctgtaaggtttcccacttctggtgaaagacatgaacttacagatttgggaagccctgtgaaccacaggcagaataaatacaaagaaaaccacacctaaacatttaattagactactactgaaaccaaaagatgaagagaagatattgaagagcaaagtagcacattgcatagaatgggaaattatatgaacaactacagattccttacagtggagatcaaaagaaagtggaacatctttgaagtgctgaaacaaaactgtcaacccagaattctatctccagcaatattttccttcagtgatgaaggtgatattaaaacattgttatataaacataagagtatatactatgtgattccatttgtataaagtcaatggaaacaggcctcaagttacttttgatggggattagtaattgcaaggaggggagggaatttttcaccataatgaaccactccataaattagtaacataaaaaacagcagttttattttctcatgattctccagtcaaggctaggctcagccgagtagttctacttgtcttgacagtggtcacttgttggctacattaaggtagtacgttggctgcaggctagactcattagggatgttcagaactctctatttagtctaaaggccaacatttccagagtcagacttccaatttgtactcttctctgtatgtgtcatacctcaattaaaagcccactttcagactaggtgcagtggctcacacctgtaatcccaatactttgggtggccaaggtagaagaattgtatgaggccagggattggagaccaacctgggcaacacagcaagaccccatctctaccaaaaaaaaaaaaaaaaattagctgggcgcagtggcacatgcctgtagtcctagctactcagaaggctgaggcaaggaggttcgtggagcccaggagttcaaggcagcaacagtcagccgtgatcacaccattacactccagccttggcaacagagtgagaccctatctcaaaaaaaaaaagtctactttcaaagggcaatagataattatttttttaattacaatctaacaaaaatagaataatctaatataaatagaaactacaaaatgttccagaaaatgtaagtattcctgtgtgactagtgtagaattaatataagaaacattaataggtgataaagtaaaaaagataacttagggttagattacactgagatttgagtgcttggctacagagctgggtcttatttgaagggaagtgggaaactattgaagggttttgagcagaggaatgatatgttcaaaacagtggtttaggaatataatcccatgctagtgtacaaattagactagaggagggagagactattatcaaacggatcaatttggaaacaatttagataagcaccaataggaattgaattaaaataatagcaagctaatgaaaaaaagggaataaaatgtattaattctacatctacacagattgagagcctactatgttctatgtacttggtaaaggactgtatatatttttgtctttatagtcaaggaattcacaacatatgaaatgtagaagtatgaaaaaataacaatttgttgtaataagaactataatagatgaatatttaaggtgttaaggacacaagaagaggaagcagccaataatacagaggagtctaagacatgctttagataagatttaaccttacatgagtagttacagtttaccaaacaaagaaggcaaagaacaacattctagccagaagaaacagcacataaaaagtcacaggcaaagaagagtagagcatggtgaattgggggacatagttcactatatctacatgtgcaagctaagcataggtacagaagctagaaagataaggatcacatcactaagggcaaaagacatgaaaaatttggtgactatatgagatgaaacaagatttagtgactttataagaagacaaggatgaccttaatattttgaatttaagtgactagaaggataatgataaacccaatagtaagaattgtataacttatagacacttttcatctgagtggacattaaatacctaggagttctttttatatgtgtgtgaagaatagcactagatgtgtttcatcaatgaaattctgaatataaaataatcatcataggttcttaaagccagtcaacaaccaagaattgatactgaccactggcacagtttttttcaaaaatgacaaactttaaaagaaaaaaaaatgccttgaatgaatgtttttcttaactcagaagaaaagaaaaatctttaactacatatagcttacctgaagaaaaaacagaattgcagaattgctgtgaatgttctaaagacctggttctatataatcaagttaattcctctttcatgtgttttaaaatattgttgatccaagaaccaaccatcagctatgctggaagtctataattatgcattgatatatgagaaggctatcattctctacagacgactggtaccatccttagcagaatacttgaggctgcttttggtttagggaatctgtagctcagagattttcctagaaagtaacctctgttgttcaaattagatagccatttgtggagacaaaacccactgggtataggtagtattacctgaatcactaaaagataattgattagaaatccaaatcaaaccttgagactgctgagtctagatgagtggctgcctagggatagagggcaggaaggggtgggaccttacaaagacacatgaagaaacttttagaattgatatgtttgttgttttgattgtggtgatggcttcatgagtaatacctattcaaacttttccagttgtacacttaaatagtgcagtttattgtatgtcaatcatgcttcgataaagatgttagcaaaggaaatgactttcatcttagaatggtcagataaactgttttaagtgctacaccattatccatataaagaagagatggccatttaaaaatatttatacaagacttgaagcaatgtaggtaacctgaggtataataaattgagtgtcttgatatttagagtcctgatgtaatacactttattaagatatagatttgtaaatttatgctaattctggatgattatttttcttgagttggtttctatggactgaatgttaaagtgggttttaagcaggttttatataatatatcaataccacattagcttgattttttttattgcgagagatgcagaaagatcaatatcttacatgctctatatcaccataaatactttcaataaagcttttttggcctggtagggtgactcacacctgtaacctcaacactttgagaggctaaggctggagaatcacttgaggccaggagttcaagaccagcctgggaacatagtgagaccctgcaaaaaaaatatggaaattagccaggcatggtggcacacgcctgtagtcttggctacccaggaggctgaggcaggtgatcacatgagctgaggagctcgaggttacagtgagctatgatcataccacttgcaatgtagcctgggcaatagagtgaaaccatgtctcattcaatcaaacttatttgaaccttcgtacatttttgcttttattaatgagcttttcttttaaaatcagacttttaatggctttctggcagtgtcatcctggttgtggttgagactaatatgagctctagtttgtgttttttgttattgtttttgtttgtttttttgagacagggtctctctctgttgccaaggctggagtacagtggcacaattacagctcactgcaaccccttcttcctcccagactcaagtgatcctcccacctcagccttccgagtagctgggactataggtgcacaccaccacacctggccaatttttaaatttttttgtagagacagggtttcatcatattgcccaggctggtcttgaactactggactcaggtgatccacccacctcaacttcccaaagtgctgggattataagcatgaaccaccatgctcagctgagctctaattactgaagattaattctataggttgaacctggatatgttagaagacataggggactttcataaagaagttcaaattagaatatgtgagataggagaattttttaaaagaattgttatttgatacttagggtgtagtcatatactcttaatattgctagagtgtaaattggtaaaagttttcatatccttttatacagcaatttcagctcttggaatttaaataatcaaaagtctgggagcatctacatgtgaagacattcatgtcacttttatgtataatagtgtagcaacttgaaactatatatattatgttacatgaaaaataaactaacacagtgggttcattcactttgtgaaacttcatcacttatttgaggactttgagtataaacaaatcagaatataaaattacctgctattacgaagtagcaagagaggctgggcacagtggttcacacctgtaatcccaacactttgggaggccgaggggggcagatcacttgaggtcaggagttccagaccagcctggccaacacaataaaacccatctccactaaaattacaaaaattagccgggcgtggtggcatgtacctgtaatcccagctacatggcagactgaggcaggagaatcgcttgatcccaggaggcagaggttgcggtgagccgagatctcgctactgcactccagcctgggtgacagagcgagcaagagcaggcgagcaagcgagactccatctcaaaacaaaaaacaaaacaaaaacaaagtagcaagagtgagtatgccagtgtgctgggggtaagatgatttagatactctgtattttccatgtcttattttcatactttaaaaaacatatcagttgtttctaaaagaacatattccttttagttacaaacatatacattcagcaaccctaaagtagcatagactactactggctgaagctctggggttttattagtacagtgatgacttaattaacaaatcctctttgaacaaagcctcttcactcaagactggccttggtgcagtaggcatgagagaaggaccagttttctctgagctagatcggtagcagcagggactaatgaggcagggccttgaaagtggctctctctcagatctaactcctcagggactggctaaagctgaagctgagggtactggtgcactcctgggacctacacagcctggttacccaggtgttgaaaaaacagtttctgtgccaacaccatatgtggcttttaagagactcggcaggactcttgctttaggcagagcattccttgtgtggaatgagtaagctggaaaataacaaagagggaatcccatgtgctaggaagcttcctcttgtcttctgtgtgctccgtgtactgctttttcaattctctgggccttattttgttcaactataaagtaaaaggagtagctaaaaaatctctaatatatctttcagttctaatagactacatgtttaaatcaggaatcggcaaactttttataaagggtcaaatagtaattattttctgctttgcagggcatactacctccattgcaagtgctcaactctccctctgtagcgtgaaaacagctgtatataaacaaatgggtgtggctgtattccaataaaactctatttataaaaataggcagctagccagatttggcccacaggccatattttaacaagcccaggtctagatgttaatgtaatgggaatgtcatattaagagaattatttgatgaataggatataattcttatttcatagagaccattctctcagactttttatttttaaagcgtaggcaaatataaaatattatttcactgtcaggatgtaataccatgggaaaaagattaaaaatactctggcaccaaactgttgtagtaaattatctgaaatagagcctttgacttcccaattaaggaagaaaatggtgtctgcaacacctgtgactgggttattttaagtcttcaaaagttaggggcctagtagaagagagtctcaagggcttgttcattttctttctcatcaaatgggccaaatcatgcttttcatagtagaaggtaggctgtggaccctttactattttatttttaaatatttctcttggctaggcataatggcccatgcctaaaatcccaggctgaggcagaaggatcccttgagcccaggagtttgagaccaccctgggcaacatagcaagaccccgtctctactaaaaaaaataactttttaaaaattaaaaataaataaataattttttggtggtccagaaaggggcagctgccatgctttgcaggtttcagatccccatctatcttgggttgggtttctatcttggtcttaagttatcagtattctaatatggagataagtctgccttcactttggagacctttgttagttcttccatgtcaggcttcagctagtatagtttgtctaatgcatttatataaaacttgtttccaacaatgaaaaagcaattacaggttgggatatgtaattcaggcccattactacataaaaggatcagcacagtggtactttatctgactagggaagtctaaaatattcttgttggccagcttgctttcacataagcactgttcgggatcttttctaagttgcagaacatgaattccttattggcctatcccactagccacagctgtgagcacaacagaactgacacatacctggtaattataccttatctaaagtgaacagggccaccttcccagcatagtgacagctatagcccttaatctaatgcagtggttctcaaagtatagactcactgggggtgccctttctgaggctctttcaaggaatctcttctatgaaatcaaaactacttcacagtaattcaaatatattatttgcctttttgactctcaatgacagtagagttttccagagactacataatgtatgatatcacaacagattgaatactgaagcaaatgttaagaatccagctgacttctgttaaccagatattaaagagattagcaaaaacttaaatgtcatactctctactaatatttttgtttggaatatatagttattcttatgaaaatatgttaaaatgtaggtttattcagaaattttctgagatcattttattttctaatacagtaaatattaataaatatgactcacacaaaatctatttggagtcctcaatttttttttcttttttttcctggcttacattttttgatgcactcaatttttttttttttttttttaatttaaaaagagacagggtctcactatgttgcccaggctggtttcaaacttctgggctcaagcaatcctcctgccttggcttcccaaagtactggtattacaggtatgagccagtgcacctgacctcaataattttttaagagaaaaagtttgagaacccctcctctaatgtaatacccttagttgcaatactctgatctcatggttactgatatcatctttaccatattccctcttataaaatatttactaaaattatccccagagataacccttgttaacaatttagtgattacttctagacatctttctactgagtgcttgcattcacacataatatatatacttttacatttattggatcatactgtggtctttcaaaacttattctcctgagtttaatttttctacctgatcactctctgaattcttataaaatcttaagttcttttttttttttttttttttttttaagacagggtctcactcagtcactatcacccaggctggagtgcagtagcatgatcatagctcactgtagcctcaaactcctgggttcaaaggatcctcttacctcagcctcctaagtagctaggactacaggtgtgtgccaccatatctggctaactttttttatttttagtggagacaggcatctcactatgttgctcaggctggtctcaaattcctggcctcaagcaatccacccacctcagcctcctaaagtgctgggattacaggcatgactcaccatgcttagcctaaatcctaaggtcttaaaattgaaagggacagaggggtcatcttatctcattcccaactcaagtcagaaaccctctctaaaacattcacaacctgagaggtccatttaatttggttttataaaccctaaattgttagaaactttttccttctcttggacataaatttgccttcttgatcacttttacccataggttctagttctactttgggaaactatatagaatgcatcttatctgtcttcactgggcttcattgtgggtattttcttctgttctatcttccagttcactaattcttttttaagttgtgtctaagcttctattaaaactatccactaaatttttactttcaatttccatttaaacctgttgtattctagtcctctgttaaaattctcgattttatctttaactcttgctatttcaaagtttctgtttgttaagttcaatatctggaactgctttattaagctgtaatttctgctggttttaatttcctgcttgcctctttgtattactgtttattttttattgtgggtgatatgttgtatttgcaaaattgcttatagaaataatttgaagtataggatgattcatgtttgcttttggcaggcatggggacattggcacactatatttatcttcatctaagtttaaagatttagatgattagaggctaagctacaatcccttgtctaggtctttctactgcctgttcacacacccttaatccttttgattcccaccctgagataaggagattttaactaggcccattactcttgacagactgggttccagactttgtcctcctagcatcaaacaccagactcacttctctgggtttctatcatcctctgtattatagcctggtaattcttcattcttttgttaggacttcaatgccttcaaacagattttttaaaaatatgtccagatgttctaattcttgataagacagttggtctgaattacctaggctgccattagtacctgcaacctactttaatccgtattaatatttttctgtccttctggattgcttgggaaactgttaaagagcaggaataaccctgaccaggcatctgtaccacattcaaccagatgctctgtaagagctcctcttgaaggtttaatctgatattaatcagataggaagtacagttcttatgaacagattcagtcttcccacagggatgagttcagttaagaggggcaatggatacggtgtacagtggccccattttcctttatgtttatattctagtcttgtaataaaactaatgctcagaatgaaaggtctcaatttaggatttaaaccaagtataaacaaaaagttaaaacaagctattgttcaaactttgacttaagtgaaagaattggtttttttatttgtttgtttatttttgaggcagggtcttgctctgccacccaggctggagttcagggatgcaatcatagatcactgtaacctcgaactcctgggctggagcagtgctcccgcctcaggctcctgagtagctaggagaacaagtgacaccacacccagctaattttttaatttttttgtagagatggggctttgtatgttgcccaagctggtcttaccttctggcctcaagtgatcctcttgccttggcctcccaaaagtgctggaattgcagacatgagccaccatacccggcctggttttattttaaaaaacacttttgctgcccttctgtaaaatgttaattatatgtatgcacattttcttttatctggtgcttctctaaattcctttagcccacgtcttatccaactagtcatgtgggaatttcctctttggggaattaaatatttaatattaacttctaggtagtacagagcagcccactgtgtttcacttttgtattattcctttgttagcactaagttttctgtatcagcttgtctagaatttttgtttcaaaattgtattcttctaatttatttgcagtttttctcttctaattgtttaattgtccatcccctaccccctgccccaaggcaaatgtactgtcttttatccatatgtgcccataaattctaaactcaaagatttctggttctcccttatatttatggtatttttctacttctctgttcagtatatttttgcaagtgtttcagttttcttcagtgtttgaggttctctagtgtgtcatttcattttcatgcatcagagtaattcctaccattcttatatggagtctcttacctgatgattttttaattagtaaagtgcaatattgaacaacattgaagattttatttcttaatctaaaacataatatttatttaataatgaaatggaaatataggttttgtgaaagggagaaaggtgtttctctaaatattatacctgtgtcaaaaagctgcaagtgctactaccactgttttgtgacccctgaatgatttctgctttctttatattaatacttactctaatagtaattgaactcccaaaaagatcacaaagtccccaattgctagctttataaatacattgatgtgtaccttgtttgatgagataaaagcttcagtaagtgatatccccacctgtgtggttaatttcaaaatattgtttgtctaatacattgttgtcagtgacaactgaacaagaacttttagaagcagttggctgtccattaatggcagatttcaaggctatgcaaattgtgccagttcagccctgcattttttcgatattatcatatcaattgagtcagttcagagtagacaaagcaaggttatgggaaccacctagagcatcatgcaccatttaacatcaatgcagcatacatgaacatctgcaacttcgatcttattaacagaggatagaatggaaggcagtaaacagctttcttcatcacttaattgcaaaatagtatttcctaatgtttgcattgtttatcaacacgaacttcatcaataattgtataattatggttgcctagatcacagtgccctcatgcatcttgtcacttattatagagtggtctgagtttaatttgaatttgaacacatgatacaaggataataatacaagttccttgaaatgtgagttgcataatacaaaaattttgtgtagtaggagaatggcaagttatgattcttcagtcactttggggattaacacaaggaaaaacaggactgaaaggcagtgaaagatgaggggaagccactagttagattcaaacatagacccattggacatgagagtaggttatgttccttagaattaatcatgagtaattcgatgtttgctttaggcccaaattgagctgaattaaaacaggattattatgcttaggtcttcccttcagtctctgtagttaaagagagaaaatggcagaaaactacaaatatagtgaggaaaaagctatggtggccaaagttaaaaataccacatgctgaggaaagccttgacatagctgctcagccttcattgctgttgcttttgaagcctgataatgccacactactcctaattagcaaatgttagtattacagtaagcaatcaagtgcagtcttcaggctttgtggcagcagtttcgcagtgcaaaatattgaagaaaaaatgaaggaaaacaatataagctcagccacagttattggtgtggtcagtgggagttgtctcacaagagagcaggaaaaggaaaatgtgaaaaacagtgggtgcatttaaagcatgtaagacaagagctggctagtctgaaaagtttgtctattttaatcatgaaaatctcacatttttacttaaatccattttatatttaaggaaaaatctaaggcttgttcatgaaattacacttgaaatattttaatttgtggttagagtctcctccccatctcaaattaaaaggtattaaattgtatattgagtgagctccgtttgtactcagctcttcccaattaataaacatagtcatttccttaaaaaaaaaaaactctagagttagaatgttttctctcactaattagtctgtatttatgcctttaataattatctgttcattttctagcagcaaatgtttgttctcagattaaattggagaaggaaggaaaaaaaagatagctacccacagtatagtatccacagacgatatagagttatgtccctctttgtgtggttcttgagtataatagacataacagaagctttcttaatatgatagttaatctattattttctgtatttgggggatgctaagaactggtttactagaggtaatagtttgatctgtagttatttatgttaaaatacttttttaaaaggtaattacagcttctactataaacttgaaaaagttggtctaactctgtgccgaatgagcggggagatattactatatacatacatataagtgtatatgcctcttacctgaatacctcagggagcacacttttctgaaccagggttttgtaataaatgtgtgtactactaattctgacacatgtatagttctcctttaaataacttgtatgcaaacgttattcagaaacgtcttctaggagctatttatcaaaactgctataataataactttgtcctaatgagtttcagtctctgtttagggagtaatcgataaactacaaattaatgttccataattcacattataatgcacatataattattttgagatgaggcaaaccctatgcatttaatttacagctataattaagtaagctcatttgatactaattaagtaagtctaaaaggatcataggtttgtgtatttaattatcaaggtacaatcagcaactaattccttgaaaagctttcctatcttcagttcaacactgatctcagcccacactacaatttatcttcttgcatcttcaatagattaaaatgcattgtgaattgtggagaatctacttggtaagttagcttctttatttaaaaagtatatatatgtatatatatatacacatacataggcttaagaatacagaaattctataatctggcaaaactgtccttaagaagtgaaggagaaattaagacatttccagataaaagataaagaggtttattgccaatagacctgtcctacaagaaatgctaaaagggaatgcttcaggattaaatgaaagaatgctagacagtaactgaaagccatatgaagaaataaagaactcctgtaaaggtatctatataagtaaatataaaaaccagtattgctggtttgtaactcttctttcattcatgaaaggaaaatgcctaggccgggcgccgtggctcacacctgtaatcccagcactttgggaggccaaggcaggcagatcatgaggtcaggagatcaagaccatcctggccaaaatggtgaaaccccatctctactaaaaatacaaaaattcgctgggcgtggtggcacacgcctgtagtccctgctactcgggaggctgaggcaggagaatcgcttgaacctgggaggcggaggttgcagtgagccgagatcacaccaccgcacttcagcctggtgacaaagcgagactccatctcaaaaaaaaagaagaaaagtgcctaaaacaataattatatgttaatggaaagacatgtaaaatatgtaatttataacaacaacataaagagggaaacagagctgtataagagcaaggttttttatactgtccaggctaagttggtaacaattcaaactagattgttatgaatttaggattttaattgtaattgccatagtaaccactaagaaaataagaaataggtcagggcgcagtggctcacacctataatcccagtgctttgggaggccaaggcaggcggattacgacgtcaggagatcaagaccatcctggccaacatggtgaaaccctgtctctactaaaaatacaaaaattagctgggcgtggtggcacgcagcctgtagtcccagctacttgggaggctgaggcaggagaatcacttgaaccccggaggtaggggcaggagaatcacttgaacctgggaggcggagtttgcagtgagtcaagatcgcactactgcactccagcctggatgacagaccgagactccatctcaaaaaacaaaaaaagaaataaaataagaaataatgaagttttctctagttttgttaaagtagtatataaaaattagattattagaaaatacacttaattgctagcttagaagtcttttaaattctactgtcagccgggcacagtgtctcacccctgtatttccaacactttaggaggccaaggtgggaggatcacttgggcccaggagttcaagaccagcctctgtaacatagggagaccctgtctacaaaaaattaaaacaattagccaggtatgatggcaagcacctgtcatcctaggtactcaggaggctgaggtgggaggaccacttgagactgaaagattgaggctgcagtgagtcttgattgcaccactgtactccaacctgggcgacagagtgagactctatatcaaaaaaaaaaaaacaaattctgtcagtcaatcaactaatattcaagtatttaatatagtaggcttcctgctaagtttcaacaattgtctccatttcttcccactaaattttttaatgtatagtcaagaaggaagagctatctgatgtctagagtgacattctagtgttgggaaatgctagataagatgttcacattttcagatttcccagccacatttaagctcaaaaaatatgaatacttgtccccatgactttcctgaaggtctaaaagatatttctgtctccatcccttcaaaaccaagatacctgattgtgaggagtagaagacccctatatggtccagtgtatgttctcttcaatctcaaagcgtgtttagagtattgccattgctatcagaaatgtgaactttcccctcagatcctagattttcagattaagctaatcttagaacatgggctttcctccttccttatcagaggccactgtggtaaaatattatagaaagtaattgttggccagtcgcagtggcttatgcctgtagtcccaacactctgggaggctgaggcgggcagatcatttgaggtctggagtttgagaccaccctggccaacatggtgaaaccctgtctctactaaaaatacaaaaattagccgggtgtcatggccggcgtttgtggtcccagctactcgggaagctgaggcaggagaatcacttgaacccaggaggtggaggctgccaagatctcgccactgcactccagcttgcgtgacagagtgagactctgtctcaaaaaaagtaataataataattgctaatacctaatgttgcgctttacagctcacatagaacatttacttatattatctaaaatgaggtattaaaatagatgaacaaactgatatctgggctgggagggagttgttgcttcttttatttctttggggtactactagcacagcctgtcagtacattaaaaatagagactttttggcattactttgttttttccaagattaactagcacaacacaaatttcttgtgcctaggtgtaaccagtgttgagacttcacataccacacacaattaatgacatcaaccttgcagtactgacagcgatatcatgcccagtttgtatatggtgtctgggtcatctgaggaagttaaaatagtattgtgatctgtgaacaggccaagtctagcaggtgccatttgcatagactagaatataaatagtatcctctaaagctatatgatgtaatgtccctaaaatgaattatctcccatcttctttcattctcagaaacaaaaatactgattcttgtattgtttgatggaaaactattagttgttcaacataaccagcaaagtataaagacttgacacctaatggcttctgttttctctgagagttagaattagtatgtagcttaagaagagctgtaggcatttagaatgatatttggggtggtggtggggaaatggaggcatcagctagggatagtttagaaccagttctaaattgagtggaattgccaaaattcggtatggtattggataacaaatatggcctattttgacacagggtcttaattttttttttaataggcttgtgccattcttcttaatctaataggcattggcaatccctaattacggagaactggtttgtctagtgacatcccaaacataggaagaatgtttccttctttaaaattttttgatagacacttgagtcaaatgaagaaatcccagatgaaaaattttagaaaggacattctactctcctgtagaatgggaaaattgtcccattcagctagttgtaagccaaaggagaaaacttaaggggttgtattatgcagctacatttttgaactgataacagttacccttccctgtcctttcctgcctaaacagatcctgatgctgcaaaccaacatttctttctttttttttatcactgttgatgaaggttatttaaaacagaatcagtgatatgttagcaaatattttatgactggctttcaggaaaaaagaacatagattcatagcaattgtgtcatggtttaaatactcccaccatcaatgtgaggtcactgaatgtagatttgagaagagctttgtatatgcagaattaattctcattagccaatctgagcaggctccagcacaccactgacagttaaaagaggtggatgactgatgtgagtaaccacatgaatgaatgtcaaaaacattatgctaaaaaaaatgtgctgaggtaagaagccagatataaaagaacatatactgtatgattacatttatttgaatttagaacaggcactattaatttacagtgatagaaatcagatcagtagctttttggtttttgttttattgagaaggaatttggctatgaagggatatgaaggaactttctttctttctttttttttttttttgagacagagtatagatcttgtcactatgctagtagcgccatcttggctcaactgcaacctctgcctcctcagttcaagcaattctcctgcctcagcctcccgagtacctgggattacaggtgcccaccaccacgcccaactaatatttttgtatttttagtggagacagggttccaccatgttggccaggctggtctcgaactcttgacctcaggtgatccacccaccttggcctcccaaagtgctgagataacaggtatgagccagcacacctggccaagaactttcttagatgaaaatattcatagcagcattacccaatagaactttctacagaactatcaacataacaattgtattttcaatctctgcttaggaaaaataaccaaacagcaatttaaagatagcctgtaggccaggtgtggtggctcatacctgtaatcccagcattttgggaggccaaggtgggcagatcacttgaggtctggagttcaagaccagcctggccaacatggtgaaactccgtctctgctcaaaatcaaaaattagccggctgtagtggtgggcgcctataatccaagctacttgggaggctgaggcaggagaatcacttgaacctgggaggcagaggttgcagtgaactgagatcgcaccactgcactccagcctgggcgatacggcgagacttagtatcaaaaagaaaaaaaaaaagcctaatagtaagatggaacccagtatgctagtatatatttaacagtcagctcatagcaaaccaagccctagtttgttgtgttttctaatttctatggtgtaaatactctcaccatgactcaccattcaaactaccaagatgaaggcattgaatggtgagttggaaagagaaatgtacgatcaattcataagctggtgtgaactcagtttctgaactgcttctacccgtcactattattgacggactgaattttcttggttttagtttagttctttagattattcaatctttcccagagctgtgtctttgcccagagactttattgaacctcagagatgtctggctaggctgtagctcaactttagatcctttaacagaaggaagaacacgagggctgagtgcggtggctcaggcctgtaatcctagcactttgggaggctgaggtgggcagatcacttgaggtcaggagttcaagaccagcctggccaacatgatgaaaccctatatctactaaaaatacaaaaactagttgggcttggtggtgggcacttttaatcccagctacacgggagggtaaggcaggagaattgcttgaacccaggaggcagaggttgcagtgagccgagatcatgccattgctgtccagcctgggtgacagagcaagactccatctcaaaaataataataataaggaataacatgcgtatgatccttaaaatatttctgcaactttttttttcccctggtgctgcagcttctattcgtaaagaatggtgaggaacacaaccaagctttaaaatcagtgtacttgagaggttttgttgttgttgtttttacaggtaattaaccatatgttacacattttaatctgcttttaagtgcaagagagattggcaaatgacttaataaagaaatgacttctgcttaaattggataaaatggttgtttactggtgtttattgctgtattccaagtagacaagtaatctgtgaatccagtttagtttattggacaataaatggtactcagaacttttatcagtgtttgattgtcaggatgcccattgaaattgacttcatacttagggaactttaattttattgtacagtatgcactgttaaaaaaaatatccttgtctttcagtataaacctatgacattgccttgtggcattatcatccctgagatgctttcttgctctaagatttcttctatgtcataaagaaaaaaggaacttttggttccttcatatctaatgcagttttttcttttgtaaactctaaatattttccattgccaccatcaacaattcaaataacaatcttactgatggaaagtccatgattagaaatagctgcttcttcaaaaataaagaactttgtatgtacctatccattttgaaaatcttaaccattgtgctcagaaggagagatatgattttaagaagggtcacatttagaataccaataatgtcctactcctgaaataattgggaccaggccgctaaaaagaaagcacctgatgtttggcctttcagtattttctataactatgacgccttggtccaaattatctaataaatgcttcttcctattctcccgccctaagagtccatggtctctttataaagaagaatcatatacatacagatattacttgaatttatatggcatcctcatgaggtgaatcccacctatgtcacttaggattcatttgattgccctggtttgatccaattcaagtattaattcaggccaggtgcaatggcacatgcctataatcccagcactttgggaggccgaggtgggcagatcacttcagttcaggagttcgaggctagcctggccaacatggggaaacccccgtctctactaaagatacaaaaattagccgggtgtggtggcaggcacctgtagttccagcaacttgggaggctgaggcaggaggattgcttgaacccgggaggcagaggttgcagtgagtaagccaagattgtgccactgcactccagcctgggtgacaagagtgagaccctgtctcaatagaaaaaaaaaaaaaaggccaatatgggcccagggcctgccattcagacttccgcttgtggcagagaccaagggatggcagcaggttagtcgcaggtgaagtcataacaagcggtgtggagccgcacctgggcaacatgtcggaaggaaatgcagtgagcgaacccagcactctgcaagggccccgacccctcctgactggggcccaggagctcagcaggcagcgactggcaccccttcaccccgggccgccttcccttcatccgctctgggaaccttaccctgggggttgaggttgggggtcaagaagaaaaccttcaccccaaatatcatcagtcagaagaacccaaggaagaagtaaccgtcaagaaggagaaacatgaaagggacagagatggacagagacaggtgcatggacagggatgaggccacccagaagtgatccagtctcactccatctttgagaagggcccagctgaaatgatgaagaaaaaaggaactggaataagaaagtgaatgtgtcagacatgggaccttctcatatcgtccacatcaaaaaagagaagaaagagttggacgaagacacgaaacatctcaccatgctgtagaaggacgatttcattgatgaccctgggctgaggaatgacactcgcaacatgcctgtgcagctgccactggctcactcagggtggctttttaaggaagaaaacaatgaaccagatgttaaaccttggctggctggccccaagaaagaggtgggggtacctactgtgaaactgaaagaggagctacaagatgaggaggaggccaagataaaggctccttccagagcagccaggaagacccccgggcctcccgaaggacatatccgtggcagagctgcccagggagctgagcctcaccaaggaggaggaattgctgttcctccagttgccagacaccctccctggccacccacctatccaggacatcaagcccatcaaggcagaggtacagggcaaggacagagaggtggtactcatcaagcaggagaacgaccaggaagccaggctggcaaagaatgcttctaccctagctgacctgacagagggtcaggttggcaagctgcccatctgcaagtccgaaagggtgcaactcctcctgggcaaggtgactctggacgtgaccatgggaaccgcctgctctttcctgcaggagctggtgtctgtgggccttggagagagtaggactggggagatgatagacctgggacatgtgaagcacaaacttctgtgttcccccgattttgaatccctcttggatcacaaacactggtaaaatgatcagatggaggaggatggcggctgctgtctgctccagacattttgttctcgaatctctgcaacccaggagaggccagttgagcccacccactccagcctttggcagccattgtcccagtttcccccagggcccacagggcttcctcccacagcagctgtgaatggcacagttaccttcccacagtgtgaagatggtacatccttgctgctggggacttgtccatgctatttgtttttgtatttatattttgtattttgtcttaatctcttcaactgactgcatcctcccaagggaggagggaggatctgtgggaaggtgcaggcttttggtggctgttgggccgtcaggcagcaagtgtgaggactgcagcttttgctggtgctcccttcttcctcccagaggcagtataggagagagagcaaggattgagtctgagacttaagcatggggtcccaactcatcagttcctggttctgtatccttgcgcaaactacctaacctttctgagcctcctgttcctcatctgacaaaaatggggatgatacctacttcacagggttgacgtgaggattacatgggatattatagatgaaaactccttgcacaaggccagaaccagtagccactcaataaatgttaatttccttttaagtaaataaataaataatcaaatgttaattcaaagtcccacatgagagcgttctgtgttttgtggtgtttgttttgttttgttttagagacagggtctcattctttcacctaggctggggtgcggtggcacaatcacagctcactgcatcctcgaattcctggactcaaaggatcctcctgcctcagcctcctgagtagctggaactatagacatgtgctaccatacctagctagtttttttttttttttaatctgtagactgcctctgtggacagtttttcaaattttttgtagaaacagggccatgctttgttgcccagactggtcttgagctcctggcctcgagtgttcctcccaccttggctgagacgacaggtgtgagccactgcacgtggtcagccttctatctttaaacaggatctgaatctagattcatcaactcataaatatgttctcatttttaaatgatggaatgatggaaagtgaaagcaccaatcaaatcatattttcattatttccagaatgtgttcagcacagttaggtctggaaaggtttttgggaaaggttgtgcaaggttgaatttattcactgttgaaatagcacctctaaatttcaagcaattgtatgatttacttttatacaagtgtcagaaatgctaaattattaaatcccaatggcaggatcactgacaactagaaacttgagtttatttgcttccgtggtttactaaactaagctagagaaatatagtacagttatttactacttaagatcagccagaaaatgtatagtgagttcatactgtactagattctgggagataatcaaatgtaaaacatataccagtctcaaggaagttaaaatctagtaggaataatcactatattcagcaataattgttaattgagcacctactctgtactagatacagtactaagagctgggaataagattaagtcataattcctacctataaggagttcaaagtttagttgagaagacatttgtaaagaagtaattgtaactatgatagataccttcctggaagtatgtgaaggttataagtgatggcataaaagagaataatcagttctgcttggaggccaaggactatagccaagaagacatgccttatttggaactaagagtgaaagacaatttgaaatgtagacttgatacatacacaagaataaaagatcatggcacatttgggacatcatgagtatgaccaaagagtaactgactaaagttactcttttggtcagggaaagataaagtttgaacaataggctggattcatatcctagagttaagagttcattcaatagagaaccattgaagagtttttaacaggggaataacatcagatttgtattcatgaaaaagtactctgtttattcatcatatatttattgagcccctataatataccaggcatagttctggatgctagcaatcatcagaaaaaaatattgccttttctatagctcctcttacctaggcagccaagttttgtgccctgagccctagctcctttcctgtgctcagctgagtgaatcagggttaggaacataaccaaaggtagacagtccatagatggtcagtgagctatgagctaaaacagcagaggaaatcagttttttgtctgtctgtttttgatgtaggatctccctctgtcacccaggctggagtgcagtggtgctatcatggctcactacagccccaacctcctgggctcaagcaatccacccaccttagttagcctcccaagtaactgggactacaggcacgcacccccatgcccggctggcttttaattttttttgtagagacagcttgttgtgcaggctggtctcaaactcctgggctcaagcgattctcctgtctcagcctcccaaggctctgggattacaggcataaatcaccatgcctggctggaaaccagttcttcagataagagagtgcagcatgtaacatttaaagaagtagagaccaggttgacatgaacagctttatagtaagattaaagtgatatgcttcatttagtgaacctattaaagataacagaaacctcgttaattcattatacacacacacacacacacatatatacacgtgcatatatatatgtgtatatatatagtcaggtgcagtggcccacacttgtaatcccagtacttcgggaagccaaggtgggaggatcacttgagcctagaagtttgaaaccagcctaggcaacatagggaggcccatctctataaaaaaaataaaaataaattagctgggcatggtggcgcatgcctgtggtcccagctacttggaaggctgaggcaggaagatcacttcagcccagagctcaaggctgcagtgagctgtgatggcaccactgcaccccagcctgggtgacagagagagatcctgtctctaaaaaatttcttaaatgcagtcacacacactaaacaaaggggaaataaggttttagagcagtaattccatctatcattgttttcttggtcatttttccatggaaaactatttttgtattcaaagtcaacactcattctcttatatgtttacattcagaactgaagaccttaactggaattaacttaaaacatttgtagaaaatcagatgcaaacatgaacaaactaagagattttaccacaaacaatgatgtagaggcaggtagtctgcaaggtcagaaccatgccttcagaagcagcaattttaagtgagacctgaatctcctatactcaaaggtcttgcattagtcaggattctctagagggatagaactaataggatagatatgtatctatataaatgggagtttattaagtagtattaactcacacaatcacaaggtcccacaatagaccacctacaagctaggagcaaggaagacagtccgagtctcaaagctgaagaaagtctgacgttccagggcaggaagcatccagcgcaggagaaagttgtaggctgggagggtaagccagtctggccttctcatgtttttctgcctgctttatattctctggcagctgattagatggtgcccaccaagattaagggtgggtctgccttccccagcccactgactttggcaacaccctcacagacacacccaggatcaatactttgcatccttcaatccaatcaagttgaccctcagtattaaccatcacaagtttcatttcaagattaataatatccttgtccatttaatcataaaaaggaatgcttattatgtgccaacttttccaagtgctttatatgtattaactaatttactcctcagaaaaatcctgtaagtacctgcaaatgctattattgttccttttttctttctttctgagacaacatctggctctatcacccaggctggagtgcagcagcactatctcggctcactgcaatttccgcctcctggactcaaaccatcctcccacctcagcctcccgaatagctggggctacaggaatgcaccaccacacctggctagtttttttgtatttttttgtagagatggagtttcgccatgctacccaggctggtctcgaacttattagctgaaacaatctgcccatctcagcctcccaaaatgctggggttacagacacgagccaccgtgtctagcctcctattttaaatatgagaaaattggcctggcacagtggctcatgcctgtaatcccaacactttgggaggccaagttgggaggattacttgagcctaggagtttgagaccagcctgggcaacatgacgaaaactcttctctacaaagaatcagctgggcatggtggcatgcgcctgtaatcccagctacctgggagtctgagataggaggatcacttgagccagggaagttgaggttgcagtgagccgagattgcaccactgcactccagccagggtgacaaagtgagaccctgtctcaaaaaaaaaaaaaaaaaaaagaggccaggcgcagtggctcatgcctgtaatcccagcactttgggaggccaaggcaggtggatcatgaggtcaggggttcgagaccagcctggccaatatggtgaaaccccatccctactaaaaatacaaaaattagctgggcgtggtggcacgcacctgctgtcccagctactcaggaggctgaggcagaagaatcgcttgaactcaggaggcggaggttgcagtgagctgagattgtgtaactgcactccagcctgggtgacagagcaagactctgtctcaaagaaaaaaaaaaggaaaaaggagaatttaatctgattaccagattgtaaatggcaaatctggaatgtgaacccaagcagtctgacttatgcacttaaccacagttatactccctctactctctatggagaatttatcaacttaatttagtcaaatttggttatcagtaccaggcttaagggaatttaaatgtcagttaactgctgtgtaacaatgaatcaaaatctatttattccatcatcacctttttttcaggaaaatagtagcaacattacttgaatgacaactttgggatcatattttactacttctctttcattcatttgtcccaaattcctgcctttgccatgggactctaggcagttgacaaactctgtgagcctcagagtcatcatttataaaataaggttagtgataccttactcatgtgagaattagatgagataaagtatacaaagcatttgatgcagtgctttttcactcagataactaccgttgcattccattgcctgatgtatcaaatccaaacttttgcgtggctttcaaagtctccctagaaatggctagatcccacccatcttgatttatttcttgccttacttgatatataaactttcttctgtctctattcctcttgggacatacacacctttcttttcctctctttttcattatccacatgtttaagacctagtttaagttcagtcttctccgtgaaagcatctccagttaaactatattgttctttcccttttttgaactcctgttgcagttataatagatgttacattgtgtgatatttcacaaattctttgatatatgctaggtttctctttccatctagattctaagctccttgagaagatagatcatgtcttaatatttttcctgtatctcccccagaggatctaacagagtatcataactattgttctatgagatctaatgagctcacagctattgttcaacaaatacttattacctgattgaagaaaataagctcctaaaaatacctgataatattatataggtctttatattgtcagggtgtttttataacactgttaatacttaatccatataatagtcacagaaaataggtagaacagatattatcttcattttttaggtaataacactgagtttaaattacattgtggcttgcccaaggattcttggtaagtagcgttattgaccccaccctcaacccctgccattccagtccattgtccgttctctatcaggctgccaaaataattttcttttgagacagggtgttgctctgtcatgcaggctggagagcagtggcacaatcatagctcactgcatcctcaaccacctgggctcaagcgatcctcccacctcagcctactgagtagctgggaatatagatgtgcaccaccacatccagctaatttttccattttgggtagagatgaagttttgccatgtctcccagtctggtctcaaactcctgggctcaaccagtcctcccgcctcagcctcccaaagtgctgggattatagacatgagccactgtgcccagcaatattttcatatcaaagatgagattgcatcactcccttatttaaaactttccaacagtttcccattttacatagaatgaaatcctgcaaaacccccacattcagtatactccaggtacagtggccttctttagcttcagcagtcttagtttgccaagcttgttgctagtctggggcctctgcacttgaatgttctacccctggaacttcacatggcttgttccttcttacccttgaaatctcaactcaaatatcacctcctcagtgaggaagtaatacctatgtaaattaactcccctcccttgtcacacttcatcatatcatcctgttttattttctgtatggcacctattaatatctcaaattaggccgggcatggtagcgcatgcctgtaatcccagcactttgggaggccaaggtgggtggatcatggatcacttgagctcacgatttcaaggcaagcctggccgacatgatgaaaccctatctctactaaaagtacaaaaagttagctgggcatagtggtgcacgcctgtaatcccagctaagagtagctgaggcacaagaatagcctgaacccaggaggtggaggttgaagtgagccaagaccacaccactgtaccccagcctatgcaacagagcaagatgctatctcaaaaaaaaaaaataatatatatatatatatatatgtatctcaaattagcttgtttatatatttgttacttgtgtattgtctatccccactagaatgttggcctcataaaagcagagtttttatcctattcacatctgtattcccagtccctaataaagtacctgacacatggtagagtcttaataaatatttattaaataaaatagctaagcccgaactagactaaaactatggcttttttgctcctaatcaagtgtacttcccatgaacatttaatttttcctactttttgtggaagcacttatacctttggaactacagtaagaattgatgttcagaataatgacattaagatgtgctgtaggattctctattatcaaagaaaaattttattcagttcaataaactaaactaattaaagcagggatgtcatggcatattattatattaacacatttagaaagatttccaaataaaaagactttctgctttttctttagttaactagaaaattaaattaactcagagctctttatgcctcaaaagtccttgttaattaggattgttctataaatctctattattagcagagttcatcatcttttttattgccctgtttattagggcagtctaagcagggtgtctttgctcatatcctgatatgtgtgtcctagtgaaaagaaaagcatttccggattctcattttttccctattccttgatataggcatatttcatgctgttagtataacaatttagtttccttctatcagttctctccataaagctggaatgatattattgacctatgaagcaaaataattaaatttaaggtctgtttaaaagcattaatgctttgtgacgttgtttatgataatagaagattgaaaatagcctaaaagtccatcagtaaaggattggttaaataaattatactatatccatgtagtggactattatgcagcaataaaaaataatgaggacattctctgtttaccaatatagaaagatatccaagattttaaaatatgatccagagtagcctagatagtatgatacctttttttgtgtgggtgaggggaggaaaaaattaagaatgtagtttattgtatatgcatagaaaaattctagaaggatatataagaaagcaataacagtgataaccagattgggaagtagaaggagcagaaaccagctgaagggcagagatgaggagagggagattttatagcatagcttttcatatgttttatatttttgaatcatacgaatacattacctactcaaaaagttaaattaaaaacaagcacaactaaaagtaatatgtggccaggcatggtgcctcacgcctgtaatcccagcactttgggaggccaaggtggatggatcacttgaggtcaggagttcaagaccagtctggccaacatgatgaaactccgtctctactaaaaatacaaaaattagccgggcatggtggtacacacctgtagtcccagctactcaggaggctgaggaaggatatcgcttgaacctgggaggtgaaggttgcagtgagccaggatcgcaccactgcactccagcctgggcgacgcagcgaaactccatctcaaagaaaaaaaagtaatatgtgattctggactgaattctataccagatgaaaaatattgctataaaatacattaggacaattaagaaaattgaactgtggactatagattagattaaaatgttgttttctgtgtttatcaactataacctggctaacagaatatcatcactcttaggaaatacacactgaagtattaaggggtaaaaggcataatatataccacaaatgctaaataaaactttgaaagaataaataatgttatatatatgggaggaatgatcaactaaatgtggcaaaatgttaaaaaatggtaaatctggataaatgttgcatagaaattgtctgtatttttctgggaacttttctgttaatttaaaattatttctaaatagttttttaaaagaaacaaacaaaaacattttaatactatggatattaccttattataagcaatggcataagaatgtgaagggttctggtttttacgtagtcatacttttcactttctggagaagtttttaccatcacttttctgtttcttccatgcctattgatgctgggtcagaggcagtggcaggggtagtgactgaattttaccttgaggttgaaaaacaccaggccaagtgtggtgactcatgcctggtgtttaggaggctgaggcaggaggatcacttgaagccaagggctcaagaccagtctggagaacacagcaagaccctgtctctacaaaaaaaatttaaaaattagccaggcatgttggcttgcacctgtagtcctagctgctcaggaggctgaggcaggaggatccttttagcccaggagtttgaggctacagtgaaccatgatcacaccactgcactccagcctgggaggcagagtgagaccttagctcttgagagagagagagagagagagagagagagagagagagagagagagacagacagacagaaggaaaatgaagaaaggaaggaaaaggaagagagagagaaaagaaagaaagaaaaacacctgcctacctgcctttcaacctgctggatcaccttcacttgtatcttctcaacagtttaggacatcaacaaaacagtaacaatgtggcattttaaaaattctttgaacaaaattttctaaggatatcgtgaggttgtgtgtatctagtgctaaaatatatagttaatttagtggaggtaaacctgcagaaacatttaattgtttggcattgagtaactggatttgtattattgttcaattagatattgtggcaattgtagaaacttaaccatctctaatataattgactttcattattgatgcatgaagatgtttttattctaattagattggcctcttaagtgattaggtagtgaagcttgtctcatatttaagtgaagagtaaattatttgtatgaagtgtctagaggatgcctaaaattgattattttgtattctaggtaagctaaattttattgttttgaatgaaggcactctgcaagtcttatctaataaatgacacaaaacaaatctgttatcaactgaattgttagtgtttgtttcctgtctgcttggggaagcttatgatttagtggttttttagaaatccagaaagtaggaataataattattcccaacccttttccttctcactttacaaaaagtttgtgaagaattgagaaataaatgctacgaataatcttaagctcttaggtagaagtacttgatcaaaactaaccaggtcatttttctacaattagtgcagaaagctagtttttactaattgttcccacagctactccaggcccatttcatgcctaagaaaactaggtcccagtgagagtcatgtgagtgttgtaggcttcattggttgaataacgtccttacctgtaagtgtatattcagatttagtgaatgtacttcatgtgttcatataataaatttcctagaatagctatggagtaggtcatgccggtaaaaactgttagttttgtgacttttttttttttttttttttgagactgagtctcactgttgcccaggctgaagtgcagtgacatgatctctgctcactgcaacctccgcctcccagattcaagtgattctcgtgcctcagcctcccaggtagctaggattacaggcacatgccaccatgcccaactaattcttgtatttttaatagagacagggttttaccatgttggcgagtctggtctcaaactcctgacctcaagtgatccacccgcctcagcctcccaaagtgctgggattacaggcatgagccactgtgcccggccatgactttttataatagatctgtaaaccagcttaagtcatttgaaaatcagagcatactgaaaatgtaataaaacataaatattattgaagatttttcagagtcatcattttgaaaggagttcttgtagttctttagataatagaaaataatgaaaactgagtttatgacgcatcttttgcatatatgatattcttatatacttatctgtactgataagtataaaaaggtagaaaataattctactttgtatttcaggaaattgagcttcatatgaaaactaaggataaagtatctcaatgatgtgtgtgtgtgtatatatatatatatatctccagaaaaaatcattataaagctgcatttatgtagaattttcagcaatttagataaataagtcatgatttttttttttttttcctccgagagggagtctcactctgtcgcccaggctggagtgtagtggtgcgatcttggctcgctgcaacctccacttcctgggtttaagcaattctcctgcctcagcctccagagtagctgggatttcaggcatgtgccaccatgcctgacaaatttttttttgtatttttagtggagccgggattttaccatgttgcccaggctggctgaactcctgacctcgtgatctgcccacctccacctcccaaagtgctaggattacagatgtgagccaccatgcctgaccagaagtcatgattcttaagaataaaattcaaaataatctcttccgttgtcgattaggttctgttcataaataaatatttatgcagtcaaaaatgaataattgttttcaaacgaggagctcaaggaattctatgtaattttggtttacttactatttatatataattattttccaatctgtaagtctagtgattaattcttatattacctaaaatgttttatagacatgttagattattacataatgtaaatgtattgtaaatagtaatggtttcattaacttgagctcattttacttatttagtacctgtttggttttagtttatagttgttatttccctgtatagtgtagcttgtacttggaagtagtaaaaccagatttctttataagtatttatggtacagaccttttcctaaatcagactgcagacctttcctgagtatttctaataaagtctgcttacattttttttttggcctgcatagtagtttgtgctatatatactctctagaaaatgtaattctggatatttgtgccataactttcaattaatcaaaatcttgtcaactgccatataggccctcatgttacaaaatgtggaaagttcagttacttaaagagtttggctgggcattgtggctcacacctaatcccagcactttgggaggctgaggcagtcagatcacttgaggtcaggagttcaagacgagcctggccaacatggcaaaacctatctctactaaaaatacaaaaattagctgggcgtgatggcacatgactgtaatcccagctacttgggaggctgaggcaggagaattacttgaaccaggaggcggaggttgcagtgagctgagatcacgccactgcactccagcctgggcaatagaatgagactccgtctcaaagaaaaaaagtttaagccagatgcagtggctcatgcctgtaatcctagcactttgggagaccaaggcaggaggattgctcgagcacaggagtttgaaaccagcttgggcaacaaagtgagaccctgtctctacccacccgccccccaaaaaaaagcaaaaaattgaccagctgtggtgctgcgtgtctgtggtcccaactacacaggaggcagagagaatcccttgagcccaggaggtcaaggttggagtgtgttatgattatacaactgcactccagcctggatgacagagcaagacctaaaaaaaaaaaaaagattttaaaaaagattgactaagtgaatgagtcctcttcttgaatatcagtcattccaggagagtattttcattaacatatttatgtctcttgttgaaagtatccattaagagcaggtagcaaaagctagacagaatatgcttttgaagattctctatgctctttattaatacctttcttaagtttctcaagatctccttttgcctccctcttgatcttaaacgagactgaagtttaagagtctttagccactctgtccccatagggatgcaaatttatgatttcagaagttccagcccccaataagaagcactgtccaatcgtttgcagatgtatcttgtaagccagatttcatgacagataagtccattccactgtcatgtgccatgtttaaagtactaaattaggttactctgtagtcaaaacaagtaagccctggtccagactactctagggcaaaatcccgttgcactgtcccttttgttctgcccatgcattcagttgtagctttcccttttgccagttgacagatagtgacttctttgcaaaacataaccagattaggttatttttagtaaaccaactaaaataaaaaattcttgacattgggaagaagtattttaacagaataatagtaatgtttttattgtgccattgtgattttctataaagaaacacccaatattcattatttatatttttttaaatttacaactctttaactgtatccaacatttcactgccaggaatatagtcaggctcgaagcttttttagaaacccatgatccaatccataccaacacttcctttagtttatggcttctgttcatttgcactgtccagaaaggtactgctaccatttgtagtcactccaaaaaaaagtgtgaactacctaggtataactctcataagacgtatacagcagcatctgtatgctgaaagttaccaaaaaagtattacttgcagatgattttgcaccttagttcccaagtgcccctgtacagaatatggagcttatgtcctgtctctctttgaatgatgagtgatgaaggagcttcagatgttactgggtgagcttgtattgagtgttacaaagagaagtcattctgcctttctttggctctaattgcagaaagtgaagtcactgcttttgctgtcttggatcaagaccagaaagaaattattgataccaatggagctggagatgcatttgttggaggtacagactaatttatttcattcttacttacaagtaaaacattttaacccttgtttctaccatataaccaagatttattcatttagtaacttctaatttcttcttttaaataattaacttctgaagttctttccatatacttctatcattgtcagtattagagggttttaccagaggaaaaatatgtgtttggaaaagataatttgctactatgctgtaccccagtcattttcacaagattaattgtatctgtcagaaaattgcataaacaaactgcatcaagtacagtatatagtatattcatagcccttcaggcttaaatgttaacacatttttgttctttaaaacaagttgtgatgaatattaaacagtatgctaataactaaggatgatgtcttttgatgataatcctttggttaaaacatctgtttcaaacacaatagtggttgtttgttatactaaaaagggttaaatttttgcctatttttggctcaataagaactggcaaattttatgtgaactaatgattttggtaatgaatactcaaaaataaaatcaaaacaatagaagacttggcttgatgacttagattgatctaaaatctgattcaaaaattcttttgataagtctaaattccttctagttaagtgtagttaattaagctagtttatagtctctagaaagctttcgcttcctcacagataccccaaaggggtctttcctggtctctgtttctttctcttaacatcaagccagaccaggttaatttaaaaaaaaaaaaaaaaaagcaagcaagtggagctgatgattgtccctttttctctggaggataatttgaatcatgggaaacttatttaagtttgtgtgatggttttaacttaatattttattttaatagtcttttgccaacataaatttttatttttctttctctaaaactattcatgcccagtcttttttttttttctcccaggctggtgtgcagtggtgcaatctcagctcactgcaacctccacctcccgggttcaaatgattctcctgcctcagcctcccaagcagctgggaccacaggtgcatgcctccacacctggctgatttttgtacttttagtggcgacggggtttcgccatgttgggcaggctggtcatgcccagtcttaaatgaactattaaccattaggatgccccatgcccttgttctttggaaagagtctgtaccacagacaacattctacttcactgttatgattgtgttttttatttccttgctcggaaagtcttcattattgataatattagagtacttagcagccaattttcctattttttactttttagagctatagatgtatgtaggctaaaatattttattctgaatttaaccatattctgtaatacattaagaaaaccctagtgatttcttggttagaaattggtcaaaccaggaatcttagtctagaaacttttaaacttatacactgtatgtacattacttaagtactttaaaatctttaaaacatgaagtattctatttctttgacattcagtgggacacataatgaggccatcatagatttgatggtgacctaaatagccactacctctggccttgggttacttggcttcctggcccggcaacaacagattctgttacagacacctaactatctgtaatgctaccgatactaggtgagaacatgtagactttttgagggagggagaggccattcttaggatactgaggtaggaacagctagctaccatttgtattgtggttacaacgataaataaactacttcatcaaagcaattgggatttttttgttagaggatttttcagcctctttttatcctacttcattatatttattgttggggtatagttaggtaagcaaaaaagaaaaagagtatagaacagggatccacagtcgtcttttttaaaggccaaatagtgactattttaggctttgcaagtcatatacaggctgtattgcatatcttcttgttttgtttgcttccttgtgttttgtttttttacagcacttttaatacgtaaaaacctttcctagctctccagctgtacaaaaacataccataggccagagttggcctacagactatagtttgccaaaccctctttaaatcatgggcagcttcctcactttattcatttctagcatttcaaagctccagacactggatttcactatacattgttgaaatcagaatagagaaagtagaaagcaggtagaaactaggcaggactttactggtaatacaattagatagccatttttctcactttgaacctactcagttcccagggtaatcagatcccaaaacactgggtcatgcaatgagatgaacatcctaatgtcagtttattaatagaatacttatgttgccatctttagcacattctgtcaaatgtgaatcaagctacaaagtaatagcaatagataacttttatacagtacctactaaccaaccaatatcttaaacactttatatatatattaactaatttagtgttcacaaaaacttcttggggtagattatttttacccctattttactgatgaaaaaaacagagacaaagaaaggtgagataatgtgcccatagtctcatggctagagagtagcagagccaggattcaaacccagaaagtctggctccaaagtcagtgcttttactcaccacactaatactgcttctctaaacatttatgtaaatctcaccattagaactgagaaccacagaccagccttcctgacaaaagctggttttgccagagaatcttcctgttatctgagtagatgacttactttattgaaaaggatctgttgtaatctgacagggttctggggactctaaggtaagattgttgaggaaaagaaagaaaaactgaaagggaagagaatccaagaactgtagtccctggtgagtttcaaccaagagctttttgctaagcagtagaatcgattgcactacagagatacagaaagccagatgataaacttgcttggttagcatgggctccaaataagagagttatatgaatcagctgtttaatagtgaagcaggatatttccctaagcccttctcaggcagaaattgcagtgtgtgggcgcaggaactagccagccactttggtgccagcaggagcgaacttcactcactcgcttctccactgctcacaggagggtgagcacacgtgagcaggtgcaggagctgggctgagcgcttttgggcactggtaagagcgaactccataccagaccagtggcagcatctaagggaagctgcccgtgacccctggatccccagaggaagcgttacagtgcccttttagctttgctgtctgtagacagcttaagcattaacagctcagttgagtgaccctccattgtcaccaatgtgacagccctttgcacccacactcatggcacccgagttcttgtccggcatccaggataaatgaggtcacacaaacgagttggagatggtaaatgcaggggattttattgccgatgaaagtggctctcaacaggaaggggagctgaaagggggatgaagcaggaagataatcccctggagtccggtcatccccagccagactcctctccaaagctatgccatcaagctgtccctctgaagtcaagccgcttctctccgatgtccaaccgtggtctacaacatccagctgcttctcctcttctttctctgttggctgagcctggggtttttatgggcacaggattgtgggtggggtgggccatgggtgattttggaaaaggcaacatttgagcaggaaaacaaggatgtaagttctcactttgggccatggtattaggctttttggctttaggatggggcgctcaccagagacctaccctcttctgcccagaaatttgcctgcctcctgtccctatcaatagcacccatctaacaactgatgcatctatcttacaacagaaatggtcttgttagttggaaatactaaaagatccattggttaaaaccccctgctccctctccacaccagcaggagcctttctactgggattggaaataacagctgttggcttgacacagtggctcacacctgaaatcctagcactttgagaggccaaggcaggcggatcacttgaggccaggaatttgagaccagcctgaccaacatggcgaaactctgtctctactaaaaatacagaaaattagctggtcatggtaacatgcacttgtagtcccagctactcaggaggctgaggccctgcccgtatggaaaaattaacaaaatggatcaaagacttaaatgtaagtactaaatcagccaggtgtggtggctcatgcctgtaatcccagcactttgggaggccgaagcatgtggatcacttgaggccaggagtttgagaccagcctggccaacatggtgaaaccccatctctactaaaaatagaaaaattagccgggcatggcgttgcatgcctgaagtcccagcaacttgggtggctgaggcaggagattcacttgaacccaggaggcagaggttgcagtgagtcaagatcttgctactgcactccagcctgggtgacagagtgagaccctgtctcaaaaaaattaattaattaattaataaaataattgtcgttgactccttccaccttgggaatgaatctcaggcagtggcaacttttacatttactatgtagtttatttttcttcgcttcattgcccaattaacatatcttctttctgattgacacattctatatttggatggttaatatattcatcctgtaactttcaagttttgctggcctaagagtatttctgtcttttgtgactttgcatatctatattttagtccactttgtggtaatttaactctctgaaggacaataattttctttgcataaatttcaagttttggataaagtatcactccagctaccatgtgctaattatctatatcagtaccagagtgccatgtgttcctttagccagctaaaaagatatatgactacatcatggattttcatgtataatttaaaaatgagtaacccaaatgtacataaattaaattaaattaaattcgtagttccatctcacgggtttagtgacagtaacaaatccctccagcctctacaagcatcgctccttgttctatttggaggtcttaagcactttgtgatatttgttctttatttgtcactgcccagccctgatagaactaatcttttcacattcttcctcaaaagcccaagtgctaggattgtactcttggaaatggatacaattctataatctctaagtatgatttcctaatttcctaggtcaggaaaaaatttcttcctgttgtcctgctgtgctttgtcacagcaggtctaccttttcatttggaaccctctttgtcactgccatagtaacaaatggaaacattgagaacattttgtgacaggcactgtcattgttcccagtgaaatctcttcccctgtgtcttcccagtaaatgaaactgagaagaaaaatcataacaaataacatgaaagaggacctaatcaatatgttcccactgggctgtcaataccagcctgtgttaatctaatatgatttagtcatatgttttatggcagctgtgggaatatggacaggacctacaaatcatctttagactgaaagtgagtacacctttgacagattatgtgtaggcacttatatacaactctcagataaaagactagagacttcacccaagaaccaacattcttagaattaaaaaaaaaaaaaaacaccttcattaagtatggttaaaagccacgtatagattagaagattttactttgttggttttttttgttttgttttcgtttttgttttgagatggagtcttgctctgtcgcccaggctggagtgcagtgacagaatctcggctcactacaacctctgcctttcaggttcaagtgattctcctgcctcagcctcccaaatagctagaattacaggcatccgccatcacgcctggctaatttttgtatttttagtagagatggagttttgccatgttggccaggctggtctcgaactcctgacctcaggtgatccacctgcctcagcctcccaaagtgctggatttacaggtatgagccactgcacctggccagaatattttatttggaatgataataaagtaactgtgctgactcataatactttttttggagggggagatggggtctcactctgtcacctaggctggagtgcaacagcacaatcatagctcactgcagcctcaaactcctgggctcaagccatcctcccacctcagtctcccgagtagctgggactacagggtttttaaaaaatgtttttgtagagacagagtctcactctgttacccagtctggtcttaaactcttggcctcaagcagtcctcctgcctaggactcccaaagtgctggattacaattgattaaaatgacaattcatttgggattacagacatgagccaccacccccagccagaatactctttattttaaaaatcctcacaacagcttcagcagagaaaatgtattacccttaaaaatattacctataatatgcaaatgactctgaaaaccactcagcaatcacaatgcaaataattctcctatttcccatctaataaaaaggaacactaattacattctctaggctgggagcagtggctcacacctgtaatcccagcactttgggaggccaaggcaggtggacagcttgagctcggcagttcaagaccagcctggacaacgtggcaaaaccccatttctaccaaaaataaaaaaattagctgggcatggtggcataagcctgtggttccagctactccggaggctgaggtgggaggattgctggagcctgggaggtcgaagctgcagtgagctgtgattgcacccctgcactccaggctgggtgacagagcaagaccctgtctcaaaaacaaacaaaaaacaatttcattctctaattcatgtttagaaaagaacattggtttacaaaaaatttttaaagagttttttcagaacaaggatgccacttcctcttcatgtggcacctatctatacttctgagaaccatgaagactctctaattatcttcatattttctatcctcaccttgtttctttggtcccaaacatttatagcttccttccccattcttcttaattgctgcttcattgtgctatgcatagaagtggtgcagaattcttgggatttgttttttctacactacccccttcctttgctctccatctcagaagactagaagacaacttggtaagtgttgaatatattgtttctcagacttcttcactcaaaaaccaaaaccttcatatgacccacatctgctgaggatttacttgatggtgaccaagatgacagctgcccactgctaaacaacccaatgtcaacaactctttttcttgtctttctgctctaatgggacatcttctctgttttatttcttgaacagaaatttttcttaaaaccatcaaatgaacagtgaaattggcttggtcattaggaatatgaaacagaccaggcatggtggctcacacctgtaatcccaacactttgggaggcagaggcaggaggatcacatgaggccgggatttcaagaccagcctgcacagcacagtgagaccccagtctctacaaaaaaaaaaaaaaaaaaaaaaaaaaatagccaggcagggtggcatgtgcctgtagtcccaactactcaagaagctgaggtgggaggatagcttgagcccaaaaggttgaggctgcagtgagctgaggtcacgccactgcactacagtctgggcaacagggggagaccctgtctctacaaaaaaaaaaaaaaaaaggatatgaaacattcaccacagatagtagttcaggttcatgcaacagaaagcaagagagagctatacccttgcacagtgataggatgctttattacatgccacactagtgttatacatccagagtcttagtcaagctgaagctagaccagcaccaaatttcataaacactgtctatgattatttgagccttcgttagttaaaaaaatgtaaagattatcctctccagccatgatttaaaaaaagagagagagaaatcactttgttcatgtgaaatacaggatgattttagagtgaagcctgtaatttctcatcaacgcaaatgttccctcaaagacctaatatcctgaatggccttcatctagaagcaattgtaaatagataatggaattgaaaggagtttatcttctgggaatgtggataagacacagacagtctgaaccatgtaggctatcagactccaaagctcagatgtgaaacttaggtttcttatatttgatgattattgagaaatatttattctaagaaaatgatgttgatatggaaatttttatttagttgcagaggtccacaggaaatgtagtaagtaaaatttctgaagttcattttcttaaacagaattgtgacataacaaaatatatgtgtgttagttccctgacctagaatattggtgagccaattggaagtaatttgaatcctaaaattctctcagctgctattaaatgaatctggtcaattttacctgtctgatacatccaacatgtatcagttagcttttactgcataactaaccactttcaaaacctagttacctaaaataacaactcatttatttagctccacaaatctgtgggttgacagctgggcctgtgcttacctggacagttcctctggccttagagtgttgagagattaagtaatttgcccaaggtcatattgaaagctaagattcaaactcaaaatttggcctcaaagttcttagccctagccattttgctatactcccttttattactacaacatcttagcttcctctctaaaggaggagaaatagccaaagtggttttataaacactggtctgtcgactggtaccagtctatgacataagagttttcatcagtcagtatcaaaatgtaaaaaggcaggggcaagaaagtaaatttccataaaactaaatgtattcagttttaaatcttgcccttcctactttgagggagttcagttttctttctttatgaataatgttggtaatagtggattttttaaaaatgttcttatctagcagaattaaagtttgccagctctgtgtttatccctaaaatcttttgggcaagtttcaatgttctgtgaaatcccaaagtctgggattcactgatcaaccatattttttcataaattctacaaaattatttggccttttttttttaatgccagtaaaaaattactgatgacgtgaatgccattcatgttgggcttttctaatatctggcccacttcttcatataaagaagatgagtataggccaggcgcaggggctcacacctgtaatcccagcactttgggaggctgagacaggtggatcacttgaggtcaggagttcgagaccagcctgaccaacatgatgaaaccctatctctactaaaatacaaaaattagcaaggtgtggtggtgggtgcctataatcccagctactcaggctgaggctggagaatcgcttgaacccaggaggcggaggttgcagtgagctgggatggcaccaccacactctagcctgggcgacacagcaagactccatcccaaaaaacaaaataaaaagtaaagaagacaagtatagaactgtaagttctatacttactgtaaacagatgagtacaggccgggcacggtggctcacgcctgtaatcccagcactttgggaggccaagacgggcagatcacgaggtcaggagatcgagaccatcctggctaacaaggtgaaaccccgtctctactaaaaatacaaaaaaattagctgagtgtggtggcagacgcctgtagtcccagctactcgggaggctgaggcaggagaatggcgtgaacctgggaggcagagcttgcagtgagccgagatcgcaccactgcactccagcctgggcgacagagcaagactccatctcaagaaaaaaaaaaaaaaaatgatgagtacagagcaataagtataatatgatgtgatttgtattttgttaaaaatggtcttatgtgtgtatgttgtaggtatacttataaaagcatataaaagttccaggaagaaacactccaaacagctaacagtggatgtactgggaggtggctgaatgaaataatcactttctactctgtatgtctgaatttttttttttttacaatgtgcccttattggctttgtaattagtgtaatctttaaataaataaaatcacatgtgtgtagcactgatgcagagcctagccaaccttagtacctagcagaaatcttcactgtggtaaataagtcatcagacacagcatttcaaactatacgataatttacataaaacataacctctgatgttttaaggctacttatcagcaaaggtctgaataaaacaaaattagcagcatgattgtcaaattaacagctactctctcttcagatatataagttctgaaaccaggggtataaacacaggcttttaatttatttttcatttaattatccaattaacgttgacattttatagaatttagatatatttctagcccacaaagtaaatggcaaattaaaaactgatttctgtcatcaaatgctcttaaaattttagaaccatcatgctatgagaaattttcagttgatcaaatgtaggtttttgaattgagttaaataataacaaaatgatccttcttatgaattagggcataagcacagcttcacataaacaatgttaccatcatcttatcccagcagctattactttgccccattgaatcttttgtttttaactatatcatttagagtgtttgtgctgaaaggaaaattttaaaaaatcatattttctggttttcagtttccagtagtgaaactcttttcaaatgagatcttatctgaatcagaatgaaatgaacccacaaaaattaaaaattaaaaatgtttttaagaaagaatgaaatgagattaaacaaactcccatttgtccctatccacattttatttggtggctcatgatgtcacgtaggaaaaccatgacctattcaaaagcccctatttgatgaatgaagaaagtaaggcccaaagaaaggtaagatgagttgtccaagggagttaattgcaaatacgagacaagaagccagattactgaattcatgaagcagcagttacttgtgttcataatccaaatgaaagttgtcagttaaggctgagcgcagcagctcatgcctgtaatctcagcactttaagaggccgaggtggacaaatcacttgaggtcaggagttcgagaccaccggccaacacaacatggtgaaaccccgcctctactaaaaacacaaaaaattagccaagcctgatggcgggcacctgtaatcccagctacttgagaggctgaggcaggacaattgcttgaacctgggaggcagaggttgcagtaacccaagatcacgccactgcactccagcctgggcgacagagtgagactccatctcaaaaaaaaaaaaaaaaaaaagttgtcagttaagctgtctgttatttagtcctcttggaaacatataggtcaagagtcaatatcccaaatgcacagaaggaggggttttttgttttgttttgtttttgtcttgatgtttgactttaacaataaacagaagcatacgctaaacttttattttgggaaccacatcaaaagatcacacattagctttaaaatcaaatactgactcagtgttgtacatctatgctccatgaagaagaatgacttttaaagcagtgttttgaaagggattagggtgaaagggcatcttatctatatgagtgcaaaatactgcttagcagtactcttcaagagctttcttccgaaattaagatcatttttaaattgatgggcttttggttttgtttttaattcaaatacaatgtcccataccatgttaacagaacttagtaagcttccatttttagccaccacaaagaaggaataagaagttattctcaaagctgtagctataggacaataaagttattctttcttatagctacagtactgaccacttgcctgtatattacacattgcttctcagttgctcactttatgtgggagggtgtgttgtgctgaactatcttaaagcaacctttgctctaaattgacttcctgtacatgtcaacaattaacaccatctgacaccaattaagctttagttttcttttcttttcttttcttttttttttttttttgagacggagtctagctgtgtcgcccagaatggactgcagtggtgtgatctcagctcactgcaacctctgcctcccaggtttgagtgattctccagcctcagcctcccaagtagctgggactacaggtgtgcaccaccactcctggccaacttttgtatttttagtagagacagggtttcatcatattggccagaatggtctctaactcctgacctcagatgatccacccgccttggcctcccaaagtgctgggattacaggcatgagccactgctcccagcctggttttcattatgcaaatacctgctaggtcagaccttaccctggcaggcacagtagctttttcagttatttcaaaatttaatatttattattttccctgaaaaatcagttttctaaaatttgggtcacaagttgttatttgagttcatgactaattggtagtcaatatgaagtcaaaacaaaattttactaactagactacatagaaaatacaaaaagtttacatctgagcacttttcagcagggggaaaccattactttgtcacatctggatattctaagctagccaaattgaagtgggaatttcctgccagatgttagttctttgagcaacctgtgaacatctaagtaagtgaggggttatgagtccttgtttggtagagctatacccactctggaggcttgctcctaacaggcagcagacattttatatgtactaccaccagtcaggaggttgtgcaacctatttgaagtcaatatgatgtgctcttgttaaatgtcaaaacatccaaggcctcattttgaatgtacaacatcagtcttacagatattatatccagggtgaacattgcattgaaatgtcctcccaaatgtagatgacaaaaattttgtttcattaatagaaagaaggtaagactgaaacaccacaggtattccagataacttggatagggccattttgtaaagtcagtgtagaccaaaatatgtctctaaatatgagggaaataaagaatctgaaatgacatgaaaaataccaagtatttatatcaacctcctgttctagacgcacatgggaattaggaagtgaaaatttcattcagaagagctgtgcacaaaaagtggaaatgcattattcaattgaaacaagtaacatttttaagggggataaaatactttctacatgatctcactggttttgtcgtcctccgtaagggaaaatattgacatttaccagactgtttgctccagctttctgatctcctgcagtttatttttataacaaccttatcgatgggcctcttacccagctctctaggtttaactgagttgagtcgatttgttaccacagcttcaagtagctgttacagaacaagcaagacatcctaataaagctgtaaacgtgtttactcaaacagagtattgattttacttggaggggaagaagccggttcttagcacagtgtcagggtggatgaatttcactgcagtttttcattgtcatctgtcagggttgtgaaacactaagtaaagccatcagaggataattagaagtaccagaagtttagcccctaaaatcagttaaccacttgggagttttgtagcttaattagcttttattaaaactttccctagtattaatagccaagcacttttaatggtatttccaagtagatcaagatatcaagattgtgacttgttaaatatatgaatttaatggctaagggtttttcagaccttttctcactctaaattaggctaccactagaacataattagaaccaaaaccaatgtaaagatacagtgatctgtacttatactagcagaataaatgcatgatttttttttctgaaaaatcaacttaaaagaagtagtaaaacaattataaaataatttaagccaggcgcagtggctcatacctgtaatctcagcactttgggaggccaaggcaggaagattacttgagcctaggagttcaaaatgagcctgggcaacatagtgagactcccatgtctacaaaaaattaataaattagccgggcatggtggtgcacacctatagttccagctactcaggaggccaaagtgggaggatcgcttgagctcaggaggtcaaggctgcagtgagccgtgatcacaccactgcattccagtctgtgtgacaaaacaaagccctgtttcaaaaaacaaaaataaaacatgtctttgtagaaaaatccagtttgcgtctttattacacttaaatgtttttgtaacacaatgtgatctaaacacataaaactgtcaatgccacccttatttttaaataccttgattaaagcagattctaaaatattctagcttactttaagttagtcattgtcttaacaataaaagctgatgcacgttgtgcaaaaggtaagcatcagagtaaggagttgcttaccttctgtagaaactgcattagctactgagcttcatgaaaagcattcatgtgaacactacctgacctcttccaaatgtctagaaaaacaaatcacagttgaaaaaaatcacccacctagaaaatgaacaaaaaaactggaaatttattaaaaataagtttgaccttctctcatgatgctgcagtcaagcaaaaatgaaaaataagtttgaccattatatttaaagtacatcttcccatatctaaataattcatttagtgctttatggtaaactttttatgtcttcttgcactactgcctcggcctgtctaaatgactaataaaaattatgatatctctgggatgaccagttctaaagcctaagggtaacagactctgtcagaaagaacagcaaaagatgttgggttttctttgtctttgaaatgctttgtcacgtgtttatctgtgcatatagttctaagccaaattctaccctgaattgctttaagccacaaagtagcaggttgtaaaatattgttgcataagagggcacctctagagcttgctcttctaatttttctaaaggtagaagaaattgacttttcacaattgtatttagatcattcttccatattaaggtattcaaaaacagaaaacataaaggatatggatttatgattatatcatttttatgtgcatttcaaaaggcccacaatacagtaatttattttattctatgcaattttcttgagaatgacagcatgtgagagagctcgttggatggggaggggcagtatatagtagggtagccatatttgagcttcaaggcactgtttactctgactccttcagtcaaaaggagcataaacccatttcacctagttcaggttaaggaattttttttttgtaaggaagatattataacagtggttaagacactgggtcaaaatatgtggggttttttgtttgtttgttttggttttttttgaggtggtgtctcgctctgttgcttaggctggagtgcagtggcgcaatcccgactcgctgcaagctccgcctcccgggttcacgctattctccttcctcagcctcccgagtagctgggactgcaggtgcccaccaccacgcctggctaattttttgtattttttagtagagacgaggtttcaccatgttagccaggatggtctcaatctcctgcctcctgatctgcccgcctaggcctcccaaagtgctgggattacaggtgtgaaccactgcacctggccccaaaagatgtggttttaagtcctggtaccacattaactagttgtgggactgctgtggtttgaatgtgtcccctctaaaattctagcattgtcaatgtgatagtattaagaggtggggactttaagaggtgattaggccttgatggctcctctctcattaatgggattaaggcccttataaaagaggcttcatgcagcatttggctagcttgctcttccactctggcttacccttccaccctcacaagacaccaaatgccaacagcttgatcttgaacttcaaagctgccataattgtgagacaataaatttctgttctttatgtattacccagtctcaagtattctgttgtagcagcacagactatgagagagactatggaaaagttaattctcttttttgtttgtttgttttttgttttttgtgtttcttttttagatggagtcttgctctgtcaccaggctggagtgcagtggcatgatctcggctcactgcaacctctgcctctcgggttcaagcgattaccctgcctcagcctcccaagtagctggcgactacaggtgtgcgccaccacgcccggctaattttttgtattttagtagagacagggtttcaccatgttggccaggatggtctctatatcctcacctcgtgatccacccgcctcaacctcccaaagtgctgggattacaggagtcagccacagtgcctggccgttacttaacatctctaagcctccgtttcctcatttataaaaatgaagataatgagtacctatctcatttgggttattatgaaagttaaatgaagtaatgtttataaagcacaacacctgatacatagtaaggattcattaagtgttacatattataagaggggtctcaaagaagtctcagacaagagccagaatgacaagttttcactgaaagtatagccagatggtgattgtaggttcaagtcagttctggagacctcagcagcagatactggatcttcactccagttcttcactaattaatcctactcagctgcattacgtgtctgcgtcttactgtctcacagtcagcttcccagcctgtctttgttttccattctggctcctaaaagagaacactgggttattagctcaattcactttttatacaatgtcatcagtaggacactaggagaaccataagttgtttgcccttgaacgagatgcctaccctttgttccatttaatagtaaaggttgaatttacgtgcacaaaacattctgcagtgctggaagtgatttttcttaaaagggtaatacgtggatgggctctataaacattgtgtttgcatgccttgtccactaccttcttcccatatttatagttctgaaaatgttccctacaacgtgatccatctatcatacaatacatggaacatcaaacagcttgtatctcaagctagaaacctagacgcccttcctgagtccttccattccctctctccaaaccgtcagtgagttcttttgattccgctttaaggatgtatctcaaatttgtccacttctatttctctgtcatgactttagcttaggcctgttttccacttactgtagtagtttcctaactgatgtctatgccttcactctttctggaactttattccattttctgtataatagccaaaataatcactttaggaagaagttgaattatttcattcccctgcttacaacctttccgttgcttctcactgcacttagcctaaaaatccaagctcctgtggtgatttaaaaaaatctatatgatctgctatgtttgtatctttatttcattccattttcacctttgcctgcatgatgtagctatactgtcagtcttctttcaggccttagacactttgtacagtggagtttactttgcctagaatgttcctcccctactctttaaaagtcaactcttctgtaatcatcctatctaaaatgggtcccttgactaatattctctcctgttactcagttctttttcatagtagcacttaacactctggaattgtcttatttacttatttgtttacttgtttttgtctatttcccccattacaatgtaagtttcagaagaacaggaactgtaagtgtcttatttaccagcgtatccccgggacccagcacagtgcctagcatagaagactcagtaaatattagttaaataaatgaatatatcaatcatatgcacagctgcaaaccgatttgcccctaccatcaagtaaagaccatttagtcggtatttctaggaatttggttattgaggtatatcataagaaggggttagaataagtcaggaaacagagtaggccatactttaggatcaggtcaacttggtttaagagtaacccacgctaggccaggtgcagtggcttacgcgtgtaatcccagcactttaagaggctgaggtgagacaataaactgagcccaggagttcaagaccaaccagagcaatatcgtgagacccccattggtatcaaaaattaaaaaattagccagacctggtggcaaacacctgtagtcccagttactcaggatggtgagataggaggatctgttgagcccaggaggtcaaggaaacaatgagccataatcatgccactgcactccagcctgagtgtgtatgtgactaatccagaaacagagagactgatcatactacctttagtatcacttaaaataaaggatgctgggctggggggcatggtggctcacgcctgtaatcccagcactttgggaggccgagaccggatcatgaggtcaggagatcgagaccatcctggctaacatggtgaaaccccatctctactaaaaatacaaaaaattagctgggcgtggtggcgggcgcctgtagtcccagctactcgggaggctgaggcaggagaatggcatgaacctgggaggtggagcttgcagtgagccaagatcatgccactgcactccagcctgggtggcagagcaagactctatctcaaaataaataaataaataaataaataataaaataaataataaaggatgctatggagagaatacatgtgttaggaaagaaggtagtatttaataataattgtactaagtagttatagtacagatacaaaaaatttattctcaagatcataatcctgaacatcagttcctgctgtaataggcagtaacatacaggtcagagactccagtcaagatttcataaaatatattaaagttatccagtagatctccaagttgattcctgacatcactctcaagtcccctaatacacacatcacactctcaaacttacaaatttggtttgccaaaatgtccagtgggaagggtttaattcagcagataatagaaccttgccctgtcctacctaggatctttgctgccattccttcgtttataggtgtgagtggggtaaaaagtagctcatccataaaggaggcagtgaaaatctctagtgaagagcactgagcctgggacataacctgtttcattttccacagcttctttacctcaagccacagaattgttcttagctctttaacttttgtcagcacccacatcaaatcaacaaacttgtttatttttcttctttccttactatctatcacccagaatagtggttctcaaacttgagcgtgcatcagaatcatctgaacacttgttaaaagatctgttgctggaccctctcccagggcttctgatttagtaggtccgtgatggggcttaagtgatactgaagcagctggttcagggaacacgctttgtgaaccatttctggaaagaattttacagtagattcccatttgatctctctgcaagcagtctctttcctagtaagttcatattccacacttctgccagagttagctgcccaaaagcaatgtaatatgcctcccctgtatcagagtttggttggctctctatttattatagtataaaatccaaatcaggctgggtgtggtggctcacacctgtaatcccagcaatttgggaagctgagatgggtggatcgcttgaactcaggagtttgttaccagcctgggaaacatggggaaaccccatctctaccaagaatacaaaaaattagtcaggcatggtggcacacacctgtggtccgagctactcaggaggctgaggtgggaggattgcttgagcctggaaggcagaggttgcagtgagctgagatcacaccactgttctccaacctgggtgatagaatgagaccccgtctcaaaaaaagtccatatcacatcatacaagatccttgacgatatgtccccattttgtctttcccgctgtgtccccaactcagctgacctttgactatattgcaaaataagctttgtcctgtcaacagcatggctttttttcctgcttataatgtctatctctgcaaaatgttattcattcaacacccagctcatgtcaccttctccaagatgcatttctaaatgtcccccaattgaggtgttatgttatttttaaagtgcatacgtggctttctctcctaaagctataaaaccctcaaggacaaacactgtgttttatccatctttgactcctttggtgcacccaaagcccagtacctagacattcaatagctgttggttgatggaatgaatccaggtacttctgacagattccagattttcactttcttttgtttcttataataaaaatgtagtatagaagcagtcatggcatgagtctagtaaactgaggattcagatcagtcaaagttataatttatcttattccctttcctaaagcagctagagataatgaaaataaaacctttaaaaagaatgtaacacctttaagttgactgcctcgtgtacactgtggcagcatatatctggtaatcattggtataggaggtaagtttaacaggccagtttaagacagcatataaatcatcactaaaggacagatagctaagaaagatggaaaataaacaaataattgaaaaaccagattgacccagaaatgactaagaacaaagtttgtgcagggagacagggagaattgagtttagtactgttagttgctgtaaaatatatcaggtttgctttaattacatggtaatgcttctaagaacaaaggtaattacatgataacttatgttactactcccatattatctctaaataactatgtaattagcttgtcactactatacagtgtgaagtttgatattactcatggataaagaacattggtaacttaagtgagtgagcaagggtggggtgagggatggaggcagcagggaaatcatagaattattacaatcaggaatgcaaatggttaattagatcattgcacccagtccttaaggatctgagccagagccatggagaataccaaacgagtctgaggtaaattctccatggcttgtcacagtgtcttctgaagaccataaacatacaacaaagtaagttgacaaagcacgcaacagatcaatgagtttgggatataatgcatgtaattttaaacagttccttttatttggggaggtttttcttttaagtaaatactaagaattttttttaattgaaaaatatttcactcatctcattttccaacatcctgaggttatatgtgtggcctatggggtgaggatgtgtagcactgggaactctcatttattgctggtaaaaaatgcaaaatggtaaacaaccactttggaagacaatttggcaatctcttacaaaactaaacatacttttaccatatgatctagcgatcaggctccttcgttgcccaaatgatttaaaaacttacgtcttcacaaaaacctgcatgcatatgtttatagcagttttattcataattgacaaaacttggaagtagctacatatctttcactaggtgaatggataaacattatcgatacaataaaatatgattcagccaacaaaaagtaatgagctatcagctgggcatggtggctcacacccgtaatcccagcattttgagaggcaaaggcgggcagatcacttgaggccaggagttcaagaccagcctggccaacatggtgaaaccctgtctctactaaaaatacaaaaattagctgggcatggtggcaggcgcctataatcccagctacttgggagactgaggcaggagaattgcttaaacccaggaggcgaaggttgcagtgagctgagatcgtgccattgctctccagcctgggcaacaagagcaaaactctgtctcaaaaataaaaaaaagaaagaaggaaagaaatgagctattaagccaagaaaagacatgagggaaccttaaatgcatgttgctaaatgaaagaaggcagtcttaaaggctacatactgtgtgattctaactacagtcatgcaccacataacattttggtcattgacagaccacatatatggcagtggtctcataagattataaaaccttatttttactgtaccttttctatgtttagatatgtatagatacataggtacttaacattttgttacaattacctaaaattcaatagaataacaggctatacaggattgtagcctgggaacaataggctataccatctaggtttctgtaagtacactctgatgttttcacaatgacacaatcacctagtgatccatttctcagaatatatccccgttgttaagcaactcaagactgtatatcacattctagaaaaggcaaaactatggagactgtaaaaaagtcagtagctaccatgggctggagctgtggcgcaaggagagagggatgaataggtagagagcactgaggatttttagagcagcaaaactgttttgtgtgatactttaatggtgtatattattatatttgtcaaatcccacagaatatacaacacaaagtgtaagccctaatgtaaactatagatattatttaatgataatatgtcaataatggctcatcgattgtaacaaatacacccactaactaatgtaacaggttaatcataggtggaactggggagtaaggggatgagggaagatttgggaactctctgtattttctgcttcattgttttgtaaacctaaaactgcccaaaaatataaagtctaatttttttaaacccaagtgggaaaacctttcttcgatccatcttattctactgacatcttgggtgtgtatgatggtctgtgtttcccagtgtcatcaatttcactgccttaaggtgctatggcttagacttgtgtcctgtggccagtgacctcacagtttttaccaaaatacttgttttcattgctatcacgtgatagctactctaagtatgattatccttcttaattctgttaggaatccccccggcattccctgtgagggaagtattagtccttgaatttccgtttcaaaagatgcgtactgatttacttggtatatagcttctgtaagaggaagtttcatttgggaaagaaaggttgtgctaaggttccctcagaaactttctaaattgccttctctaaaattgcctgtgtttccctaagcctaagagtaaaatacaggaaatagtgatgatttttatgtgcttgaggaatcttctaagaagagtgaccaattttattctacttatactgatacttgtactgatttaccttgtggaaaattcatccagtggctacaattactaactcactccaaaggcatgagtgggaaactattaaaataacacatcacttagctgaaactcttgaatggttgctcttaataaccatttttctgaataatttaaagttcccatgttttttaaaaaggtttattgacttagatctgatttgaaaagtgtaatgtagcttattatagaatatttaaaacataagaaaaacaaacaggaaaaaagtcatcccaactctagaaacttaacttttttcaaacacattttttttttttttttttttttttactattttgactaaacatgtttctaaatgtacttcttggatctgactaaagactaaaaatggaaggaaacacaagtagaaattataaagtcaggatcaggccagtgtggtagctcatgcctgtaatctgaaaaccttgggaggctgaggtgggaggatcacttgaggccagaagttggagaccagcctgggcaacctagtgaggccccatctctaccccaaaaaaaaaagaaaaagaaacttatttatttaatttcctctctttaaaggtatcatatgcaaaacagaaggtttgggggttttggggttttttgtttgtttgttttttgagacagggtctccctctgtagtccaggctagagtacagtggcacaatcatagctcactgcagcctcaaactcctgggctcaagcagtccccactaccttagcctcccgagtagctaggactaaaggtttacaccaccatgcccagctaatttttctattttttgtagatacagggtcttgctgtgttgccagggttggtctcaaactcctgggctcaagcaattctcctgcctcaacctcacaaagtgctgggattacaggcatgagctgctgtgcccagccagaagttttcattttagcacagtttaatctttcactttctggtttctgctttttgtgtgtcttatttaagaaatattttctacctctaggacataaagatattttttattttcttctaaaagtcttactatttttccatttacatttaactcattgatagacctggaattctttttttttttaatatagagtgaggtaatgttatttttccaaattgaaaactagttgcctaaacactacttttctaagaagccatcttttccccatgaatttgcaatggcaactctgttgtagctcaagtttccaccttttctctatttatttatagctatgccaacaaacactgcatttattattatagatttttagaagtatttaatctggtaagactagtctctcctatcatttttacttcagtaagtgtatatgcctgttcttgatcctttgctttttcatataaattttagaatcaacttatcaggttcccaaaaacattgttgagactgtgattgaatttgtattgaatgttatcttcttctccaataacccagcatatctctccatttaggtcctttgtaatatctttccataaagttctatagttttctttattagaggctggcataacttgcatcgcttttgtatttttaccaaattacatttttaaaactgttgctcttgtatatatatatgtgtgtgtgtgtgtgtgtgtgtgtatgtgtgtatgtgtgtatatatgtatatgtatatatgtatgtatattctatatacaaagctgctctcaatgaaaatattgacaaatttatttcttcttttacaattcctgtgtatgtgtggggtgtgtgtgtgtgtgtgtgtgtgtgtgtgtgtgtgtgtgaagatctcgcactgttgcccaggatagaatgagtacagtggcatgttcacagctcactacagcctcatccttctgggctcaagcaatcctcccacctcagcctcccaagtagctgggactacagtcatgtgccaccatgcccagataatttctgtattttttgtagagccgaggtttcaatttcttacccaggctggtcttgaactcttgggcttaagcgacctgcccaccttagcctcccaaagtgctggaattacaggcacaaactactgcacccagcctccctttacaattcttaaattttttttagtcttgttactcttgttagggcttccccactatgttaaatagtattgattttttattttattttattttttgatacagagtcttactctgttacccaggctggaatacagtggcacaatctcagctcaacacaacctccacctcccggattcaagcaattctcatcccttagccaaccgaatagctaggattgcaggcacacaccaccacacctggctaatttttgtatttttagtagagatggggtttcaccatgttggccaggctggtctcgaactcctgacctcaagtgatccaccagcctcggcctcccaaagtgctgggattacaggtgcaagccattacgcctggcctgattattattattttatttttattttttatttatttatttttgtttttgtttttgtttttttttgaaacgaactcgttctgtcacccaggctggagttcagtggcccgatctcggctcactgcaagctccacctcccgagttcatgccattctcctgcctcagcctcccgagtagctgggactacaggcacccgccaccacccccagctaatttttttttttgtatttttagtagagacaggttttcaccatgttagccaggatggtctcgatctcctgaccttgtgatctgcccgcctcggcctcccaaagcactgggattacaggcatgagtcaccatgcccagccctcattattatttttaatgggactgtgtatgttttctatttatttgtaattttactgtttccctttttccacattttctgcagttattgggtatgacttttataatcagaaaaacaatattttcacttgctttcttaaaaataaataatctcttagtgaaggcctgaggggtccttataggtgtaatatggatggccatggagctgctatggcttcaggctttatatatatgaggtattgctgtctattcacagtattctctgacctttaaatttatgtggcttaaaatctattttcaatgcataaacatttgtatatttttccaggtgaacaatgtactacctagatgtataataatttaaatttagtgtaaaatgagattttttacaacaaattatatatttccaaaaactttaaaatgtttaaactctacataggcatatggtggtctactatatataaaaggtttctgggaactatttaagaagataaaaatagagccactgacatgtatttgtactgtatctttgggaaaacaatttcagcgtaatatatacttgtaaaaagtgaattagtaaaactattctggccgggcacagtggctcacacctgtaatcccagcactttgggaggctgaagtagaaggattgcttgagcccaggggttcagaccagctgggccacatggtgagactccatttctacaaaaaatagaaaagttagtcaggcatagtggcacacacctgtagttctagctactcaggaggctgaagtgggaggattgcttgagcccaggagtacaaacaaaaacaaaaaaaactttattcctccaagtttaaaaagtgcagcttgcttacttgttgacaagctgctgaatatagaatgaacagtaatagagtctactgggttttaggttccagctaccatgaaaaactattaaggaactataaatagaaaagaaaaaatggactcataaagactttgttcatttccttctaaaatatccctagcttattaagtgtctccattaaggcttccgtacccactgacaatatttcttgattctctgtaaatgacactaagaaaattctagatgctatagctcttctatagtaactacatggaatagacagcttaagttaggaaattacattgccttttgagcacaccagcaatcctacctctgtgtgctttgaggaaactagtgtagcacctcctctttttgtacaactttaacatatgtttcaggtctcatgtcaaataccagatacaatttgtcaatttattgatcacattttgtaacatcagtaaaagtctaaataaaatcaaccagaagataataggctacaccaattgttaatgaacagaggtttatttggaaagattgttccaggattcagagccagctaacaatagctctaggaacccaatttattgtcgatgagagattctcaccttatgcctcgtcagctagaggacctaaagtctataacgtctcctaaagctgggaaaagcctgagaggcccaggttgatacgcctatgtgtaacaggatagagagaaggaaccaaagtaaaaaggcaacaacaactgcctcagcatatgagttcttgatttggaaaaacctgcactgatggttcttgttctctggtgtaatgcctcctatgcctgctctcttggctgtgttgaaaagcatacatacagagctgtgctcttcattttcaagatgatgtactgataaggaccacaagccagtggcactgggaaaaagggatcctaagagactttttcttattaaacatacattcaaagtcagttatttaatattttgctttttggactcttggtaagcccaaatcttgttctaaaaagagcagacttttttgttttgttttgttttgtttgagatagtgtctcactctctctcccattctggagtgcagtggagcgatatggctcactgcagccacaacctcccaggcttgggtgatcctcccacctcagcctcctgagtaagtagctgagactacatgtatgtaccaccacgcctggctaaatttttgaatttttttgtagggacggaattttgccatgttgcccaggctggtctcaaacttctgggctcaaatgatctgggtgcctcagcctccctaagtactgggattacaggcatgagccaccaggcctgacttgtttttgtttttttgttgttgttgttgcccaaactagagtacagtaggctcaatcacagctcactgcagcctcaacctcccacctcaagcagtccttccacctcagcctcccaagtagctgggattgcaggtgcatgccaccacgcccagctaattttttttttttttttatgtagagacgagtctccctgtgttgcccaggctggtttcctgggctcaaatgattctcccatctcagcctcccaaagtgctcagattagaggtgaggcatgagccacccaacctagccttttttttttttttttttttaatacctgcaagccacatttatctgctatagtgtttaccaaccacactctggggcctgaggctgtgtttcagtgaatgaaatattaaaaagtactttgtttacttgctgacacagtacagtatttgtatctattaatagcatattgttattgttggttttttttttcgaaaaacactttattggaataatatacttaaaatgcagggaacttttaaaaatagagtgaggccaggcatggtggctcacacctataatcccagcactttgggaggccgaggcaggcggatcacctgcagtcaggagttcaagaccagcctggccaacatggtgaaacccgtctctactgaaaatacaaaaactagctgggtatagtggtgcatacctgtaatctcagctactcaggaggctgaagcaggagaatcacttgaacgctggaggcggaggttgcagtgagccaagatcacaccagtactccagcctggatgacagaggagactctcaaaaacgataataataattataaaatagagggtgaaagaccaaacatcctatagaaaaataagcaaaagataaaaattaattcacagagagatttgttctttaaagatatataaaaagatgttcagcttcacttaataagagaaatccagattaaaattatactgaaatatttctaacccatcggactggcaaaaattcaaaagctggacagtgtactatattggtgaagttgtggggaaatgggcactcttacattactagtagaaatagaaaatccttaaacctctatgaaggagaatcactaataaaactatgtatgcatatagttactcattaacctagcagttctacttctagaatttatcctgaagatacgcccctaataacacaaaaatacatatgtaaaattttattcattgtagcattgtttatatttccaaaacattggaaactatgtaaatgcccacacataggagatagattaaactacagtgtatttatacatggagatactatgtagctgtaaaaaagaatgaagaaaatctctaccaattgatgtataatgattaccaggagattttggtctctgactacaggagtctcgctctgtcacccaggttggagtgcagtggcgtgatctcggctcactgcaacctctgcctcctgggttcaagcgattcttctgcctcagcctcccaagtggctgggattacaggcacccgccaccacacccggctaatttttgtatttttagtagagacaggatttcaccacgttggccaggcaggtctcaaactcccgacctcaggtgatccacccgcctcagcctcccaaagtgctgggattacaggcgtgagccatggcacccagcctccaagagatacttttaagtggaaaaaaagcaaagtgtaagagagcatatatagtgtattacctccttttgtgttaaaacaaaaaaaaaaagaaaagaaaaagaaagaaaaggaagaaaatgtacatacatctgcttacctttactaaaagaatacaggaagataaaccagaaaacagtgaaagtggttgcttaaagggatggtgaggaggacatggtaaagagagtcactcttctttgagcatatcttttatagaatttttacttttagaaacatgttaatgttctacatattttttaaatattaaatcaataaggatagaatgtaagaaatgggactaaaactgaaagcaaactgaaaaacatgaacccaactatttccaatcttttcttaagtaaaatgagctccccaaagggggtaaaaaagagaaccaatctaagttacatgctgaacacagtatttgactacaccagagaacagaaaattaaccctaaactctttttagtagatttggatttttttcttttaaagttagggatgaagtgacttggaaactattttagatgtattacaaaagtgagtaaacaaataaatttgttgatatttttgggagctaggttctcactataaaagaaggaacatacaaataatgggatgaggaaaggcaagaaagaaccctgtggagatggactagaattggaagtactggtgtcagctcaatttctaaaataggtctctgtacacatgtatacgtatacagttatggatgtaagtgtgtgtgtgtgcatgactatgtatacatgcatacttcccagctctgttcattaacatggtctagaagcaaagagcacagctgccacccagatcttggtctctaataccattctgtgctaaaaagaaccagttatcctcagataaatggctgattccagggcatagtagagcccagaacattatgccagaacataaagaagggatcaaaaataatgtgatggcatatccaatgacacgggagccaccagcctgaacggctcccactggcaaaaactggaatattttaaggaccaaattaattaagggctgtaagggattataaaccattgatttaaaaagaattgtgggccaagcatggtgtctcacacctgtaatcccagcactttgggaggctgaggtgggcggatcaccttaggttgggagtctgagaccagcccgtccaacatggtgaaaccctatctctactcaaaatacaaaaattagccaggcatggtggctcatgtagtcccagctgctacttgggagactgaggcaggagagtcacttgaactggggaggtggaggttgcagtgagctgagatcgtaccactgcactccagcctcggtgacagagcaagactccaccacacaaataaaataaaaataattgtgcattcttattgataataaatagattttaaaataataaatgggagaagaggtaggctcttgtttatggtagaatggtgagggctgactggtaaatgtgaaaatcatttcacagctgcagttggaaaatcatcacagtatgagttgcttcagttaaaaattatgagtggatactcaatctgggagggggttgggacttttgataaagaacagaatatttatgtgatttttttttttttttgagatggagtctctgtcgcctcggctggagtgcagtggcgtgatctcagctcactgcaacctctgcatcccggattcaagcgattctcctgcctcagtttcccaagtagctgggactacaggcacccgccaccatgcccagctaatttttgtatttttagtagagacagggtttcatcatattgaccaggctggtcttgaactcctgaccttgtgatccgcccccctcggcctcccaaagtgctgagattacaggcaggagccaccatggccagcctaatttgatttgaggatttgctcagtctgtcttccttccttctttccttccttccttccttccttccttccttccttccttccttccttcctctctctctctctggtctctttctttcttttttctttttttttgagatggagttttactcttgttgcccaggctggagtgcagtgacatgatctcggctcactgtgacctctgcctcctgagttcaagcagttctcctgcctcagcctcccaagtagctgggattacaagcaagtgccataacacctggcaaatttttgtatttttagtagagacgaggtttcaccatgttggccaggctggtctcaaactcctgacctcatgatctgcctgcctcggactcccaaagtgttgggattacacgtgtgagccaccgtgcctggcctatgtgatcttaaattgtctattcacaaactgcttgttagatgcaagggaaaaaataggtactatacaatggagaagtaggacaacaccttgatcaggtggtcagaattcctatcaccagtgcacagcagatggacatgatgtgcctctaaatgtgacactttgagaaggatccatcataatgtgtgtagtagtctgcctgggtgtgcatagtctgaacttaatcatgagaaaatattagacaaatccaaaattagaatcagtctattaaaaatgggaaaataaataagtaatgggataagcgcgtcagacacagtggctcacacctgtaatcccagcactttaggaggctgaggcgggtggattgcttgagtccaggagttcgagaccagcctgggcaacatgacaaaaccccatctactaaaagtacaaaaaaattagccaggcgttgtggtgtgcacctgtggtcccagctacccgggaggcagaggtaggagaatcacctgagcctagggagttgaggctgcagtgagccaaaaaaaattatgccactgcactccagcctgggcaatcagagtaagaccctgtctcaaataaataacaaataaattaaaaatgaggtgaggtaagttatgactatattcttcaaaaatgtccgtatctcaaaagtcaaaatctgaggaaatgttccagatttttaaaaactataaagataccacagttaaatcctgaactagactctgttccagaggagaaaatttccataaaggatattattgggtaattgactaaattgaaatatggacagtagattagataacagtgttactgaagttgatgttgatgtccacactgtagctatgtaagagaatatccttattctcagaaaagatacactgaagttttcagaagtaaaaagacattgtaaatgtaacttcctctcaaatagttcagggaaataaaattgtatgcagagaaagagtacatgcaaatggtgcaaaatgttaacaatattgtgcacctgggtagatgatatgcagatgctttttgtactatttttattcctgcaacttttttctgaatttggaatccttttcaaataaaatacattttaagcaggctaataattaaaaatctaaactaagattatattgggaaacattatgctaagtgaaataagctagacacaaaaagacaaatattgtatgatctcacttatatgaggtacctagaataggcaaatttatagagacaaaagtagagtagcagttaccaggggctagaagtaaagaggagtggggagttattgtttaatgggtacagagtttcttttggggtgatgaaaaacttctaaaaatgcatagaggtagtagttgcacattgtgaatgtacttaatgtcactgaattgtgcatttaaaatttgttaaaatagtaaattttatgttacgtatatttttcaaaataaaaaagtatcttggggatgtttacttccattataaaaggattccctacaattatttaaatataagctccctttgtttatttaaacaattttatacagctttcaagattcacatcagatactttttgaagattccacttataactgattatgtagtatctgtatttcattttagttggtttttaaaaatagattattgaaaaactgacattcaccttgggcaaaggtcttagcttttttcagcatccaggttctccacttgtcaaagcaaaagattcttcagaatacttcattcatcatctagttctcttagaaaaaggatgctggtggttttgcttcacaaaaatatttcataaacatgagctttttctttttctcacaatgatcataccaggcggaatgaagaaaacagatgttgcttataaggcgtctaatagacatgtttgcattgtaagctgatctgactctgaatttggcatctgctccattcactgtgtggactgagcattttcgcctcacagtttggcagaaaagttaatattgacttttgactgttacctgaaaacttggtgataaaatactcttactaaacctcttgagagagtgattttacagtctcagcaaatgtctttaaaatacatcattctattaaccattttaattttattctttggttgggaatacttatttgtttcatctaatacagagcattccccaaatctgactgggaaaagtctgtgtggtcagaatggtagaagaaggaggacataaatcacttataatgttctctacaggtcattataccacagcttctcaattaaccttcatccccctcaggctgcccagggcctcagggaaggcccagaagcctagctgcagcacagtttctcattattatctgctcttctgagtatttgagtgttaactgcagcagctcagcagctcaggtttcccctaaggggaaggtagcccagattcttctgctcttgacctgtcttatttgcaattatcctttttttcttttttcacagttttattgtggcataatagacatacaataaacggtatgaatctaaagtttacaattgtataactttggacatatgtgtacacccatgaaaccatcactatggacatatccactgctcccatggccttttctaatcatgccttcctgctccttctcatccccttttggattgtttccagtttggggctattacaaataaagctgctgtgaacattcatttacaagtctttgtgtggatatgtgctttcacctaccttgggtaaatacctagaaatagaacggatcatatgatatgcacatgtttagctttttaagactgacagatggtttgggaaagtggtcttagcattttacattcccacaattagtgtgtgagagttccagttgatcacacccttgccaacacttgttatagtcagtcttttcagttttagccattctgcgagtgtgcagtggtatctaattgtgattttaatttgcatttctttaatgaataatgatattgaacattttttcatttgcttatttggcatctatcttctttgctaaaatgttaaatacttttgcctactttgtgttgagttgtttcttgttattgaggtaccaagtatttaattgtgacaaagttcagattattttttcttctataaaagttgcattcttagccaagtgtggtaacttatacatgtaatcccagtgctttgggaggccaaggcgggcagattacttgagcccaagagttcaagaccaacctgagcatctctacaaaaaaatgcaagaattagaggaaagctgaggtgggagaagagcttcagcccagaaggtcgaggctgcagtgagccatgagtgtgccactgcactccagcctgggtgatagtgagacactgtctcaaaaataaataaatttttaaaaaagaaaagttcatactttttacctcttactaagtgatctttagcaaacccaagatcactaagattttcttctatgttttctcctcaagagttttaggattttattccttacatttatgtctgtgattcatttcaagtgaatttttgtagatagtgtaaggtaaaggttgaaatgcttttttttcacacaatttgttaaagtgtcctttcttgatgggattgtttgggcacctgtgtcaaaaatcagttggctatacagaagtaggtttatttctggactctgttcagttccattgatctatttgtctatatgctaataccatagtgtcttggttattatcattctataataaattttgaaatcaggtagtataaatcctctggctttgttcttctttttcaaagttgagtttttgctaacctaggtcctttgaatttccatataaattttagaagcagcttgtcagtttctataagaaaaatctgctagaatttttattagtattccaatgaattaatagaaaaattcctgcagaactgataatattgaatcttctgacctttgaacactttatgtctatttatttaggcttcttttatatttctcagcattgttttgtcattttcaatgtgcaggccctacacaacttctgtcagatttattctaaggtacttcaaatatttgaagtatgtgaagtaccttagaataaatatggataaatattcttaactttttaatcaatttttgtttttgagacagggtcctactctgttacccaggttggggtgcagtgatatgatcatagctaaccacagccgcaaccttccaggcttaagcaatcctctcacctcagcctcctgagtagctaggtctacaggcatgcaccaacatgcatggctaatttttgtattttttgtagagacaggatttcgccatgttgctcatgctggtctcaaactcctgagctcaagcaattcacccatcttggcctctcagagtgctgggattataggcatgagccacgatgcctggcttattcttagtaacttctaattgttcattgctcgtatgtataattatatatacacattaccagtatagataatttacttttgtatttttagtagagacggtgtttcaccatgttgattttgagaccctatcaacatatgcttccctggctgggtgtggtggctcacgcctgtaatcccagcactttgggaggccaaggcaggcggatcacctgaggtcaggagtttgagaacagcctggccaacatggtgaaaccccatctctactaaaaatacaaaaattagctgggcgtgatggaaggcacctgtaatcccagctactcgggagcctgaggcagaagaatggcttgaacctgggaggcagagattgcagtgggccaggatcatgccattgcactccagcctgggcaacaagagtggaactccacctcaaaaaaaaaaaaaaaaaggaagaccagattgacttgatggcaagttgttgtgtctcaacttgagctctttagaataaatattaggggaagctcatgatgtttgggaaaagatctcccgaccgggcacagtggctcaacacctgtaatcccaggccaaggcaggcagatcacgaggtcaggagtttaagaccagcctggccagcatggtgaaaccccatctctactgaaactacaagaattagctaggcatggtggtgcatgcctgtagtcccagctattcaggaggctgaggcaggagaattgcttgaacctgggaggcggaggttgcagtggccaagatgatgccactgtactccagcctgcgtgacagggcaagactccatctcggggaaaaaaaaaaaaaaaaagacctccctaacggtaacgcacaagactttctcttactgtcaaggctgaagaatgagacaggtgcttagatcatatattggtctgacccaatatgacatttctgctgctgttatacaatactcatgtgtttttttttgcctgtgttctaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggacacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataat

SEQ ID NO: 2312 - DNA, 532817 bp, Homo sapiens
gcggccatttttggggcgggcacccaatctctcgccctgtaaactgcggggtgacgggacgctgttactaggactcaagatggccaccgcgcccgctagtcatctcgctagcccgcgcgccagtgagctggcacgagacacgcggtggcccacggcgtctggggacgatctccagcccttcgcacggggcggagcgcccgccttccctccaatcagcacgccgggccggctagccaggggccgcccgcgcgcggggtgtgtgaggacgcgctcccagtcgctgagtgcctgagccgggaagcagttgctgtggtacctgctgctgcccgagcggacgtagagcatcggacgcgggcgccgtggcgctgggcaggagggcgaagccatgacgtcagtcaggtaacgagcgggcggctgccttgactgctccgagctgggcgttagcctcccgagcgcgtgagcactgtcgctccttctcgcgggtggtctggagcctgcctccgcctctggtccccctcgtgttgggggttccctccgcacttttcatttgggcatttctgctttcctcagaagttttcgggtctgtggcacattgcggagttctgtgtgtcgctgcttggtcgaggtgaccctcgcccaaattccagggttgcaagcgttcttgggtgtgtagtggatttcccatgaaaaatgtgccccacccgcgcccccgggggcggcccagggccggagggagcgtggcgtgcacagtgtgtgtcatgcctgcgtgtcatgccctctgacagaacttcattgttggccgggagcagacctgcaaagttggcccttctctgatgcaggtatattgccctcaagttgtgaaattgtgtgtctctaaaatgtttgctcatgactggaattaggaccctggttcccgaaggtaccatcttgtttctttactccttttatctcagagtcacaagtgaaatgagttgagagatactgggcatgtagcgaaatccatgaaactggagactttcccccaattgctcttccagtttggaaggttctttttttgttaatgaggacaggataatgggcttgtccactttctcccagtagccttgactgaatgtttaatttacgctagttcaactatttataaaaagagataaattgccttatatacccagtgttctgactggcctttttaaaagcagaacttgggctttgttgtcccagagaaagggaggccccagcacaaaaatgtgaagagaaataaaataagctcatttttggtctatgagctttccaggctccacccgtcctggtgatttgagggcttctcaatgccaatttttactacattgtgtttaagagacagcttgggaacctaaccctcagtaagatctaactgtgctgaactcggacatagtctgtctcttaaattgcataattatatatatatatatatatatatttttttttttttgagacagagtttcgctcttgttgcccaggctggagtgcaatggcgcgctctctgctcactgcaatctccgcctcccgggttcaaacgattctcctgcctcagccatccaagtagctggaattataggcgccagccaccacacccagctaattttgtagttttagtagagatgggggtttcaccatattggccaggctggtctcgaactcctgacctcaagtgatccacctgccttagcctcccaaagtgttgggattacaggagtgagccaccgctactggtctaaattgcttcattctgtactaacatagacaaagtacttatctcattatgcagaaggagattcaggtgctgaaacatggagacccacatggaaggatttcacagtaaattatattggggcatataaatctagcttttaaagctaacagtattttaggatgaattagaattaggctattatacccagagttaattccccttcttcccattcccactcttattatcacagaatgctactaattaggtgtaggggtcaaatactttctgtgttaagaatcagttgttatgtggattcagttttaattgactatcatcttcctgaccgtgcctcattggagaaacatccaaatctaaagcttctgctgtttaataagtgacagcaggatgtatcttttactgtaggggttgatagttttttttaaaagactgatgtaaaggttgacaccagccttacttgacatgttttgaaaggatggataactgataataaaatttatttatgcttgtttcttcagatgtcagtctgtattttacataatcttgaactatggtaacatggctcgagaaagctcttttagatgttatttaaaccagctattacattttacacctgaggaaactgagacaaaagttgagtgccttgtgcaaaatcagcggcaaaattaggaattgaatccagatttccatgatttagtgctctgcatggtgcctttgtagaaacaatatactatttaaacttcctgaaaaagctgtttctgtggacagaaattgtaaagtatcatgagagacaactatagtaactcttttgctttcttcttatcctgcaacgaacttgataactggggtttagaagtaggcagggttagccaagagaacacaactactgggtgttgggaagtgcagggaggccattgaaagtgaagtgactctgtatggtgatagttttgaatgagttggtcatcctacagataccagccatttcctggtgaacactacatttaatacaattatgtcatatctttagtttttgcaataatgatgtcagacatgttcctatcagaggcatttgagccagagcgactccatcttgaatagggtctgggtaaaataaggctgagacctaccagggtgcattcctaggaggttaggcattcttagtcacaggatgagataggagatagtcagaagatacaggtcacaaagaccctacaacaggatgcagtaaagaagccagcaaaaactcaccaaaaccaagatggtgatgagagtgacttctggtcatcctcactgcttattatacactaattataatgtattagcatgctaaaatacactcccaccagtgccattgacagtttacaaatgccatggcaacgttcagaccttaccctatatagtctaaaaaggtgagagaccttcagttctgagatatcagaactgatttcttcctttcctggaaaactcatgattaatccaccccttgtttagcatacaatcaagaaataacaagatacttagttgagcagcccatacccgtgctctgtctttggaatcgtcatccttttgtttctttatttctctaataaacttgctttcactttatggacttgccttgaattctttcttgcatgatgtctaagaaccctcttggggtctagatcgggacccctttctgttaacattcccattttgtgctcagtctaacagtagcctaaaaggtaggtattattgacccccttttactgataagctgaatgattacaagatatccaactctgactttgtgtccaatgttcttgttttataccacccttaattgttgctaaatatagtagtatgtgactcttttcatagcaatggctatgaaagaatacaggattggaaatcaatgaggaccaatggtcagaatatcttgggccccactgagggccttttctgagttactgagcttccatttctcttttctttttattattattattattattattattgttattattaattattattttgagacagtgtcttgctctgtcgcccaggctggagtgcagtggcgcgatctcggctcattgcaacctccacctcctgggttgaagccattctcctgcctcagcctcccgagtagctgggtttacagacgcctgcctcacgcccagctaatttttttctatttttggtagagacggagtttcatcatgttggccaggctagtctttttttttttttttttttttgagacggagtctcgctctgtcacccaggctggagtgcagtggtgcgatccggctcacttgaagctccgcctcctgggttcatgccattctcctgcctcagcctctctagtagctgggactacaggcgcccgccaccacgcccagctaattttttgtatttttagtagagacggggtttcaccgtgttagccaggatggtctcgatctcctgacctcatgatctgcccgcctcagcctcccaaagtactgggattacaggcgtgagcaaccgtgcccggctggccatgctagtcttgaattcctgacgtcgtgatccccccacttcggcctcccaaagtgctgggattacaggcgtgagccaccgcccccagccccatttctcttttctattctggacatttgtttaatgaaataactcagtagcagagatactaatatgcatcctaccagtgttgttggataagtgtaaaagtgcttttaaattttaaagcattttaaaaatagaataaaagcactttgagccctctagagaatggtgtcatctgaggaaaaaaatgtttaaatcttaaatttttagacaggaaacaaatttacctatctaattttctcattttacagttgaattaaagcccagagatagtgtgacatgttcaagttcacacagttacatatcttgaactagatatgagatctctagataccttgttcagttccctttctagtatagcattcaactctgaggaattcctaaataatgatttttttttggggggggtctctttaggaattcctaaataataattttaaatgaaaacttttctttttttttaacttaagatctttgaatttggctggagttagtatttcatcatttgtattctattctacttaattactgattaagagtctaaatttacagcctctgaaaccagatatccttggggaacaacttatatcctttgttatgtatatcagattcctactggtcttcatttgggaaatgatagaacatatttgataaattgatgcttttgtcattttaaattggcccaatagttaagttggcgcctgagttaagttcaggagacagaggaagatgcagaatgtcaggattcaaagaggatcttagcattttactttttttccttttctatactggatcttgtgtccaaagtaaagtgaaatgtcctacttagacctagtggtagagcctaagatagaatttagaccttctgactcctaatttatgtatttttcactgagcaacactatttcaaaattcccctctgaatattgccttgttttcctaacatcagtgtctagtctggttttgggcatcgcttacagcttgggtttgcgccagggaagactaggaaatggagttggggaatatttgttgtagagctaatgagccctattctttggtctgcccagataggtcaggtttggtctaaaactattctgggactctggacatcactgtgccctacatgatgattctggaacccacttttgtgggttaagcctacattggaaaatttatgtgggcagtgggtggggtcgtggggtattttccttctaacactcgaaactttttgaggtatgtccaatagaatctgccaagccactcagaacattcatatggagactaaaatctggctaagattgaaactgtctttgttgagttggtttctttagagccttaaagttttcaaactcatttttacctgtgtttttaaaatacgaattgtaaattcacattactgcacaattttttttatgctgtgggatgtttttagagaggtaagtgagcttttaaactaaaattgtttcatttatggaatattttgaagaagtaaaacagaaatctttttatttatttatttatttatttatttatttatttttgagacacagttatactcttattgcccaggctggagtgcaatggcacaatatctgctcactgcaacctccgcctcccgggttcaagcaattatcctctctcagcctcctgagtagctggaattacaggcacatgccaccatgcccggctaatttttgtatttttagtagagatggggtttcatcgtattggtcaggctggcctcgaacttctgacctcaggtgattctcctgccttggcctcccaaagtgctcacaggcatgagctaccgtgccggccaggaatcttttatgtgcaacgttgtcagctgttaatgctcctatttatgaataggtcacctttgtttgaaaaaagcgtacaaggttttctaactccaaatctttccagccacaatattgctacgttaagcagaactgtcaaagataaaacttgaaccaaagtgattttctagactgtttgaatgttaaccctttcctgcaatattggttaacagtcacgtctccctacctcttcatacctccttggttttattttattatttttattttttgaggcacggtcttgccctgttgcccttgctggagtgtggtggcatgaacacagttcactgcaacgtcaacctctgggcttaagtgatcctaccacctcagcctcctgagcagctgggagtagtcccacttgtagtccctacagtcccacctgtagtcctgtagtcccacctttgtattttttgtagagatggggtttaaccatattgtccaggctggctttgaactcctgagctcaagtgatccacctgctttgacctcacaaagtgctgggcctcccaaaatgctgggattacaggcatgagccgctgtgcccagccacatccttggttttaaattgttatttaaaaaatactgttgctgggcacggtggcacatgcctataatctcagcactccgggaggccgaggtgggaggatcactttgaggccaggagttcaaggccagcctgggcaatatgataaaaccccgtctctacaaaaaatacgaaaatttgcagggtatgatggtattgtgcctgtagtcccagctacttcagaagctgagtcaggaggatcccttgatcctgtaatgaaatatactatttttttttttttgagatggagttttgctcttgctgcccaggctggagtgcagtggcgccatcttggctcaccgcaacctccacttcccaggttcaagcaattcacctgacacagcctccctagtagctgggattacaagcgtgtgccaccacacctggctgattttgcatttttagtagagatggggtttctccatgttggtcaggctggtctcgaacccagcctcagcttacccacccacctcggcctcccaaagtgctgggattataggcacaagccaccacgcctggccatgaaatatactactaataaaataaaatactgtgataaaacataaataaacatttttattttttactttttacttttttagctggcattctggtctgagattattttattttatttttattttattcgagacagagtctcgctctgtcacccaggctggagtgcagtggcacaatctcagctcaccgcaacctccgcctcccggattcaagcaattctccctgcctcagcctcccgagtagctgggattacaggtgcccaccaccacgccctgccaatttttgtatttttagtagagacggggtttcacaatgttggcaaggctggtcttgaactcctgacctcaggtgatccacccaccttggcctcccaaaatgctgggactacaggtgtgagccactgtgcccggcagagatttttattttttaaatggcaaagctaggttatgaacaggatgaccatatgttccagtttgcccaggacaattctggatcatgcctgttatcctgacattattatttattattattttttcttttgtagacacagggtcttgctctgctgcccagctggagtgcagtagtgcaatcatggctcactgtaaccttgaaatcctgggctcaagtgatcctcccacctcagccctccagagaggctgggactataaacacacaccaccatgcctggctatattttgtgtgtgtgtgtgtgtgtgtgtgtgtgtgtgtgtgtgtgtgtcaggggggtgggtaaagatggggtcttgccatgttgcccaggctggtcttgaacctcctggcctcaaactcttggtcaagtgatcctcccgcctcagccacctaaagtgctgggattataggcatgagccattgtccccggctatcctgacacaattattaatagacacataaatgtgtctcatttactctcaaaagtgtcccatttggataataaattatctggtcacctacatatgcattacaatcattttgttgtactaggttttgtttgttgaaatgttatttgaactaggaccataagataatggaattttggcctattttgggtacatttggatgtttttcattggtcagacatttttattgtatggagagttctgagtgtacaaatgtatattaaatagtaatgcacatgatttgaaattagggattatttgttatcttacttttgggaggttacataaccttgaggaacctcttgtttcctcatccgttaaaaagagataatagcgatacctatcctacatgggtgttttgaagatattaaagaggtgacataccaaaaaatgcattttaagttgaaaattgttatataagtgttagtcatgtcacacatgtgcctttctgcaattgaatttaaaatgaataattttacctagtttggggaacttactatttgatagagcactggtagtgttttgctgtaaaggagagcagggaaataatggtagttggaagtacatgctgggctaaggttttctgcggggaggttttgaaattttcacatttgtgtgctgaaaagagtggtccaatagaaagcagaaaaaatagatgatgcttgacagaaggaagaaatcaatgttgagtaggaaagaaggatagaatctagaatacatatggaaggattggctttacgtaaccaagaaacacatttccctagtctgttcactttaaaaaaaaatgccaacaatataatttttttttttttttgaagcagagtcgtcggccgggcgcggtggctcacgcctgtaatcccagcactttgggaggccgaggcgggtagatcacgaggtcaggagatcgagactatcctggctaacacagtgaaaccccgtctctactaaaaatacaaaaaaaaaattagccaggcgtggtagcgggcgcctgtagtcccagctactcgggaggctgaggcaggagaatgccgtgaacccgggaggcggagcttgcaagtgagccgagatcgtgccagtgcagtgcagcctgggcgacaaagcgagactccgtctcaaaaagaaaaaaaaaaaaaaaaaaaaaaagaaacagatcctccctctgttgcccaggctggagtgcagctgcccgatctcggctcactgcaacctacctctcctggggtcaagggattcttctgcctcagccccctgagtagctgggattacaggtgcgccccaccgtgccaggctaatttttgtatatttttgtagagatggagtttcaccatgtcggccaggctgctctggaactcctgacctcaagtgatctgcctacctcggcctcccaaagtgctgggattacaggcgttagccactgtgcctggctctctcagtataatttacctaaagtcaaatcagccttccctttccttcccttcccttcccttcccttcctttcccttcccctcctttcccttccccttccgcctttcccctttcccttctcccttctcccctttcccttctcctttcctttccacagggtcttactttgtcgcccgggcttgagtgcaatggggcaaacacgtctcactgcaaccttgacctccccagcccaagccatctacttgcctcagtcccccaagtagctggggctacaggtgtgcaccaccacgcctggctattttttttgtattttttgtaacaatgccgggggagtggggtgggggtggggtcttgctatgttgcccagggtggtcttgaactcctgagcccaagtgatccacccacctcggccttccaaagtgctgggattacaggtgtgagccactgtgcctgatccagcctctttttaattaattctgtcccccttctcacccaggcaaccacttttggacttcttttactatagatgttagttctgcctgttctagaacttcacataaatggaatcatacagcaaggagtattttgtgtctgattacttttgttcaatataatattttttagattcacccattttggtgtgtgtatcagtagtttttcccttttattgtgaagtaatattccattatatgtatgtagcaacaagtcttctattgatgggctttgggttatttccagtttttggttactatgagtaaagttgctatgaacatttttgtatatatctttatgtggacttgggtaaatatctaggagtgaaattgctgtgtactagggtagatttatgtttaactttagaaaccactaaacttttccaaaatggaaaatttaacactttttacattcccaccagttttttttttatgagagttcagttttccacattcttcacaatgtttggcattttaaaatttaggcattctcctgagtgtgtacttgtatttcatcatggtttttgtttatatttccttgatggctaatatgtgattattggccatttgcttatcttttattttgaagtgtcaattcatttctgaaatattatcactgaataatatttcattgtatagatatgccacaatttatccatttatcacttgatagatatttggattattttcacttttgggctattatgaacaatggtgctataaacatttatgtacaagtttttattaaacttttatgtgcaaccctattttattgggttgtctttttgttgctgatttgtaggagttctctttatatctgaatgcaggttatttgccaggtttctcagattttacacgcacatacacacacacacacactctttctctctctctctctaaatattttctcctggtctgagctatgttgttgcattttcttaatgccttttgagagcagaacttttaagttttgagcaagttgaatttgttgatttattttattttatggtattaccttttctgttctaagaagtctttccttactctctgctaggcttgtgaaactattctctcatggtttttttctagaagctttatgtttttgtcttttgtatttaggcctatgatctatcttaaactactcttttgctatcatgtaagggtttctcaaaaggattttcaattaattgattagatagctgtgggtcttttcttggatttgttctattctgttgatttatttgtatcttcttatgtcaatgccacactgtcttaattattgtagctttataagattggtattgttactttaaattttgatagaattaatcagtgcagccgtgtgggcctggagtgtttttgtgggaaaaagcagaaggttttaaattagtgtaattacttttacaggtttaattactttagctgatatataagcattcaggttcttcactttttcctgtggcagttttaagaagttgaatttttaaatgaatttattctcaattgttgagttgttataaagttcataaaatttcctaatattctgttattgcctgtatgaactgctgtatgtctccatttgcattcttgatgttggtacttcttttgaatttttggatcagttttgctaggggtttagcaattaatcttttcaaaaacccagattttgttttgttgaatttctattttggacatgtatttttaatttttttttttttttttttttttgagacggggtcttgctttgtcacccaggctggagtgcagtggcgcgatcttggctcactgcaagctccgcctcccgggttcacaccattctcctgcctcagcctcccgagtagcagggactaccggcacccgccaccacacccggctaattttttttgtgtgtttttagcagagacggggtttcaccgtgttagccaggatggtctccatctcctgacctcgtgacctgcctgcctcggcctctcaaagtgctggtattaggggcatgagccactgcgcccggccaccttgctctcctcttgtggatttgatttgctctcttttttctaccttttttgagttagaagtttagattattgtttttaaacctttcttgttttctaatgtgcatttcatttcattcattcattcatacattcattcagagacggagtcttgctctgttgcccaggctggagtgcagtggtacgatcttcgtttactgcaaccttcgcctcccaggttcaagcgattcttctgcctcaggctcccgagtagctgggactataggcgtgcaccaccacgccaggctgatttttgtatttttagtagagacggggttttaccatgttggccaggctggtctctaactcctgacctcgtgatccgcccaccttggccccccaaagtgccaccgctcccagccacatttctttcattattattattttttctttgctaacccctagtagtcattctaatgtacatttcttatataattaacattttcttctaagtactcctttagctgcagcatacaatttcgatgtgttcaattcaaatttctatttccattgtgatttttctggtccacaggtcatttagaagtttattgtttcttaatatttggggattttttagctattttcaattttacatggtgttcagggaatgcgttgttgacatattgtgtacatatctgtaccatatatctgtaaatgataagttgtttatcattttaatcctttgatagctactgagattagttttaaggcctaccctgtggtggtctgttttggtgaatgttacctgtgtctctaattccgctctgcaatattttgaggttttcagtgtagatattttatgtatcttttattaaatacggtgtatactgcagttattgaatttagtgttctataatttatcaattaggtcagatagttttatgtgtttgttactatataactgagatataattcagctactgtaaaatgcaccacttaaaaattgcacagctcagtagttttcagtatattcacaaggttgtacagccatcggcactatttaattccagaacgtttttgtcccccaaaatgaaaacccatacccgttagcagttactcttcatgtctccctaacctctaacccctggcaaccactaatctaccttgtccctacaaatttgcctattctgaacatttcctaagtggaatcatataatatttggccttttgtagctggcttttttttttaactaagtatgttttcaaagttcatacatgttgtagcgtgtatcagtatttcattctttcttatgactgaaataatatttcattgtatagatatgccccaatttatccatttatcacttgagagatatatgggttattttcacttttgggctgctatgaataatggtgctataaacattcatctacaagtttttgtggtgttctatttttctatttcccctaagggtagaattgctggggcatgtggtaattttatgtttactttttgagcaactgccaaactattttccaaagcggctgaatcactttataatttgcaacagcaatgtatgaagattccagtttctccacattcttgtcaatacttgttactgttctagtcttcgctgagaggctctgtgtgcttgttggagcacactttcagcactcaaccaggctttcagttcatccatagccttgacttcctgttttgccgagcttcatgctcagtcagtggtgattgcttagggccttctcaggtctttcttgagtatgcccataggcctgggcacactgttttcatcttccagggtcttaggaatttcagaacttttcaaaactccctatggacatctcattctcctacttttccttttgtgttttttggttagcttgtttgccccagctgcttcagggagctgaaatgttaagcaattgtagctgattgtttttgacaaataaataccttgggggaaaagcctgttagcaatgggcaagctctgaatcaggttaaatattaggaagtcttgggagtggggtttttcagggaattgctagtcagctcaaataataactgtactctgaaaatgggactttgaaggaactctagccctgttctgtcacctccactggctgctaggctccaggattccacagattgtggtttgctgcttttcagggctagcctggagctgggaagaggggcatgggaataaggcatgttaaaatgccacaaagcttgctattcttactgagatgcagccatctttttttgaataaatgctccttggattgttgcaaactttttggttaatattcagagttctgaaaaaggctatttttgactttttttttttttttttgagatgcagtcttgcattgtcgcccaggctgaagtgcaatggtgtaattttggctcactgcaacctctgcctcccaggttcaaacgattcccctgcttcagcctctggagtatctgggattataggcacctgccaccatgcccagctaatttttgtatttttagtagcgacggggtttcaccaggttggccaggctggtctcgaactcctgaccttgtgatctgcccgccttggccttccaaagtgctgggattacaggtgtgagccactatgcccggcccaagtcttgacatttttttgccagtgttcttgttggttttatggaagagaggatttttggaggtccttactctgccattcccaatgatgtcacccaatttgttttttaagcattaaaaaaaattattttaaaatataaagacagggtctcactatgtcaattaaaaagacagggtctcgcccaggctggtctcgaactcttgggctcaagtgattgtcctgccttggcctcccaaagtgctgagactacaggtgtgagccaccacacctggcctaaacatttttaatatatctgtttttatatcctgttcctcccttttcttttgaaatacaactcacagaaattgcaaaaatagtacagaaagttcctgtgcaccattcactcaacttcccccaatgatatatcttttataactatagtgtgttaccaaaaccaggaagctgatttcggtgttatacaatagtattaaattaactatagacgttattagaatttcacgggtttttgtatatactgtttttaattgaggaggtggtggtgtatagttctataaagttttatcatgtccagattcatgtagctattaccacattcagggtattaaactattctgttaccacaaagaaatttcttcatattatttctttatggttatgcttttctctgaaccctaacccctggcaactactgatctgatttccatcactgtaattttgtaacttcgagagtgttatataaatggaatcatatagtaggtaacccgtagatacggcttttttctcacttagcacaatgcctttgagatccgtttaagttgttgtgtgtgtcatagttcattcctttttattgtttctcttttatgggtgtaccatagtttgtttacctatttacttgttgaaggacatttattatgtttccagatttttaccatttttttttctttttctttcttttatttgttttttttgagacagagtcttgctctgtcacccaggctggagtgcagtgccgcgatcttggctcaccacaacctccgcctcccgggttcaagtgatttttctgcctcagcctcctgagtagctgggattacaggcgcacactaccacacccagctaatttttctgtttttagtagaagcaagttttcactatgttggtcaggctagtctcgaactcctgaccttgtgatccgcccgcctcggcctcccaaagtgctgggattacaggcgtgagccactgcacctggcccattttttttttttttcaaacagatatggttttgctctctctgtcactcaggccagagtgtattggcatgatcattgcacactacagtcctcctgggcttaaagaattctcccacctcagcttcctgaggaactaggagtagagacatgcacaactgcacccagctagtaattttaatttttgtagagatgaggtcttactatgttgcccaggctggtcttgagctctggcctcaagtgatcctcctacctcagcctcccaaagtgctgggattacaggtgtgagccaccatggctggcctagtgttttacaaataaatctgttaggaacatttgtgtacagatttctctgtgtacttaagtttttcttcctctgggataaatgctgtgtagtgtgattctttaatttttggtgtgtctgcctgttttactaattactgaaagaagggtgctaaactaagattatgtatttgcctatttcttttgtttctaagtttttaaaaaagtattttgaagccattttatttggtgtgtacatattttgtattgttacctttagcatttcttttcttgatgatttgacctattttcatgaaatccctttgtatctggtgatactctgtattttaaagcttaccttgtctgtgtcttaatatagccactgtatagtgtctatatagtgtcttaatatagccactgtaatttatgattagtgttttctttttttttcttttttttattatactttaagttttaaggtacatgtgcacaacatgcaggtttgttacatatgtatacatgtgccatgttggtgtgctgcacccattaactcgtcatttaacattaggtatatctcctaatgctatccctccctcctcccgcctccccccaccccagtgtgattagtgttttcatggtgtgtctttttgctaactttttattttcaaaacttctttgtctttataaaagtgtatcttgtgctaggcatgctggctcatgcctgtaatcctagaacctagggaggctgaggcagaagtatagcttgagcccaagagtttgagatgagcctgggcaacagagggagacccagtctctattaaaaagaaaaaaattaactgggtatggtggctatagtcccaacttattgggaggctgaggtgggagagcttgggaggttgagcctgcagtgagctgtgattgcaccactgccctccagcctgggcaacagaacaggagcctgtctcaaaaaaagaaagaaacaaaagatcagaacctataatcacagaatcactgaaaacccatggaattatcatatgctagccattgggaatacaaatgtaaatgagatttcaaaaaaatctttaccctttgttgtctaggtggttaagatcagttgattgagataaagttcaaagcaacccctaaaatcaactaaaaagttcatcaaaggacttttagaactgagcaggagggaatgaataaatctttgggagggagggatgcagtgccttgatatacagtaccaggagccattttctacattgttaacagcactcttgagtgatgttggtggcagcttgtatatcttatgtggaagcccttgggtaggagtcgatcaggaaaaacttcccaagacaggtagcatacagggaattttaaaaagatgaatgggagtttgccaggcaaaggaagcaggagaagaactttacaagcagagtcttattcaaagaacagtaaggcattatgattaaaatagtttgtatatattagaatggtgagaggtaaggttaaagaattactgaattttgattatcttagtgtgcacatttcttcccattttaacaactctgaaattggcatacatcttacaactgattgtgttttgcatcaccattggaaattgggattattttatgaataatggcatcttagatatgatgaaatatggtaagtttgagtagattcaatgtcctttaagttatgcttttggattttatcctattaataatcagaagctaggtagattttaagtagaaaaatattatgtctagaattgtttaaaataatatgattttggtgatattgtgcaggatttattgtggctaaaacaattgctaacaatgtagaaattcaggcaatgtctgcagagggcctagtgctagtgggtgtattgtgggaaatccaggtacaggaagcgtttgataaaaccaagatgatgtcgttactagtaagatggggctagttgacgtagagagaagagtcatataaagctgaggtttctggatttaaagagaagatgactggtgtaacagttaaaggcagtcattgttagtgtttattctggcatcataattaaatgtttctattactgagagggctaatcaacattcaaacattaatatatcaatagccaagaaaagattttctcaggaactcttactgtaaaatatatgtcagtataaaatttgttgactgtccaataaaataataattatagtgtaggtttatgttggctgcaagcctaaattatgagacatttataaaattactgaccgctcccccccccaaaaaaaaaagattgttcagaatctctcatcctagcatccattccaagaaaaagatattgctaacatttggaataaaaagtaatcccagtacgggttagtcatagtttttggctatagactaaacctcatcttgttcacattctagtagaacaagataaaaacaaatgcttattcatatagtatgttcatcatttaagaaggtcatagtatttactggcctggacactagtttatatgtgtttgtatttaagaaactagccattataatctcaattatgtgcagtgaaggagagagaaacgtgacatgagcaaagttttatttgcttttgaaaataattgtatcttttttacttaacttactatttcaagatatcttttatatgctactttatttaattaatttgtttttaagacagggtcttattctgtcacccagggctggagtgcaatggtgcaattacagcttactgcaacctcgaccttccaggcttaagcgatcctcccacctcagcctccctggtagctgggattatgggtgtgcaccaccatgcctggctcaattttttatatttttctttttctttctttctttctttctttctttttcttttctttcttttttttttttttttttttgaggtagtagcatactcatggctcactgtagcctcaacctcctgggctcaaggattcttccacctcagcttccctagtaactggggctataggcacatgccaccacacgcggctaatttttgtattttttgtagagatggagtctcgccatgttgcccaggctggtcttgaactcctgtgcagaggcaatgcgcccgcctcagcctcccaaagtgctgagattacaggtgtgagccactgtgcccagccaattttttgtagagatggagttttggcatgttgccctggctggccttgaactcctggactcaaaccatctacatgcctcagcctcccaaagtgctgggattacaggtgtgagccaccacgtccagcctgtgctaatttaaattattttctcctcactgctgtactagccacaacttctgcaaccagtttcatgtgggctttggacaattgcagcctaacagcatcactcatcagggtctatgttgcatacgttctcccttggggaactgtaatgttaagattaggctgggtgcggtggctcacacctgtaatcccagcactttgggaggccaaggagggcagatcacgaggtcaagagatggagaccatcctggccaacatggtaaaaccccatctctactaaaaatacagaaattagctgggcatagtggtgcgtgcctgtaatcccagctacttgggaggctgaggcaggagaatcgcttgaacctgggaggcggagtttgcagtgaaccgagattgcgctactgcattccagcctggtgacagagcgagattctgtctcaaaaaaaagaaaatgagcactaataatcttttctatattacagttttataataaaaatgcattacatattaaacagattcacaaagtgaactaatgacaatttacgtctgtccctatactttcagttgtaagtaactaaaaaccagcctcaaatggaaataaacaaaactaccgacatatgtaattgaaaagtccagatacctgggtgatgaaataacctgtacaacaaacccccatgacacaagtttacctatgtaacagacctgcacttgtacccctttacttaaaaaagcaaaacaaaacaacagaaaagttcagatggagtataggtttcaggtaaagctttattaggtggtccaacaacttcattaatgacctggtttctttcagttttcgcactctgctttctgtggtgttaaatttatcccaaggcagccacattgaagccattaggtttttaaggcttctagcaccttcttcatttatatctattagggaaaaatatgttctgtatctgagcatcatagaaaaaaatcttgggttcattctgattttcctggcttaggttacatgccagtctctgaactgattactaaggctagagaaatatattgtgctgattggcttaggtttgccccagggatcaattccacccaaattccattcttgagtgaggaaatttggggtaaaagagggaggatagcaaggaaaagatgacagacacacaattccagtttattataagaatgacttcaaatgaccttaactgaattgtaatattatttgggaacaagtcaaacattattaacatttaggcccagagatggtagatggcttgcttaagtctcccagcaagctacctcaagaactgagacttgggctgggcgtggtagctcacacctgtaatcccagcactttgggaggcccaaggcgggtggatcatttgaagccaggggttcgaaaccagcctggccaacatggtgaaaccccatttctactacaaatataaaaattagccaggcgtggtggtgggcacctgtaatcccagctactcagcaggctgaggaaggaattgcttgagcccatgaggcagaggttgcagtgagcagagatcatgccattgcactccagcctgggtgacagagagagactccgtctaaaaaaaaaaaaaagaaaaaaaaaaagaactgagactcagaagtgaattatttgactcttgaattgtacttcattcttagaatcaattattggcctctctgtaagactgtctttactgagtttttaaacggagtataataaactcttttgggaatgcggtagatgttcaaaggtttgacttcttaaaaagaggtgtaacaattatattccttaaaactgagaggggaccaattgagggtagagggattgatgtgggggcaggaggatacttttttgttgttattgtgatgaaaatgttccatagttttgtggttatatgactgtatacattgaactggatgcttacaaacggtgataaaaagggtgaaggaaaataaaaaaccaagtagcccaataacactgctcatccttgtttttttgttttgttttgttttttaaataacaagttctaggagtttttgtttgaataagaatatataaatcaggcagagtagtcccagtgaaatcatggttagattttactgtatttgtctgttgatccttcaccttctaagcacttaaaatacttttttattagacttgctttgatcacatatgcaatttaagtgtgaataagtaagtgtattatctttccctcctccactcagctttctttaaatagaaaagggacaaatatctctttattgcatattcagccatagttgctcaatctatggtgttaataagagactgtaattttatcttctaaaaatcattacagattataattataggctgtacctcattctcttaaagaaatattggcatgttagtccattgatattactgatagttgccaaatggtgagaatggtaactggtttggaggcaactgaaagggagggggaatcatcagtaaactggagaccaataaaaaattacacagaaacaaatctttttggataaactagatgaatgtctcttattgagactgatccaacagtattcactggcccatttcttgctgctagatgagcttctgtttaaggcatcacttgtggtggagttctttcttttatttggattggaaccatactgtgatctcttatggaaaacagacttcctccaagtctgttaaatataatttaaaattatatcgtttcttgttgatttgtttgtttttgttttgctttatttcatgttataggcatctgaaatgaatccttatatatataacatacaagtatatgtatgagaagacatgaatataagaagtataggaaacataagacatgaataaaagttttagctagacatttttagatgaaaagatgtgcatttaaatttgtaaaagttacaaatcgttctataaaaagttagcatatatttaaattttttggatacataataagagaattatatcacttctgatatccattgtgaagaccctaccacagtcatttttttgtgaagggtagatagggctcttgcttgtactcttccaggatgtgccacgggctccctaataacattcaggggagtgcatgtgcaggtttgttacatgggtatatcatatgatactgaagtttggttttgtaatgatccccatcgtctaagtagtgaacatagtaaccaataggtagtttttgagcccttgctttcctgtctccctccctgattttggaatctccagtgtcttttgtcccgacatctttgtgtctctgcgtacccagtgtttagcttccacttataagtgaaaacatgtgatatttggctttctgtttctatgttaattcacttaggataattcagctgcatccatattgctgtaaaggacatgatttcgttctttttttatggctgcatagtattccatggtgtatatgtattgaattttctttatccattctaccattgatgggcacctaagttgattccatgtctttgctattgtgaagagtgctgtaataaacatatccctttttggtagaatgattcattttttttcattttttttattttttaggcagagtctcgctctgtcgcccaggctggagcgcagtggcacgatctcgactcactgcaacctccacctcctgggttcaagtgattctcctgcatcagcctcctgagtagctgggactacaggtgctcgccactacacctggctaatttttgtattttttatacagatggggtttcaccttgttggtcaggatggtcttgatctgctgacctcatgatccacccacctcggcctcccaaagtgctgggattacaggtgtgaaccaccgtgcccagcctagaatgattcatttttctttgggtatatacccataatgagattgctgggtcggatggtaattatattttaagttttttgagagatctttaaacttcttttcacaggggctaacctaatttgcattcccatcagcagtttataagtattaccttttctctgcaaccttgacaccatctgtttttttttttttttttttttgactctttagtaatagttattctgggctgggcacagtggctcacacctgtaatcccagcattttgggaggctaaggcaggtggatgtgctgaggtcaggagttcgagaccagcctggccaacatggtgaaaccccatctctactaaaaatacaaaaattagccaggcatggtggcaggcacctttaatcccagctactcaggaggctgaggcaggagaatcacttgaacctgggaggtggaggttgcagtgagctgagattgcaccattgcactccggcctgggcgacaagagcgaaactccgtgtccaaaaaaaaaaaaaaaaaataggtattctcattggtgtgagatggtgtctcattgtagttttgatttgcatctttctctgataatcatctttttttctaaatgtctttatgctacctctaaaatgttctacgtataataggcaaatcaaatgtttaataaactggtgtgttaggtttattttcaggttgaaatgaagatagttatttttattttgtgtaccttttacatatcaacttacttttagaagtatttctaacttgtgttttgtgtttttttagagaaaatattctctttggaatgggaaatcctctgcttgacatctctgctgtagtggacaaagatttccttgataagtaagtattaaactcttcatatgcactatgtggaacttacatttgaagaagaatggatgaaaactttagaagtgaatttaccaccgaatgtcttcaattaaaggaaaactcaggaaatttaagtttggtgatagcaagtgtgctatcattaactattgaataactgagtacagttttccttgggaaaacttatatacattgctatttttacttaaaacttttttgcttattatttggaaggagaaaagtttatataatttacctaattatttaattccccaacttttaaactactgtcagtgagctacgtctataatggtatcataatctacagacattctaccccgaatgtgcccagtctggtttcctctcagaagctataatgggagaagaaagatgattagagaagacaagagaacgtgcaggatataattcagaggatatgaagctctgctgtttccgctttattagtaacttccaatgtttcaacttagctgagaaatcagtttgtttatttacctaagtatttgaggccatttcgtacaatagtccccacttgtgtccttgttttcagtttctgaggtctcagttacccataggacagtgtaataagacattttgagagagagacatgcaccacgtccacataacttttattacagtatattttaatagttgttctatttttagttagttgttgttaatctcttattgtgcctaatttataaatgaaactttatcatagtatgatgtgtaggtatgtatgtgtaggaaaaacagtgtgtgtgtgtttgtgtgtgtgtgtatatgtatgtatgtatgtatgtatgtatgtatgtatctatctatctatctatctatctatctatctatctatctatctatctatctatatatggttcagtactatccatggtttcagatacccactggtcatcttacaatgcatctacctcggataacgggggcactactatatggcaaatttaagtagtaaaaaagattaatgatgagaaagcaagatcccccctctcctcacacaccctgatttctgtacccaagagtaattactttttaaaaaattgaggcaaaatttatatcgcataaaattgatcgttttaaccattataaagtatacaattcagtgactgccagtatattcacaaagttgtacaaccatcaccactatctaattcaggacattttcatcaccccaaaatgaaatcccatacccagtaagtagtcattcgctattccctcctctaacccagtctcctgggaactactagtatacttagtttttctatgaatttgtctattctgagcattttatagaaatggaatcatataataatatatgatcttttgtgtttatatatatgaccttttgtgtttgggcttattttacttatgtaatgctttcaaggttcatccatgttgtagcatgtatcagtccttcattccttttaatagtggactattccattgtgtggatagaccacattttgtttatccattcattggttgatggacacttatgttgtttttattttttgtctattaggaacaatgcttcttatgaatattcatgtataagcttttgtgtaggaatgtgttttcatttctcttgggtatacacataggagtggaactgctgggtcacatggtaattctgtgtttaacttctagagaaaccaccaaactgttttccaaagcagctgcactgttttgcattcctaccggcagtgcataagtgttccagtttctctacgtctttgccaaagcttattttttattttttaaattatagccatatgagtgggtgtgaaatgatgtctcattgtgattttgatttgcatttttctattgaaaacttttgatgttagcatcttttcatatgcttattggatatttgtatatctttgggaaaatgttgaagctctttgcccattttttaattgggtcgttgtctttttgttaagttgtaaaagttctttttatattctggatactagaccctatcagctagcatatgatttgcaaacattttctcccattctggggatttactttaattttttgatagtatcctttgatgcacaaaagttttaaattttgatgatgtccattttatttttcttttgttgcttatgcttttgctgtcatatgtaagaatctattgttaaatccaggatcacaaagatttgtgcctgtgttttcttctaagagttttgtagtttaaggtcttagatttaggcatttgatcaattttgagttaatttttgtataaggtatgaaataagggttcaactttattcttttgtgtgtggaaatccaattgtctcaacatcatttgttgaagagactattcttttccccactgaatgatcttgatactcttgacaaaatcaggtgaccatagatatatgggtaaatttctggactccattctattccattgatacatatgtctgtccttatgccagtatgacattggtgtttttgtgtatgtgtgttttgttttttgttttttttttggagacagggtcttgctctgtcacccaggatggggtgcagtgatgcaatcatagctcactgaaaccttgaactcctgggttcaagtgatccttctatttcagcctcccaagtaactgagactatatgcaggtaccaccatccctagctattttaaatttttttttgtataaacagggtctccttatgatgcccaggctggtctcaaactcaagtctggcttgatcctaggcccaagttgtcttcccaccttggcctcccaaagtgctgggattataggcattagccaccatacctggcctgtacgacactgttttgattactgtagctttgtagtaaattttgaagtcaggaagtgtcagtcctccaactttgtttttcaagattattattattattattattaatttttaatttgagatccctcacaattccatatgaatttttggggatagctttttcatttctgtaaaaaaggcagttggaattttgattggaattacattgaatgtatagataaatacatgattaagtcttccgagttatgaagacagaatgtctttccatttatttaggtcttttttttttttttttttttttggagacagaatcttgctctgttgtccaggctggagtgcagtggcatgatctcagctcactgcaatctccatttcccgggttgaagcgattctactgcctcagcctcctgagtagctgggattacaggtgtgtgccatcatgcctggctaatttttgtatttttagtagagacagggtttcaccatgttggtcaggcttgtctcaaactcctgaccttgtgatccacccgtcttggcctcccaaagttatgggattataggtgtaagccactgtgcctagccttaggtctttttaaaataattttagcagtgtttagtaggttttcagtgcataagtcttatacttctttggttaaatttaattttattatttttgatgccattgtaaattgggattgttttattttcttattgttcattgatagtatgtagaaatataagtaattatgggggacaataatttttttgaaacttttttttatatcctggggattacccctgtaagtatatttggctaaactcaaatgtcaaagggtaaggcaagaatttataaatgtgtaaatttgacttacggtaatataataggaaatgtgctgggggtctaggataaactgggagatgtgttttatcctaagacattcagatagaaactttaaaacacactttcccagtcagaaaatactactatatacagttactttaatgattttagttcttttggttaccttgtacttttaaataatatactatacttacatttcttaaaatttctttttctgtcaaatttcaggctgggcgtggtggctcacgcctgtaattccagcacttttggaggctgaggcaggtgaatcacttgaggtcaggagttcaagtcatgccaacatggcaaaaccctgtgtctactaaaaataccaaaaattagccaggtgtgatggcacgcacctgtagtcccagttactcgggtggctgaggcaggagaattgcttgaacccgggaggcagaggttgcagtgagctgaaattgcaccattgcactccaacctgggtgacagagttgacactctgtctcaaaaaaaaaaaaaaaaaaaaaaaaaaaaattaaaccaagccaaaccacaccaaaacaaaaaaacccaaatttcaatggaatccattgacttctcattatggagaacgagattactggtgcccctattctttcctatgctacttcttctatctttctattctattaactgtgtttttaaggttgatgttttcattctgttatctatctataattgttttcccaactttgaatacaaattcataatgaaagttgaaaatgacttacccacattatcactctgtgtatcatttattgcagaattaagtagtgtaccaggaatgtagagcaggttaacatttgaaatgtaattagaagactgggcgtggtggctcacgcctgtaatcccagcactttgggaggctgaggtggatggatcacttgaggtcaggagtttgagaccagcctggccaatagggcaaaattccgtctctattaaaaatacaaaaattaactgggcatggtggtgtgtgcctgtaatcccagatactcgggaggctgaggcaggagaatcgggtgaacctgggaggcggaggttgcagtaagctgagattgcaccactgcactccagccagtgtgacagcctgagaatctgtctcaaaaaaaaaaaaaaaaaaaagaaatgtaattagagtaattcactatagtaagaaactaacataacagtctaagaaaactccatataattatctcaatagacaaagaaaaaccttttgacaaaatctaatatctattcctgatgaaaaaaaataacttaaagcaacctaggtaactatgtcgataactttcttaaccctataaaggttacgttaggggaaaactggtagtgtgatgcttatatgggtatataacgtatcaaattgtatactttaaatgtctacagtttattgtatgtcagttatatatcaaaggctgtaataaacagaaaataaaatcagttggacatgaattcatgggtttaaaattagatctcttttgtttgtgtagtgtgagatattttgttcaggaagtcaactaattcatggtcactattttaaaaaaatcatgatgtataaaagtaaagagcaacttaaaaatttgaaattttatcgtgtatttcaaaagtaaaataaagtatagagacaaacccataaatgtagaacattttatatgggaagcaagaattgaaatttgggatatacacacagaccaggtggtctttgctatgtctgaagaagaaagataagattggaagttttataaaaaggtgaaatgttttgtattgttttgaaagaaagctcattggcactagttttggggaggtggcaagctttgattggtgagtgactgcagtgagtagaactagtcttttagagtcacagctcattgtttcagtagctactggataaaactgttttcagatgacaacaggcagtttcagcagccaggcttgcagagaattaccttcttggagcaatgttatgtgtgctgagtgctcttccccccagcctgtcacctgttttagtcagatatgacaagaatgacccaatttatatgattagctttcacacatatataatcagtgttgttattttggtgaacatgcctccagatgtttgttaggcatatataacctgaagatgaatgtttatgggctaatactatgtgtagtctttgttagtatgctgtttttcactcaacattatgtttttggatcactgtttttaaaatttcaggcaaatgtgatcagagtgattatgacttggcagctgtgtgatgatgtcacaggatccttagggtgtcgcttttccagccagaagccactgtggttggtggagcctttgcctgaggtttgcttgtgcctgccaggcttgttctgcttgtttggcctggcaggctgcgttcggctcatgctaccagcctggatcccacacctgccaagggcgagccaggtgcagagtggcgtggcaaagagtgtgtgagcaagcgaatatgggatctggccactgtgtacagccactcatgctggctgctgtggtggggtgggcatctccaggcactggcacaggtgctggcttcatgcaagcttgcggctggatctgatgcatctcaagtggcttccactgtaggaacccacgtctggacgaggataatatggtggtgcccagaagcttggagacaccagaaaccacagagccccaaagagagtgtcacagccctggattgggaaccccctaggtctgggctctcagaagggctgcagctcttctttccttcttgttgcctgcaaggtgctgagtggggtgaggcatattttagctctgtttgtgttacagctgtttcagtcctgccacttggtgggtcttcttatcctgcatccatgaacagtgaggtatggggacaactggagggtgagcaaggtggagaggagcttcattgagcaacagaacagctctcaggagacccgaagtgggtagctcctttctgcaggcaggtcgtcctgacaagtgttcacctctcagtgagatgagaccccgagggggtaactcctttccacagttggtagtcccaggtctcttctgtaagtctggctgagtccagggtttttaatgggcttcacaagggagaagtgtgtgctgattggtccatgggcggctatgggtgggtctggaaaaagcaccatgagtctcactcccctcagtggaccccacctggaactgatagcctggcccccatgcttcaggctgtccctggcttgaaggcagggcttcacctgaacccaccccttttttcccaggagagtgtctgcctcctgctgccatcaatcatgttgtccacagtgtgcaggctgttggtgatgagggtacttgctggccccattgagctgccctcagtcccaccttggcctccttcccatgcttctctgcacctaaagtccagagggggctgagggggcagggggctggtatgtcagtgctgccccgagcacatgcacacctgctgggttgtgacagtgcctgggcttggccacgactttgctccaccctggagcaggtgctgggatcgaggagaggccaggcatgggaacaggcacttctgagtctgcaggggaaagggggacttcccgggccccagagagtgcagggatacctgggtccacagccatggctgggtggctgcagctgcactcaggagggtggggctccagccctgccaacttggaagtgggtgtggctcccacctgttcccagctcccatgggctctgtggagcatgcagccctggctgcatctccccaattgtagccagtgtctttgcagcagctgctctagacagcctgctgctgccatcaatgacgctgctgggagctcgagtaacttctttgttttacatgttttactagcagctggtcctaagtggctagctgaagttctattttatatttggaaggttttaatctttaactttgattttcaaataagtacttgaagataaaaaacaagtctttggaccctaacaataaaagagtcttctctattgttactcctggctatttcttccaaatatatttaaaaacttaccttatgatataaacgaatcgtgtttagcctacattttgagccaccattagataagtatttagataagtactatgtatatatatattttttatttttttatttttttattttttatttttgagttggagtcttgctctgtcacccaagctgcagtgcagtggcgcaatctcagctcactgcaacctctgcctcccaggttcaagcgatcctcttgcctcagcttcccgagtagctggaactacaggcatgtgccaccatgcccggctaatttttgcagttttagtagagacagggtttcaccatgttggccagggtggtctcgaactcctgacctctggtgatctgcccacctcggtctcccaaagtgctgggattacaggcatgagccaccgcacccagcatagataagtggtatattgctatggtttgaatgatggtatcctctccaaaaattcatgttgaaacttatccccagtgtagcagtataagaagtgtgactcttgggggttgaccaagttatgaaggctctgctcttatgaatggggttagcacacttgtgaaaggactcaaggttgaagggagagctctcctgcctttacattccttctgtcatgtgaggacacagtgttcctcccctctggaggatgcagcaacaaggttccatgttagaagcagagaaaagcctcgccagacaccaatcttgctggtgccttaaccgtggatttcccagcctccaggaatgtgagaaatatatttctattgtttacaaattaccccaaacaaaataagaaaaataaaacaacaacaaaacataagtaagtaaataaataaatagcctggtctgtggtatttttgttatagcagcacaaggggaccaagacatataccaaatgaatgagatatatactgattagtatcttacactgtgaaagtgagttctaattgtcaaaattcatttgataaaatatttttctgattctgatttttttttttttagagacaagtttttctgtttcccagactggagtgcagtagcacaatcatagcctagtcactcactgcagcctcaaactcctgtccctcccaccaaaaaaagaattgaaagttattaggaacacctgtggcagaaagtacattattgaaaagaatcttttctagtaaactgtagggacacagtgggcatgaggggataggaaatgtggaacatatgaatacctccagttgagccctggtctgtaattatggaggtatgtattaatagggatgaaaaaggcagggaaggaatgtgtaaggtaggtttgccttggtttttcctgacactagataaatatgaaagtaagaggaatgagagaatgaatgaaatggtaattgagaaaggaaaaccatcagtagaaatgaaaatactcagttttggctgggcgcggtggctcacacctgtaatcccagcactttgggaggccgaggtgaacggatcacctgaggtcaggagttagagaccagcctggctaacaaggtgaaaccccatctctattgaaaataaaaaattagctgggtgtggtggcacacgcctgcagtcccagctactcaggaggctgaggcaggagaatcgcttgaacccaggagcggaggttgcagtgaaccgagattgcgccactgcactccagcctgggcgacagagtgagactccatctcaggaaaaaaaaaaaaaaaaaaaaatagaaaatactcagttttatgacaggagtagttgaggagacgtgtttttcttacagatctaaacctttaataaacatacaaaccttacatgagtttttattaatctgagtatgcatgaaagatgttacttaatgttcaaacctaaaatgcccgaagtagctggctgtggtggtgcttgcctgtagtgccagctacttgggaggctttagctgtagtgcatcatgattatgcctgtgaatagccactgcactccatcctaggcaatatagtgagaccctgtctctaaaaattaaaaaaaggaaaatgctcaaagtaattggccataaattttagtgctgattattcagtgccaataatttacaactgaattatttctataaataaaaatttatttcttctacaaatgggtgtatgttagctttgaaagtgaaaaaaatatttagtgtcaagtgagactgcatgtgttaggttaaaagctagacatttaattgttttgctttaaaatgaattgtaaactgctctgacacttttgtagttaattttttttttctttgagatgaagtttcactgtcgctcaggctggagtgcagtggcatgatctcagctcactgcaacctctgcctcccgggttcaagctattcttatgcctcagtctcctgagtagctgagattacaggcatgtgccaccatgcctggctaatttttgtatttttaatacagacggggtttcaccatgttgaccaggctggtctttaactcctgacctcaagtgatccacccacctcagcctcccaaagtgctgggattacaggtgtgagctaccgtgcccggtcttttaattaattctttataaagctattgccatatttttttctacagctttcaacattatgttttgtatatttaggtctttaattgacctgaatattctgtctgggattttgtttagtatttatggattaatttggaaaaaagagatctttaccaacaaattttcttatccttacaaatatttctttctgtattttaggtattcttctattatcttttaataacatgtaaaatttaaatacatttaatatgggttacaaaatggttaggctgatttttttaaaaaacgtatacatcttatggtagtgatcatttgctaaatctgttagattcaaaaattctaaaagtaaatgctttttagaaaaaaattcagaccatgtagaagtcaataaagtacaaatgaaatctggggtcagtatctttgcagcagtgtgtgctgtccactagaatgtttcatgattatggaaatgttgtgtatctgtgctatccaacatggtaaccactagtcacatttggctttgatcatttgaagtgtggctagtgcaactgatgaatttcaacattttatttcatgttaattaaattttaatagatataattagcatatatgatattaaccagtacagcttaggtttattgtaaaattttacatttctttttatatgtttatattttttaaaggtatcttcaaaaaaagttgtatctattgtgtatatgatatatttttctacaacatattctagattattggtggtgtttggaaatgcttcttaagtttgaatattttctcttatttgactaccttgtgacctacattaacagatagtctttggttattctgcttctctccttcaaaattctaaattcttagaatttgaaataaactgctatttgaatctttatgtcatttcacatattgagtgattggtcctgagttgctctggggcttcctcaaaaaacaacctaaattatggatactaaatgaacacagactactttccttcattttgcccaaatagatgctgttctttgggttctttgatgttcaaacttaactttgaatattgaaggaaatggtacttctaaggataagtaaacatagattcttttttaacagttcatttcacagctcaacacacactttttggagcatatgttttatggttactcttttgccaaatactgggaatacaatattaaataactgttttgcctttaagcagcttgtaatctaattgaggagacagatgtggaaagaaatcacttacttcttcacagtggcattatagaatagaggttaagagtgtgctctggagctgtgtgaccttggttatctatggaagctcagtttccttgtgagtaaaataaggttattagggttcttgtgaggattgaatgagattatttgaatgtttggcatatgttagctaatattactggctactgagcttgaaatctctcgtgcctctattattggcaatggagagcacttgagagatttaagcaggcagatgacatggttggattcatattttaggattatgtgaattgctttgtctgtagtggatcaatagatttgaggaggctatagtgataaacctgttgcgagatgatgacttgatcactttagttatgatagaatggttgggaagagagtgcagtaatacttttcgtgttatcaaggtaagacttgattgatttaatgaagagggtaaaaggagttagagataacatttgaatttttggttttggtgactgatggtggtatttacaaatgagttagggagtataggaggaggatatggaagaggggcttgaaagattgaattgagttttgttcaagcttgagatgactatgatatccaggcaggcatattcaggagacagttggatttatgtttttggtgggtagaagagtcatggctggactccttttgtttctggagacagggtcttgctgtgttgcccagtctggagtgcagtgagtggtgctgtcatgcctccctgtagcctcccaggcttaagcgattctcttacctcagcctcccgagtagctgggactacaggcatgtgccctaccatgcccagctaattaaaaaaaaatttgttttttagagatgggtctcactatgttgcccaggctggtcttggaatcctctgacctcattctctcaaagtgctgggattacacatgtgagctacagtgccttgcctggactctttaattgtatttaattttacatagtttgacgcaatattattcaataaatggtagctattactagcactatttttattattatgtggctggtatttaaagcaaccagtagatgaaactttctaaaaaaaaagaaagagtaaaaagtaaaaggagtgggctggaagctagaacatttaatagatggatagataaagaatgagtatagaatgagattaagaaaaagcagaactaagacaagctctgatgaagtatgatgagtttatataagaatagtcaataatacctgatgcaacagagatatctagtaaagtaatgcctaaaagggtcccctgtatttgaatgggatgtcagtggcgccctctgccaggcaaatcacagtgcaaatatggagacagaagccagaaataaaatgtattagcaaataaatgggaggttgatataacatgggccggttttgctgatgtgacccaagagctaagcagtgatatcaatatcttccaattccaaattttaaaatgtcctttaataaaatatgtggctagtcattttgaacaattatcagtaaaatttttaaaataaaaagcataagaaaaattaagaatacaaagagtatagttctattttaggtatttaggtttaaatctagtttaattctttcagctttctctaattgagttttaatcctcgtttactttgctaatgagatttaaaaatattattttcataaaccttgtaactttttgcttttttattctaaccctgtgatttactcttaatctatttctttataagcttcttaaatttcagtccagctttagtctcaaacattgttgtagtgattaatggttttgcccccccattttcttcctttgtaatatattttaatcaacttttttttaaattggaagagccaattaaatatgttgtttaaaatcttgccatatccacactgtctacctgattggttttgccaattctgtaaaactttacttgatactgttgggattctttggactatgtggcaatatttgtagatttatagaaattttactgatttaattcttggaaggcaattttagttccaagtatttatagaatattttattgtcatctgctatgtaccaagtcttaacttgacattaactgtgcaacattaggcatggcacctctcttatgactgtcctatttcagaacttcacagtctgttcctgcgcctttcaaggcactaagctctgtgctatgctgatcttcagaggaggagcacatttgaataaaaagtgtttgtttcagtctcattaaaaggctcttataaaagttatgaacatttaaaagtgccctttcctccctttttgagctaattgaattcttcattttataggggtagaagattccaggaagagggggcagggatgagtatttatcataattgttaaataatgcgctggacactttttgtgtaatgttatttgatctggatagcaaccctgtgacataggcaggtttatcctcattagagaaattaagtggcttgcccagttcagaaaacaagttaatgtcagaatcaggatgatattgcaggttttttgatttgtatctagtgatttttttcactcagttgttctctttgtaggggctagaggcagaataaagaggccccttccctgtgctccctcttgcttccccgtcttctattctttggagtgtatgtcatttttctccagtaatttagggcagaaaaaaatgttgaggactaccactgtaccattttgttgtctctgatttttaggaactatgttcatggtaagaattgattataaaagaatacctatctatgccattagaaaacaaaacatccaaaatataggctgtgctttgcatcattctatgaaagccatggtgggaagttgggttatagctttctactaagttgaaagtaggctctgtcgcctaggttggagtgcagtggcacaatcttggctcacttacaacctccatctcccaggttcaagtgattctcctgcctcagcctccccagtagctgggaccacaggcgcctgccaccacgcctggctaatttttgtatttttagtagagatggggttttgctgatggggtttcgctgtgttggccaggctggtctcaaactcctgacctcaagtgatctgcctgccttggcctcccaaagtgctgggattataagcatgagccactgcgcccagctaatgatttttaataactttatataatactgataaatcactcttttttttttttttttttaagacagagtcttgctctgtcacccaggctagagtgcagtggctcgatctcggctcactgcaagctctgcctcctgggttcaccccattctcctgcctcagcctcccaagcagctgggactacaatgcctggctaatttttttgtattttttttagtagagacggggtttcaccatgttaaccaggatggtctcgatctcctgaccttgtgatccgcccgtctcggcctcccaaagtgctgggattacaggcgtgagccaccgcgcctggcctaaatcactctttttagtggactctaaataccactgtgatttgataccccttttattcatttataaaaatacataaacagcttccttttttgatgtttaaaaattttatagtcctttctgtcttgaatttgcatttctgttatacttttcacaccagattctattcttatatgatgtattttatgcataagttatattttgcctgtaacatgcatacattatgaaggtagtatatttttatgcattacagtctttcatgcatattgattaccctattatatgtctttgcagccagccaaaatgtgtaaattttaaaatatctcttagtcattaaattgtaattagcacacggtaaaataacaaatgtattaaaatgttgctaaattattttttatttattaaaaaaattttttttctccttctctgccttcaaaatgttgcttctctgccttcaaaatgttggtacattattaaacagaagaaaataggccaggtgcagtggctcgcacctgtaatcctagtactttgggaggacaaggtgggcggatcacttgaggtgaggagttggtgaccagcctggccaacgtggtgaaacttcgtttctacttaaaatacgaaaattagccgggcgtgggggtgcatgcctgtagtcccagctattttggggactgaggcacgagaattgcttgaacccagcaggcagaggttgcggtgagccacaatcatgccactgtacttcagcctgggtgacagagtgaaactctgtctcaaaaaaaaaaataaaaaaaaaaaagtttcacagacaaaatatgaatcattccttgtttaacacttaaaaggtttttatactcaggcaatagaatagtgtatagtttcattcacaataggtgaggagtatgtcatcctttttatattaataaaaagtgagaggagcccagatggccgaataggaacagctccggtctacagctcccagcgtgagcgatgcagaagacgggtgatttctgcatttccatctgaggtactgggttcatctcactagagagtgccagacagtgggcgcaggtcagtgcgtgcagcgcaccgtgcatgagccgaagcagggcgaggcattgcctcactcgggaagcacaaggggtcagggagttccctttcctagtcaaagaaaggggtgacagatggcacctggaaaatcgggtcattcccacccgaatactgcacttttccgacgggcttaaaaaacggcacaccaggagattatatcctgcacctggctcggagggtcctacgcccacggagtcttgctgattgctagcacagcagtctcagatcaaactgcaaggcggcagcgaggctgggagaggggcgcccgccattgcccaggcttgcttagctaaacaaagcagccgggaagctccaactgggtggagcccaccacagctcaaggaggccttcctgcctctgtaggttgcacctctgggggcagggcacagacaaacaaaaagacagcagtaacctctgcagacttatatgtccctgtctgacagctttgaagagagcagtggttctcccagcacgcagctggagatctgagaacgggcagactgcctcctcaagtgggtccctgacccctgacccctgagcagcctaactgggaggcaccccccagtaggagcagactgacaactcacatggccgggtactcctctgagacaaaacttccagaggaacgatcagacagcagcattcgcggttcacgaaaaaccactgttctgcagccaccgctgctgatacccaggcaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctaaaaagcagagcacctctcctcctccaaaggatcgcagttcctcaccagcaatggaacaaagctggacggagaatgactttgacgagttgaaagaagaaggcttcagacgatcaaactacgagctacgggaggaaattcaaaccaaaggcaaagaagttaaaaactttgaaaaaaatttaaacgaatgtataactagaataaccaatacagagaagtgcttaaaggagctgatggagctgaaagccaaggcccgagaactacgtgaagaatgcagaagcctcaggagccgatgtgatcaactggaagaaagggtatcagcaatggaagatgaaatgagtgaaatgaagcgagaagggaagtttagagaaaaaagaataaaaagaaacaatcaaagcttccaagaaatatgggactatgtgaaaagaccaaatctacgtctgattggtgtacctgaaagtgacggggagaatggaaccaagttggaaaacactctgcaggatattatccaggagaacttctgcaatctagcaaggcagccaacattcagattcaggaaatacagagaacgccacaaagatactccttgagaagaccaacaccaagacacataattgtcagattcaccaaagttgaaatgaaggaaaaaatgttaagggcagccagagagaaaggtcgggttacccacaaagggaagcccatcagactaacagcggatctctcggcaaaaactctacaagccagaagagagtgggggccaatattcaacattcttaaagaaaagaattttcaacacagaatttcatatccagccgaactaagcttcataagtgaaggagaaataaaatactttacagacaagcaaatgctaagagattttgtcaccaccaggcctgccctaaaagagctcctgaaggaagcactaaacaaggaaaggaacaaccggtaccagctgctgcaaaatcatgccaaaatgtaaagaccatcaagactaggaagaaactgcatcaactaacgagcaaaataaccagctaacatcataatgacaggttcaaattcacacataacaatattaactttaaatgtaaatggactaaatgctccaattaaaagacacagactggcaaattggataaagagtcaagacccatcagtgtgttgtattcaggaaactcatctcacatgcagagacacacataggctcaaaataaaaggatggaggaagatctaccaagcgaatggaaaacaaaaaaaggcagggcttgcaatcctagtctctgataaaacagactttaaaccaacaaagatcaaaagagacaaagaaggccattacataatggtaaagggatcaattcaacaagaagagctaactatcctaaatatatatgcacccaatacagaagcacccagattcataaagcaagtcctgagtgacctacaaagagacttagactcccacacattaataatgggagactttaacaccccactatcaacattagacagatcaatgagacagaaagtcaacaaggatacccaggaattgaactcagctctgcaccaagcagacctaatagacatctacagaactctccaccgcaaatcaatagaatatacatttttttcagcaccacaccacacctattccaaaattgaacacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacacattcaaaatagtgtgtagagggaaatttatagcactaaatgcccacaagagaaagcaggaaagatccaaaatttacaccctaacatcacaattaaaagaactagaaaagcaagagcaaacacattcaaaagctagcagaaggcaagaaataactaaaatcagagcagaactgaaggaaatagagacacaaaaaaccgttcaaaaaattaatgaatccaggagctggttttttgaaaggatcaacaaaattgatagaccactagcaagactaataaagaaaaaaagaaagaagaatcaaatagacgcaataaaaaatgataaaggggatatcaccactgatcccacagaaatacaaactaccatcagagaatactacaaatacctctacgcaaataaagtagaaaatctagaagaaatggataaattccttgatacatacaccctcccaagactaaaccaggaagaagttgaatctctgaacagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatacccttgatgaacattaatgcaaaaatcctcaataaaatactggcaaaccgaatccagcagcacatcaaaaagcttatccaccatgatcaagtgggcttcatccctggatgcaaggctggttcaacatacgcaaatcaataaatgtaatccagcatataaacagaaccaaaaacaaaaaccacatgattatctcagtagatgcagaaaaggcctttaacaaaatttaacaacccttcatgctaaaaattctcaataaattaggtattgatgggacatatctcaaaataataagagctatctatgacaaacccatagccagtatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcatttttatacaccaataacagacaaacagagagccaaatcatgagtgaactcccattcacaattgcttcaaagagaataaaatacctaggaatccaccttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttagagatttaatgccatccccatcaagctaccaatgagtttcttcacagaattggaaaaaactactttaaagttcatatggaaccaaaaaagagctcacatcgccaagtcaatcttaagccaaaagaacaaagctggaggcatcacgctacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctagccatatggagaaagctgaaactggatcccttccttacaccttatacaaaaatcaattcaagatggattaaagacttaaacgttagacctaaaaccataaaaaccctagaggaaaacctaggcattactattcaggacataggcatgggcaaggacttcatgactaaaacaccaaaagcaatggcaacaaaagccaaaattgacgaattaaactaaagagcttctgcacagcaaaagaaactaccatcagagtgaacaggcaacccacaaaatgggagaaaatttttgcaacctactcatctgacaaagggctaatatccagaatctacaatgaactcaaacaaatttacaagaaaaaacaaacaaccccatcaaaaagtgggtgaaggacatgaacagacacttctcaaaagaagacatttatgcagccaagaaacacatgaaaaaatgctcaccatcactggccatcagagaaatgcaaatcaaaaccacagtgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtgtatacccaaaggactataaatcatgctgctataaagacacatgcacacgtttgtttattgcggcgctattaacaatagcaaagacttggaaccaacccaaatgtccaacaatgatagactggattaagaaaatgtggcacatatacactatggaatactatgcagccataaaaaatgatgagtttatgtcctttttagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaggggggagcgatagcattgggagatatacctaatgctagatgacgagttagtgggtgcagcacaccagcatgtcacatgcatacatatgcaactaacctgcacaatgtgcacatgtaccctaaaacttaaagtataataataaaaaaataaaaataaataaaaagtgaattttaggccattttctgttacttagaatacctgaaactgggtattttataagaaaaggaatttatttcttacagttatggaggttgagaagtccaaggtcaaagggctgcacttggtgagaaccttcttgctgatagtgactctacagattcctgaggtggtgcagggtatcacatggcaaggggcctgaacctgctaatggtagctcaggtctcttctcttcttttaaagccaccagctcccctcccatgataacccattaatccatgaatggattaatccatttatgaaggtggagctctcatgatccaattacttcttaaaggccccagctctcaatattgccccgttggggattaaatttcaacatgagatttgaggggggtcaaatattcaaaccatagcagtgggtttaaaggtacttgtgaaagaggagaccagagaggaaaatcaacatgacctttcaaatggacctatgatccattttcaggcagattaattttaaattttatgaaagggttgagtatgaatgagaattgaagacctgggaattgttgtccattgttgtttatctatttctgtgtacccttcagaaagtctgtttaccttcagcagtacaaatatatggtactgtgaaagatccctgatctagtatttatagcaacctgtattttatgaccagagaaactgagacttaaagatgtagagtacttgcctatggtcacttagctagtaaatggtcaatcaaaaactccaaaacttgaggccgggtacggtgactcatgccagtaatcccagcaatttgggaggctgaggtggttggatcacttgtggtcaggagttccagagcagcctggccaacatgttaaaaccccttctctactaaaaatacaaaaattagccaggcatggtggtgcgtgcctgtaatcccagcttctggggaggctgagacaggagaatcgcttgaacaggttgcactgagtcaagatcgtgccactgcactccagccttggtgacagagtgagactctatctcaacaaataaacaaacaaacaaaaaacacacaaaccctccaaagcttttctttccctcctgtgtcatgctacttagtacatagcctggttcacagtatatgattactatatatttaatgaatgatttacatattatttgtgaagtccaaaatacttaacgttgtagttgttccatcagttttgaactgctgaataagtgtgacattacagatgattcactacagaagaatattgaagatcttcaaagcattgttaaggtgatctcctttcagttcctggagtggtgttcctggaaatgactaatagaacagcaaaaaaccgtctacttgggcattcttggtgttttatcaattaagtcagagacctataacagtgttggagtgcttgttttgaagaggtcagctaacttacgttgacactgtgtgtgtatgaagagtgtaattttcgtttctgttatacaggtattctctgaaaccaaatgaccaaatcttggctgaagacaaacacaaggaactgtaagtgcattaaaccattggttgtaaatagtttactctgtctatgaacttgatatatgtatatgtaaattatctgattttcaaaattatataatgacaaagtataattaacactatgaccttaatcctaacaattatgataacctacactatataatttacactacataaagtttacacaggacataatttctcctgtattcacattaaaagatgtagtgttgtattccatcatctagactaaagtcttactgggaaatatgtcatgctattttctctttccagataaaatattaaattgttcctattttctttctgactgctctaccagaaaaaagtaaaaaataaaaataaattgtcactcttaatttttgggtcttactccggtggatcacccaccttcatggtaatgatagacaaatataattttgtttctgtcactggtttatgcaaaagtaaatgtcaattgtttggtacaaggtaaaacactttattttatttttatttttttgaaacagagtcttgttctgctgcccaggctggaggcgcaatctcggctcattgcaacctctcattcctgggttcaagcaattcccctgccttagcctcccaggtagctgggattacaggtgcccgccaccatgcctggctaaattttgtattttaagtagagatggggttttgccatgttggccaggctggtctcagactcctgacctcaggtgatctgcctgccttggcctcccaaagtgctgggattacaggtgtgagccactatgcctggctgaagacattttattttcacatctaactcaggtcgctcttggtttagtttaatgtaaccttcacttgtactcatttatagggacagtaattttttttcgtagaggacttcaagactattattttcttcttgagattaagtaataatttttttccaagtacttttaaactgctttttaaaaactgtcttgaaccttttgtaaattattttcttctctcctatttaaggtaacataaattgttaattataaaatggcaggaccaatgttcagggaaaggattttcttatgcgttcttaccgtttacacattccactattatgctaacctttcatcagtatttttatatttggcctatccttatttgagtataatctccatagtgggttctcaaatatatatattgtcaagaaatttttttgctctttctttatttcctagtatagtcagtgagggccggtgattgttactgtagcattggttggttattatttataggtctggtaacagagcttcttttgctttgggaattaagtagttggtgagccttaaaagttcctttagtccttagactatgaccaatattaaaaataccagaaatctgcttttaaagaatatgttatttaatatgtaacccattttaatgttttaattcatttgaaagtttttttaactgtccaagatataattcatctctatgggtataacttggcgaactgatacttttttcttacctttttttttgtttttttgagacagactcttgctccgtcacctaggctggagtgtggtggcatgatcttggctcactgcaacctctgcttcctgggttcaagcgattctcctgcctcagcgtcctgagtagcagggattacaggcacccgccaccatgcccagctaatttttatattttagtagagatggggtttcgccatgttggccaggctggtcttgaattcctgacctcaagcgatccacccacctcagcctcccaaagtgctgggattatcacaggcttgagccaccgtgcccagcccctacattttattacgaaaagttttaaacatatgttatgtgttcacccatatatttaccaccaaggttttatcattaacatattactgcacttgttttatctatttattcttctgttcgtgcattacttcatctgttttttggatgcatttcgaagtaaattgtagacatcaatatgcttctctctaaatatttcaacacatataccattaactagagttttatatttcaaagttttttttttttagtttcacctgttctaaaatttcttataaactgagtcatatatatgtcctattttgtataaggcttctgtcactccctgtgtttttgaaattcatcagtgttgttgcatatatcagttaattccttttcatttttgcagattaacattctgttgtttatttgttctattattgctaagtattgccacttgtttgatttgtcattattgatggtcttgatatttttggctgctggctctcttccttgtagtttttgacctacataccaaagaaaactttcagttgaatatggcaccataaaagcagagtattaattttaaaaaattaaaacagttattgaattaatgaatttcatgaattatgaaagctgtttataaataatctcatttgtgtctttgcaactcaaatagccaaaatcttggtagggtggtggtcatggaagtcagagtctgctaaggagtgtataacaactcacctgctgtattaaaaacaaaaaaatctttttgtgttcaagactaagctttaaacaatataagagatatggatataaaacaaaattttatctaatcagtaattccatgctttattctcataaaacattattacaacttcttaatttcagtctgttaaagcttgattaattataaaattgtaaaaatgtgttggcaccatcacattgacctgctctttgaaaattaaccctaattctataagagtaccaataagagagtacagtgatagctctaattatcttgatattaataaataaagagtggcctggcatggtggttcacatgtgtaatcccaacactttgagaggctgaggtggaaggattgcttgaggccagcagtacaagaccagcctgggaaacatagtgagaccccatctctacgaaaaacttaaaaaaggccgggcacggtggctcacgcctgtaatcccagcactttgggaggccgaggtgggtggatcacctgaggtcaggagttcaagaccagcctggccaagatggtgaaaccctgtctctactaaaaatacaaaaattagccaggcatggttgtgggtgcctgtaatcccagctactcaggaggctgaggcaggagaattgcttgaatctgggaggaaaagttgcagtgagccaagatcacgctactgcactccagcctgggtgacagggcgagactctgtctcaaaaaaaagaaaaaaaaattagcctgatgaggtggtgtgtgcctgcagtcccagctgctcaggaagctgaggcaggtagatctcttgggcctaggagatcaaggctgcagtgaaccatgatcattccactgagctctggactggacagcagagtgagaccttgcctttaaaaaaataaaaaaagaataccaataagagagtacaatgatagttctaattatcttgatattaatgaatattaagtatgttttcattaaaacatttttagttcctgaaattttgtgattcagatttcatatacacttagtcactgatgcttcacgagtatacttgtttctctgtctgaggaagattggcatgggaaaacagggaaatattggtcagcagtgacacttgtttttctaagcaaagtggtttttctcaacttcctgtttttcattattctacatactgaagaccttgggggatgattttaagtagagaaagctgagcaattcaagttgtgatgtgatttatctaaaactataggatttatagtttgttctatacatgatccagtaatcaactggtttcattagctttctagtttttttcagttttagttttgtaaatggaataatttaaaataaattaggaaaacatcactattttactaagtattttttcacctactttccattgtgctaggcattaaagaaaagatagtgtgcagctttttatatgtcaattatacttcaataaagcggtttaagaaaaagtaaaagatactgattttatttataaatggaatcttactctccaatagtggcttttcaaaatctttggacacatctgcagttattgaaaatagaaccattttgtttccatgaatatctattttatgaatatataaattttgtattaccttggattatgagatctgatcatatagatttaggtaaggaaagttaaaagttgtctggagttaggggtgaattccaaatgcaaatataaataaattcagaagtatccatactacttaacacagagtaacctggtatctgaagattttttttttgtttgctataaggcaaggggaaaatctctttaaaagggattcacatttatttacttggctttttaagatagctaccaaggtaaacagtgaacttttgtaagcagtgtatactgttctaaatatgaagtgtattttcccttctgatagtgaatgaattccattatgattttttaatgtcaaaaattaaattattttgtcagaataaccccttaaatttttaaatgttgtcttataaaagttaattatattgtgatatttaaatgcttgccaatttacgattatgatgagatggaagaaaataaataaattatgcaataggcatgaaccttcaagggtattaggacgtgctcaggatatgatctttggtgcagtgtaaaaatgtaatttcttagtgaataggtcaatttccaaaccagcaggaaagttataagtatttaaatggaatgtgtagggatatgtcagggaagttagagacaataacatctggtatgctttttttttttttttttttttggtgagatggagtctcgctctgtcgcccaggctggagtgcagtggcgtgatctcggctcactgcaagctccgcctcctgggttcacgccattctcctgcctcagcctccagagtagctgggactacaggcgcccaccaccacgcccggctaattttttgtattcctagtagagaaagggttttgccgtgttagccaggatggtcttgatctcctgacctcgtgatctgcccgtcttggcctcccaaagtgctgggattacgggcgtgagccaccgcgcccggtctggtatgctcttaaattaattgttaatgctgtgacttagcagttctttgaaatcatcaagatcatagactgggcttgtgcctataatcccagcactttgggaggctgaggcaggaggattgcttgagtctacgagttggagaccagcctggacaatatagtgagactcttgtctctacaaaaagttaacaaaagtagccggatgtggtggtgcctgcctgtagtcccagctacttgggagactgaggtgggaggattgcttgagaccaggaggtccaggctgcagtgagctatgatccgtgccactgtgctccagcctgggtgacagaatgagaccctgttaaaagaatcttttttttttttttttttggtaagaatgagctaagaactggatatctgtaaagctaatagaaaaaaatcctgtgaagcaaaaagtcaaaattgaaataagctaggaccgacagcaaggttaaatgcttatttttttttagtgttcataaataaggtacagttttaaaaatatcataaacatttttatgatcctattctcagggcccggttttttttgtatctttaaaattatagtattttgattctagaaatgaacccttgaaccaatatccgtattttatcatgaataaggtgagagtaacattgataaaatgacttgctatagtttacattgctacttaaggacagtactagaccagaaaccaagtctcctgagtcccatttaagtgctgtttttgtcacaccaagcagttctctaagtatatagtcttttttttttttttgaaacagggtctcgctttgtcacccaggctagaaaacagttgcatgatcatggctcactacagtcttgtttttagagatgaggtctccttatgttgctcaggttggtctcaaactcctgacctcaagcagtcctcctgcctctgctcccaaagtgttatgattacaggcatgatctactgcacccagccagtaacttttttttttttttttgagacggagtctcactctgttgccaggctggagtacagtggcgcgatcttggctcactgcaatctccgcctcccaggttcaagtgattcccctgcctcagcctcctgagtagctgggactacaggtgcctgccaccacgtctggctaatttttatatttttagtagagacagggtttcaccatattggtcaggctggtctcaaactcctgacctcaggtgatccgcctgcctcagcctcccaaagtgctgggattataggcgtgagccaccgcgcctggccgccagtaatttttttttttaaagggattaatatccattgcaagacttggtaacggatcacagagaactcattagttaattaaatcagtttcacagtattgtgttttggttttggaaatcacttcagacctataaccaatattgagtgagttgaaaagaattaattacttccaaatacaaggcactttacattcttctaaggagaggatgcaacacaaagctatttggtcagcttgatacaaaagctcttaggtgtgctcatgaagtaagtcaaatgtatacattttacaaccacatattaaatagaattagttttttctttttccttcccatttctttgaacagtcttattcagaatcttcatcattagcaactttgtcatcattggagcccttttctctagaacacatcagcctctttctatgtatgatattttcgctggaaattttatcctgagctataaatgcctctcatgtaagaaaagttttttttttgttttttttttgagacaagatctaactctgttgcccaggttggagtgcagtggcgtgatcatgactcactgcagccttgaccttgtgggcttaagcaatcctcccatcagcctcctgagtatctgggactaccactgtgcaccaccacacctggctaatttttgtattttttgttgagatggggtcttgccatgttgtccaggctggtcttgagctcctgggctcaagtgatatgtctgccttggcctcccaaagggctgggattacaggtgtgagccaccatgcctggccaagaaaagttttttttaaagtttatttttgtatgtagtcataatacttgtaaggtaaccttttcactgtattgctttttaaactaaggtttaaatagttcattgtaataagagttaccgtttgtgcttataaggctgcatctccaggagtaagtactaaatctgtgttagatttctttgctgcttttttttgtttgtctttttttttttcttttactgatatggtcaggtggtcaggttacttccgtaaggatccaaaactagagttgattgagatcatttcaggcttatacataatctacaaatgattctcaaccaattgagatctgagttcacctcttttgctgaacttttaattgtgatcttactgtaaaattctaggatctcataacttctatgaaatttttatacctggattataaaacttcggaaagatttgcttaaatattttgttgcttaaaagaaaataattggccgagtgtggtagctcacgcctgtagtcccagcattttgggaggctgaggcaggtagatcagttgagctcaggagtttgaaaccagccttggcaacgtggcgaaaccctgtctctactaaaagtataaaaaaaattagctgggcatggtggcactcacctgcagtcccagctactcaggaggctgaggtgagaggattgcttgagcccaggaagttgaggctgcagtgagcaaagattgcacaactgcactccagcctgggcaatagagtgagaacccgtctcaaaaaacaaacaaacaacccccccgcaccccccccccccaaaaaaaaacaaacagaaaataattaacactgtcatcaaggaaggtaactcattataaggatttaaaaaaaaaatttttttttgagacggagtcttgctctgtcacccaggctgaagtgcagtggcacaatcttagctcactgcaagctccacctcccgggttcacgccattctcctgcctcagcttcccaagtagctgggactataggcgcacgccgccacacccggctgatttttctatttttagtagaggcagggtttcactgtgttggtgaggctagtctcgaactcctgacctcgtgatccacccgccttgccctcccaaagtgctgagattacaggcgtaagccaccgcgtctggcctataaggaataattttgtgattaaacatggtcttatattcatgaacgataggtgaatgaaaaatgtgtgttattggtggtaaaatcttaaaatccttaaagaattaatttaaattgctaccttctacttatgaagcactatatggtgccctggacttagcattagaagaaacttagtttatgtatgagttttgccataggctgtagtcttggggtattagttagaattcaatgccactatgatattaagaaatttattacaggaattaaatcttattcaatcatgagaaaaactggggatattaaggtccctaaaatgtgagagaaaaatcgctaaactgccttttgatgtaggttaatgaattgcgtgttctgttaatagggaaactgtgaaggaggttcgtgtgttgtgggctctttgcaactaccacctttatgggcctttagtgaaaaatctggtgataggcttggtcctggtagttgtggacgtaaggtagagtggggatgagtaaggacagattacagttctgcccatacctttgtgtctgtccttcctgcctctaaccaatgactgcctttggaatgtaatggctactgcttcaattgcatcccctaaattttttgcaaatttctcttgtgacatatcttaagctgaaaccatataggagaggaaattaggggaagtgtactccttcttgacatagtttaataccttaactttgtttaatcacttagtcttccaaacttaagttcctccgatatcattttgggtttagattagtgcttttctgtcattgtccattaaacaaatgatttctttcattacctacttctcttttagtctgttcagtgatccctctgggtatagcttctgaatttctagcataaaactcttcaacaataacaaaaaaggataatgatctttcctgtcaatttttagggggaaggataaggtgtttcctagaaactttattcagagcactttagtcaaagtgtagttcattgatccttaactgcaatttacttgacaagatatatttatgggatgaaatttattgagggtaacagaatggagagagaaactgctggtgtgatgaattctctttcttcttggtctacaacaaacagaaatattttgagaatgtagctatggcagattttaatgtaagagttatgccaacactatttccccttaagggttgagtcagaccttttgggaatgatatagacttgggggtcttgagtgaacttttagtatttattagcagccaatctaaccttgaaaactctatgttgatttctttttggaaagtgttgaacaattaaataatacatgttaaagaacaaggaagaagggcattgttttaattattttgtgatctaatttaatccccacagcaactctgtgaagcagatattgtaatcattcccattttacagatgaggaagagacttcgtaacttggtttatataagaaaaggatagaactgtttagatctttttgattgctttccattttgtataagttcagtgacttaggaaccttttttaaaaaacttctttggaggagtgatattgttcattatgaacatacctacttgaaaagtatttaaaggtatttttcatggaaattatattttataagttttagtatggttcactagaaatacgtcacaatttgtaggtaatactgtgttttattttgagttggctaattgttaaggtaaaactttagaggataaagtgagctcatattgatgaatggtaatctgatatttccaacagactaggtctttttttgaagttcatgtattataactttattctttgtgatactagctccctctgtagaacttcaataagattgcaactggactttttcaataatttagaaaagtgatctaaacattatctataacatttccctgtaaaattttactttgtattctaatcagttgcaagtgggtttttaaaagtataaatgtaacatttataaaaatgtttcactttgtacacacaaagttttaataacatatacaaaataaaactttcttcaaacattcctataactttaatgcttttttatttaggaaggctagagagaggtgtgatttctaggtctgtaggtctgtgttgagtaaagcctgatggaagccctaggggaaaaataaattttgacgtttagctggatacttgaaattatcccttttttttttttttttctgaaactttccggtttgacttgggtgggaaaatgttcataagggattttttttttttatcttgtagagaaggggaaagcaaacttctacaacaggtagaaagagcaaagagaaaatcttagcaagatccagaaatttagtggagaattgcaggaaaacattcttgacatttacggtttaaaaaaattttcctttttctttttttcttaagaggtggtctcactctgtcgcctagactggagttgagtggcatgatcatagtgatcgttccacctcagcctcctaagtagctgggactacaggtatgtgccaccacgcctggctcctttttgtatttttagtagagatggggttttgccatgttgcccaggctggtcttgagctcctggactcaagtggtctgcctacctcagcctcccaaagtgttaggattacgggcgtgagccactgcaccctgctcacatatatgagttctatgagtttatgctgttgttggaaaatcctttgttatcaaagtctaccaattttcctgtgtgggagtgagcttacttattttaccaccactttttctcctttctttctgctatggtttgaatgtttgtcccctccaaaactaatgttgaaatttaattgccattgtaacagtaataagaggtggaggcctttaagaggtgattagatcatggggctctaccttcatgagtgcattaatgcaggagtgggttagttatctcttagagggttgttataaagtgagtctggcccctcaagcacttgcttgctgtttgccttctgccatgggataatgcagcaagaagttgctgagcagaagctggcaccatactctaggacttcccagccttcagaactgagaaacatattaatgtttctttcctttataaattacccaatctcaggtttctgttaaaagccgtagcaatcaaactaagacactcccctaaaccattttatattaaattgtaagttgtataattagctcttcaaagatgttttctcagacataatgtaagctcaatgaaggcagaggaaatatgattgacttgcaacatggaatttagaaaaatgagcgaactgatttcaaccataaagctagggactaaaacatacaaatgaggataagaaagaactgaagtacatatgctctttcagtttctaaaaatttaactgtattttcttctaagtagattgaaggatgttcttaggattatgcttgagtaggcttttaaacaattttgtgtggataattatctttgaagcctttgttagtactaaacatctttattctgttataatacagtttattcaaacagacgtacagtgtgtattgtggcacaaagaaattcaagaatgattcttattctttttgtttgttggccttgactaaatttgataccagataattgctttaaaggataggccaattttattggtataacaaatctacccttcattatccataaaccacttatatagtaatctggttttcctatacaggcacaccttggagatattgggggtttggttctagactatcacaataaagtgaatatcacaataaagagaaatacatgaagattatattccccagtgcatataaaagttgtggtgatatcacactgtaatctattgtatacaataacattgtgtataaaaaatgtatatgccttaatttaatgtaatctattgtatacaataacattgtatataaaaatgtatattccttaatccataaaaatactttatggatgaaaatgctaacaatcatctgagcctttagcaagttacaatcattttgctggtggagggtcttgcctcagtgttgatggctactgactgatcaggatgttggttgctgaaggttggagtgtctgtggcaatttcttaaaataagacaataatgaagtttgctgtgtcagagccttcctttcatgaaaaatttctctgtaatatgcaatgctgtctgatagcatgttacccacagtagaatttggaaaattggagtcagtcctctcaaaccatgctgttactttatcaacttaagtttatggaatattcaaaattctttgttgtcatttcagcagtgttcacagcatcttcaccaggagtacattccatcttaggaaaccactttttttgctcatctataagaagcaactccctgtccattcaagttttatcatgagattgcaacatttcagtatccatcttcaggctccacttccaattctagttctcttgctatttctaccacatctgcagtgacttcttccctgaagtcttgaagcgctcaaagtcatccacaagggctggaattcacttcttccaaactcctgttaatgttgatgttttgacctcctcccatgaatcacgaatgttcttaatggcatctagaatgatgaatacgttgcaggaggttttcattttagtttgtctgatccatcagaggaatcacggtctatggcagctatagtcttgcaaaatatatttcttaaataataagacttgaaagtcaaaattacttcttgatttgggggttgcagaatgaatgttgtattagcagccatgaaaacagcattcatctccttatacatctccatcagagcacttgggtgactgggtgcatcatcaatgagcagaaatattttaaaaggggccaggcatggtggctcatgtctgtaattccaggactttgggagactgaggcaggcagatcacctgaggtcgggagttcgagaccagcctgaccaacagggagaaaccccgtctctactaagaatagaaaattaggtgtggcagtgcatgcctgtaatcccagctactcgggaggctgaggtaggagaatcgcttgaacccaggaggcggaggtcatggtgagccaagattgcaccattgcactccagcctgggcaacaagagtgaaactccatctcaaaaaaataaaagcctagcctcccaaagtgccaggattacaggcatgagccaccgcgcctgtctgtccgcccgtcttcttttttaagagcaagaaaaggtttcccagaagtactctggtagattcttatcacacacacattcctaaaccagttactggcaaagaaaatagaattatcatgattaattagcatattctgaagtacatgcttccttataactgaacaaaaattagagctccactggcaacgcggaaatggctgttgacttggcaactaatagtgaattgctcacaatgtttaagtgaaatggcctgtcagatttcctgggaacacaggaaccagggccagacttagaaacggcctcagtaagaggttttctaaaactattttctggtatcgtaattattcctaattaccttgtgcactaaaaaaatttaaaaattttaaatttagaattttaaacacatttcctgacagtaaccaagatataaaaatgtgtaaaattgagtgaatatattttaaagcatggaagatttgtgttaccctcagacttgaaagggaacctgcaaagttatggtctcatgggaaatattgtttctttttgccttgacataattttcaggctctttggttttattctaagcaacccagcagggcacctttaaaaagaaacaaacaaaattactgtctctaaaccaaagaagatagaaaaatacattcaggagaatagtatacattgaaaactgccactttagctagtgcttttttttttttttttttttttttaagacggagtctcgctctgttccaggctggagtgtagtggtgcgatctcagctcactgcaacctccaccttccagtttcaaatgatacttatgcctcagcctcctgagtagctgggattacaggggccagccaccatgcccagctaattttttcatatttttagtagagagtactttttaactgagaagagatgctgtaaagttttaggaaatcacagtggggacagtagtcatacttctactttcttctgaatataatattgtttcttttttctcctgcagttacttattttttttttctttttgctttaaggcttggtagttctgagaattttagattcagttataatcgaatgtaactatcaacacatgttatggagtagtataaattgttacttgatgtttggagttgttttactcagtcactcagcaaaggtaagattagatctccgttagatgaaaagtattatctcttatgcaaagagacattggttagctctggatgaagacaatggctatggggtcagtcaaccttgtagaaagaataggctaggcacagtggctcatgcctgtaatcccaccactttggggtggtcgaagccagtggatcacttgagcccagcagttcgagaccaaactcggcaacatagtgagagccccctctctacaaaaaatttgaaaattagccagggcatggtggtgtgtacctctggtactagctatcaggaggctgaggtgggaggatctcttgacctggggaggttgagtctgcatgcagtgagccatgattgcgccactggactccagcctgggtgagaaagtgagaccttgtctcaaaaaaaaaaaaaaaaaaaaaaaaaagacacaataaaagtaaaattgtataatctctggaaaaaacaaaataggctgtcatgttctaatactcaatatgtaaggatgtttagtatattagtgggtataattattaataaaatattctatttagttatctttgaaccagtttgtaataaccaaaccacaaaaattcaatttgctttgtatgtaaaaatcttttaaaatagaaagtcctgccttaactttcataaatctgaatgtgagcatatatttatgcttttcatttctttgcacagctttttttttttttcctctaagacagagtctcactctgtcactcaggctggagtatagtggcacgatctgagctcactgcaacctctacctcccaggttcaagtgattcttgtccatcagcctcccaagtagctgggattacaggtgtgcaacaccatacctggttaatttttgtatttttagcagagacagggtttcgccatgttgtccaggctggtgcacagcattttgttgttgatgtgtgagacttgtaatataacagtaataatgctgtcatttcttaaagatgatatataatcctatcaaaatattcctgggaagtaggtatttgtcagcctgtcagtgttttccttttattttgtgtgtgtgtgtgtgtgtgtgtgtgtgtctgtgtgtgtgtgtgttttagtacattctcccagatgctgaaattttccctttaaactgttactatgatgtatgtcttatttctttctcttttttggtcctaattatgctctcaggagttaagacagtataaaattatgttttttaaaggaaacttcatcaaatacttggaaattagcaaatattttttagaggtagaaactgtcatttatattcctaagacttgtaggccattgtatttgttgactgactgatttgactgagaacctagtgtgtgataacgtgtcactgtttctgtcaacttatataattgagggtctttttaattgttcttaccttagaccactatatacttgtggtcttataaagtatatttgaaaattatatgcattttcatgttttgtctgggcctgggaaaaatatttattttaaaactgtaacatcttaacctttaaaacccattgtcagttatttggaaaaattagtattatatgatatgaagcacttctttttattgctgatttcaggtttcactatctgggaaactccggtgtggagacataggtctgttaactgtcttctttgttttatctggaatgttttattgatactataaaacaaaacttatcagtaagactgatttggaattcatattgtttgacagcattatcactgtcaataattatccattgtcagtatttgtaaagcagaataaaagaagccattatttaagtttaattcctgagatgattcagcatacggtgtaatatcaatctgtgggaattttattttaaactttttcttagtaaagtttactttttagagctgttttaggttcattcacagcaaaattgagcaaagatacagagatttcccataatcctcctgccctcacacatgaatagcctcccccattttcagcatcccccaccagagtggtacatttgatacaattgatgaaccaatattgacacatccaaataaaactattttttggggaggggagacggagtctctctctgttgcccaggctggagtgcagtggcgagatctcagctcactgcaacctctatctcccgggttcaagcaattctcttgtctcagcctcctgagtagctgggactacaggcacacgctaccatgaccggcaaatttttgtatttttagtagagacggggtttcaccatattggtcaggctggtttcaaactcctgacctcaagtgatccacccgcctcggcctcccaaagtgctgggattacaggcatgagacactgcgcccagccgataaaactcttagaacaagattaattgattgattgagacaaggccttgctctgtctcccaggctggagtgcagtgatgcaatcatagttcacagcagcctgcagctcctggcctcaagtgatcctcctgcctgagcctcttgagtagttgggactatagcttgtgctactgctcccagaagtctcttatttaatctgtctcttctaaagtatagatgtatagttcatacctttagaaatttctgagtttttatggtggttctgcaaataaacctgtttgcttcttatttctgccttcccttccttctgagcctttggtttttgattttctcttatatgctggttcagctatccttgtttctgttgctttaaagccttcaacatattatgaacattttccaccaaacatattgttcttatgagtacatcgtaattttagggcaagaagcagagatgaactttgctttaactcttttgtgttgaagtatgctaatggcaagcatgttttttaaatataaaagttgtacaagttgagatgtttaattcctttactttaagaaaaagcatcataattagaagggagaattgctgttatctggaaggtgttcagacagtttggggagaaaaaaacaaccaaaacagctgcagtgtaatttccataagggaatgggcttatatctttgtttatttgtgtttgttttccattgtacactcagtgcctagcacggggtaacacagtatgtgattaaccaacagttattggaaaaatatattttagtgtgttattttagataattaaaagtacatttaggaaatatgcaacctttttgtttggctttattaatcagctttaaaatgctgatgatagaagcaggaggcagagaaattataggcaaataggggtgggtccctggtgaaaccccacctccaaggtgaaaagcttgaaaccagcagcccaaagtgagaacttctattcctgtttgcctgcactgtcctgattggttctttctgaataatgtctttttaccaattgaatgttgccttttccaaagctacctatggcctgccccacccgcatcctgtgcctgtaaagccccggactcagtaggtagagaggagagattctgccagactttcgggaaaagagatggcttgacttcggggaagagactactgctgtacttcagggaagaccacctactcttcccgtcccctctccagctcccctctccactgagagccatttccaccgctcagtaaaattctccaccttcaccatccttcaagtgtctgcatcacttccttcttcttggatactggacaagaactcagaacccacggagtgcaggtacccaaaaaggctgtcatactggccctttgccctcgctggcggagggcagccaccccacgcaatgtggtaagggaccaactgagctgttaacatgcacacagacagacggcagagctaaaagaccactgtaacactttctctggggttttggggtcgtgggcaccctcacctgggtgctgctgtgggacctgcatggagctttctctcgctggctcctggagcagccggccaggtcctgcactctcttgctaacatgctccctcctgcagggggttgagcgctgtggcgtgagtaaactgtcgcccttgttgcaagtccaatgaagggaccaagaaaaatcctgcatcactgatatgaaatgtaccaaattaagtaacatcatcttatttcttctgattttgttttcagtttgtttatattcctttccataggtattatgtgtctgttttagttcataaaattgtggcctaatttatattttgaccattattcagcacactgttagtactcaggactaatttcagttgcttatttagacacatcgaaataaatcacattttaaggctgggcgcagtggctcctgcctgtaatcccagcactttgggaggttgaggccaggagttcgagaccagcctgggcaatatggtgaaatcccgtctctactaacaatacaaaagttagctgggcatggtggtgcacacttgtggtcccagctacttgggactctgaggcacggaaatcgcttgaacccaggagtcagaggttgcagtgagccatcacgccacactgcattccagcctgagtgagattacgtctcaaaaaaaattttttttaaacataaataaagaccacactatcttttttgaagattatgttcacatttcattctctccattgaactgtatagatgtattacctgtatataaagaatgtaaatttttttgtattaaaaatcgacaccttaaaaaaaaactaataccaccacaaggttaagctctgaggagatttcagctttacaataattacattgttacaataatgtttaacttctcaataattaaaaaccaaagcaatgttgcaaccttggttcaatattcaaatatatttttcttggtaaccaagctacttcactatttatagtactttataaatgatttagaattgttatgcagttttttcaaagaagtattcataaggtaaatttagaaaattattttaaaacgaaagtgatgcccaccagatggtgctatttcgcctgttttatctgcgacaataagtaggaaaaatgaatatagaacttcaaaaaagtgtatggaagatctagaatatttgggcattgtattttgggtgtagatgagctcagtggaaggaagcattcaaatattctaaacttgtgtttagtactgtatgtttatcttgataaaggtaaagatgaattcccagagttaatatgccagataaccttttatttagtctaaatgttaagtagattttttgaaaagttgacctatatgcaaattttattaacttcatagctgtatatgcatgaaaaatgaaattatttattagatatgtgttaccaaaatttgtttcaagatttctttatattgttaagtaaacaatattactatctcatttgagttacattgtgatttacaaattaagggaaacattttgatttttttatgtgtttgtaattattacccagaaacttaggcttgaattcactatttttacaaaggaaagagatgactcttctaaattaatttttgtattaggaagagggcaaactatgtggtacagtgttcacttagatgcagccattgaatgacgatccattagagtcaaaatggttagttagctaatgaaatacacttttcagtaaagctggaaagatttagccagctcttaaaagtgtttctaggattttaatgtagtctttttcccgctgattttattatcactctgtattcttctctggtcatgagattgaaccataaaagtcatgtagatgcttgttataagtatttgccaaagtcatcattgtcagtgattttattggcatgtgtgaaattagagattaaacttgcttttaaatcttgcatttgaatttttcttctggaagggtacatgtataactttcaatttaatgttcaattattggtaacagaatgaagcatctctctataggccagtaaatatatatagtagattttattgtattcctgtactgtttttgaatgaatattttactaattatattaacataatcctcatacatacccttaagattaggacctactataatgctttatttgaacttgtttcatagcatttgtcttttttaactttggattatagttttggaatataaatcagatccctcctacaaaaacataaagttcttcatgctttctctcattccacttatcacaatactttacatgtagtagatgaccctatatattttttatataaatgaatagttttgtcatgccaagtattgatattagtattagtgacaacaagtattcctcattccatagtttttgtttttgttttttttttttttgagacagagtcttactctgtcacccagggtggagtgcagtggcagaatttcagctcactgcaatgtctgcctcccaggttcaagcaattctcctgtgtcagccttcttagtagctgggattacaggcatgcaccatcacgcctggctaatttttgtaattttagtagagatggggtttcaccatattggtcaggctggtcttgaactcctgacctcaggtgatccactcacctcagcctcccaaagtgggattacaggcataagctactgcacctggtctctgttctacagttttttatcttatgcttttctgaaatgactttttatagttgggtttaaaaggatcatctcattggaatctcatatcacagttatgatgcattctgtcatgatgaggataagtgtatattcaggttaaaaaaaatcaaaatattattgtcagcctgcatcagtattagagattgtctggtccaggagttctcagattgtgattcaagggcctcttgtgggaggggggggtcaggggtccttaagaccttgacagaagttctgtgagggcagaactatattcaaagtaatactaagactgtgtttacccttttcattctcattctctcatgagcataggtggagttttctagaggttgcataccatgccatactgattgaatgtacaagttatatgaaactctagcagttctgtcaaaagacaaagttacaacaaatttagtttaaagatctcagtcagctttattgtgattctagaatcaggcaatacttcattccataaagtagagtgtgtgttctaatgagttgagcagatggttggttttatagacagaaagggctgaagaaagcagattggtcatttcaaagtgaattctcttgtaaggtctggatggggagacaggacaatagaaagactggttaatatcaggttacttcagattagggattaaaacagaggaaacttcattatcatgcccattgaatacttcattatcatgtgcattgaatattgaaaattgtcctgtttgggatattaggctgttatctgtctctcctgattttttagaaagtcaagataacaactcagtttgggtttggtgagcatgggtgactccattttgatttttagtctggtcttcttttggagcctagtgtaggagttttgttcaaaacagtggcctataattttggcttcataagccagacattaaagagatttgcaaagattataaaacagtgcttctcttgtcactaagatgttttttagtttggaaatagttattttcataaaatgttacattaacatttaatgaatttattcttaaaataataaatatttaaaaaagttatattttaacttctaatatgataactagggctagatattaaagctccttgaattactcgatactctttttaaagtgtaaagtggtcctgagatgaaagtgtctgagaacttatgatcctaattctttatcctcatttcatagatgagaatactatgagcccagagaggttagtttagttaagtacactcatccagtttttggcttagctgattcttggatcactgacatctggctttttttgatttttttttttttaagttttttttttttttttttttttttgagacagagtcttgctgtgtcagctaggctcgggggctggagtgcagtggtgcagtcatggctcactgcagccttcactgcctgggctcaagtgatcctcccacctcagcctcctgagtacctgggactacaggcacgtgccaccatgcctggctaatttttgtgttttttgtagagaagggtattttttgttgcccaggctggtctcaaactcttgggcttaagtgatcagctagccttgacctcccaaaatgttgggatgagccaccttgcctggcctgatatattttattagcagttttgctgtttagatattcttcaacctaataccaaccatcagctcctttaacagtttcttcatttgatattttaactaactttattaagtacatgagtaaattaggaatattgacctactttttcaacaacaataaaatggtgtttttttaaactcaaaaaatgtctagaaaaagggaattgatatatgaaacagtgtaaccttagcgtcagaaagaataatgttgagggcaaagaaataggttcttgtgttttagagactcttttactgtcttttttcctttttttccccccttcttcaacaacaaaacattggttacaagcttccctgggcatttatggcagcccacctacagaagaacaagtgttctgttttaaaattttaaaaattttatcaagaggataataattacacatatgctgcttttttgatggatatgtattatttctcaggttgagcctcatggtgggggtggtagattctaaccccctccttttaattgttgaatgaatttaaaactatgtcataaagaaactgcgtaattttaattcaaagaaagataattaggatatacataatatccctcttcctttgaggggcttccttcgtgtagaagacatggactgagtgatttttgctcaataaaggaaaactttctagtagtaaagaaatacaaaaatagaatcagcttgtttggaagtagtgagttccctttcttatgaggcattaaagcatagaccagattattgactgttagtaggagtactagcaaatgaatcagtagatggagggttaattgggttacatgacctttcagattgcttttttttttgaggtggagtctcgcttgtcaccaggctagagtgcagtggtgcaatctcagctcactgccacctccgcctcctgggttcaagcgattctcatgcctttgcctcccgagtagctgggattacaggcacgtgccaccacacctaattttttgtatttttagtagagacggggtttcatcatgttggccagggtggtcttgatctactgacctcatgatttgcctgccttggcctcccaaagtgctgggactacaggcatgatccaccgtgcccagccttcaaattcttttattaagtgtttgagtatacttgttcaaaataactttttaaacaagtataaaaaggcagttggtttagcagatgtattctacttttatatcagctgctctgttaacctaaagattttatggatctgtggtctcaccatgatcactgacatcaattctccttgaaggaggatgagttttgtttgttcattttattgcaaaccatttgaagagatgatagattggtagcagaaatttggcagagaaaaggatgataaacattagaaaggaggataaagcccactggaagacataaatgaattgatgatattttggtgtatattttctcattgctttatgattataaatattttctgctgctttttgccactatctatttttcatgtcttccaataaagtattccatggccaaaatttgtgtgaaattctcttcggttgttgctggttttacaagttatagggttctttggaatataattactgaaatgatgactacactaaaacatatttcttcttaatttaacaaagtatttagtgggaggaaggctctagcttttcttattttctttaatgttttttaggcatgctagaggaaaatagtgttcttactattagttttgaacattttttatgactatagagttgaaagcccaaaacactagaagtaaatggatcattgcaaaatatttgttttgttttcatttgtgagtggggcattcgtgtgtcactgtgtctatgcttctatttttctctgtatatagtttatatccttaagactttcagaaagaaattgagatgttatgttgttttattgtatatgcatgtacatgcatacacacacacacacacacacacacacacacagttttatttgttcatcatatatttaaggcctgacataggtcttacaaagttcaattactatagggcttaagtaggaaatgaatggtaaaatgagccaatttgaagcaataaatactgattgatagattatcaccttcttccaaataagatatgtggcatcgtagaatcttgctcttagatacacagatatgtgtgatgtttaaatagttgagaaattcaaccagaaatgaatgaaagggttttcccgttatcctgtcatacgcaaattaccagatcattcagttcttcaatttatcaattcatgtatttattcatttaactaatatttgttagttttatactatgtgtaaagccctattttagacactgaatacagtgccagacagtaattttcctgcactcatagtttatactctaatagagaatgtagaattgagctttaaatttcctattcaataagtatttttagtaatatgtgaagtacaagagcttctgaagacttattgcgccactctctccctattcatccatttaccagttgttactgaatgcttactctatgtactagaaatgcagagatgagtaagatacaacctggccctgaaaaaaattcagtctatttggagttatagacaggcagtaactagctattatatagtgtgatgatggctatgatataattacaaataatattctgcaagaacagtaattttctctagctgtgaggtatgcaagaagctatcatagagaactaatatttgaggatgagtagaaatagtcgggtatagggagatcaaaggagaagttactcctattccccaaatagagggttcttcatgaacacacagaagtaggcaaggtctgtttggagaatggtgagatattgtgtagtttgggtaaaacactgggtatgtcatggagggagaggtaaaagaagaagctacaacgtaggttcaggccgaattgtgaaaagttttatatacaaggttaaagttggctttttattttacagttagttggggacctgtggaagatttttcagcaggcaaacatacttagtctgcagtttacaaagatagttgatagaatacaggatgaagtagtgagaagttgaggctatggaaaggcaggtataccagtttgaaaacttcataatagatatgaatgaaataatgagggtctcttatagggtagtagtagtagtgactttagaacacagggatggattaaaaatcaaattcagaggtatttttgttttgcttcatttttttgagacagggtcttgctctgtcacccatgctggagtgcagtgacatgatcacagctcactgcagctagggctacagatgtgtgccaccatggctggccaattttttatttttatttttatttttggtagagacaaggtctcattatgttgcccaggctggtcttaaaatcctgagctcaagcgattcttccatctcagtctcccaaattgctaggattacaagcatgagccaccatgcctggtccagagttagaactgacaggatttagtgagtgatccatatggagagagggcgttgaaaaagattttgaagttttgtgtttagtgtctgcataattaaatgctggtactattaacttcaaaaggaaaagcaatatggttgagggaagcaatgaatttggttttgtaatattgagggcaggagtaaacctaagggaatgttggaggcatttaaattctaagtggaggagatgcctattcaagagaaaggaggaggagtagggggaagagatagctgttcagtgtgtcattaaacctctcaaatcctcagtttgttatttatcatatattggaggtagaatcaataatttttctggttttgaaataacctgtgttttagttatcacaaattctaaattagtagtacaaaaattataataattatagtttatatgttatagactgatgataatatttattgattacttcctgtgaagtttaggtaaaatgctaagcattttgcattcatcatccatttaattctcctagcaatatgagttaaatattattactatctggattttcagaaaagggaagataacttgaccaagattgttacagcaaataagtggtggatgggtattcaaacccaggacaatctgacattaaaactcaagcttttaaccactatattatttgcctgtcttgtagaacataagagttgtaatgaatctaaaacatcatctagccctttcctgtaatcagatttatgtcatagctaaggtctgtaattaatgtcaaaattagctatccaatttacttaataagaagcttactccacagccattcattactgctgttttccttgtggcagatacttttttttttttttttttttttgtcgactcacctctttaccgtgtgatgtgagtaaattctgtatagtctaggccactcatgattatcccatttttcttgctagtcattaattaagacctgaacataggactgatatctgaccaataactcatttgtggccaatgagacatgaggggaggtttggtggaggggcttcttggaaaggtaacacctcctctcccctcatttttggatgtttctatctagatgggttcttggaattgtgagagctatcttggaattatttggggcctaggtcaggataaaaccaaaacactggatggcacagtgaaaagatggtgagaacttggatccttaatgatcttgttgaacttctaaattacccattcctaaagctattgtgcctcaggactaggtcttacatgaaattagagggaatttattaggctgtgtgaaacaaggactttttaaggctactaacagtttttttcttttaaacgatacttatcactgaaagaaacctaactgggatctgcagtgtttatctttgtctgaagtaaatagaaaggcactgtagggcttgcattactgttgagacacaattaaaacaggaatagaagacaatttttgtgtcactgcacctaatttaattggtgtagaagttggagatgatcatgctctagaaaacagatcttatatatgttaaaggtagcaaagtgtcattgaggaaatgagtctgattattctgacagtttctgtaggtaaaaggaatagaaagtaagtgttcagattaggttaggaaatagaaatggatttagtttgtagacagttaacctacgtttcagggtccttccaagactctggaagaatctcaagcaatgtgttaacataatattttgggtgaggcggggtaagatttgcaaaagttaggtatttaatccattaaaactgctattccttttcacttagactttccctgtatcataccctcatattgggtggcattagagtggcctgagctaagggaaaattgagtagaggatacatttagagatagtatatggttagcagttgtttatgtgtccagttattttgtaggcattacttccaggaatgttattactgtccactgtgtctacttccctggccttgtgatacatagatgtagttttgcagggcaggtgagccccaaagtggggctcagcccgtgagggttcttggctttgcccagaaaagaattcaagggcaagccagaggtagaagaaaatagatttattgaacaggcagtgttacagctctggtggtgttatagctcggtgactgctcctgcagagcagggctaccccgtaggcagagagtagcagttcagggcagttattaatacccttttttaataacatgcagattaaggagtggtttatgcagaaatttctagggaagggatagtaacttttgggtcattgggtcattgccatggaaagtggtggtaactcctgggtgttctcatagcagtgttgacatggcacactggtgggtgtgtctgatggaaagcttcttctgcctaatcatctttcagctagtcctcaatttaattgggtgtctgaacctgtctctagagtcaagtcctgcctcctaactcagtaggggcaagggtcttagagcattataaatatgttctttgtggtagaggtagaggaagagaaacatcgtttaagtgtttagagtgagaaactagtctggaaaatttttctaaatcttggaacttgattgtggttttcgtaaatttgataatattcctaagaatgtatatgacattatcagtaataagttataaagaagttataaagctgatataaactctctacactgcctttttttttttttttttttaagatggagtctcctctgtcacccaggctggagtgcaggggtgtgatctctgctcactgcaacctctgcctcccaggttcaggtgattcttttgcctcagcctcctgagcagctgagactacaggcacgcaccatcatgcctaacaaatttttgtatttttagtagagatggggtttcaccatgttggccgggctggtcacgaactgctgacctcaagtgatccgcccgcctcagcctcccaaagtgctgggattacaggtgtgagacaccgtgcctggcctacactgtcagtactaaaaattgatcaaacacagtagtaaaaagataaaattatctttctattctcttaatgttgcaaaattgttatatgaagaggaaatcaagaaatgcagccagaaatgtaagaaaataagagcattatagagatagattaggcaattaataaagatatgctcttctttttgaaattcatgtttttggcatttgttagccttttaaagttagtgtttagttgtaatttattttctcattccagatatttacttcacacctaattttgtattcctttccttaaatagagtcccacaaattgtaaaaaaggaattagctcaccaaaaacaccaaatgcagtatttttaatatttacctttcaggttcggttgctggatctagatatgcctcttttttttatttcctcattttttcttctaaaaagaaaattatgtattttaatgtcagattgcttttgattaaaatgtttcatattaaaattgtatacctgaaaaatattattcaataacacacttcaaaaagttgacagttaaaaaaaaaagaatagcccttgttacttttcttatctaatcacagagtttgtgtagtgaatgtaaaaagaaaaaaaaattgttacaagtttggagcaaagagctctgtgtttaaaaggaatctccttctttttttgtgtgtttttccttttgtaccaatggggaacctaaatctgttttagttgcacagacacaatggacaaatagtcattttgtatttgccaagtgtgataccttcctttgtttatttgctattaaactgttgagagttttatggctagtggataatcattgttcaaactttttaataactacagtgaattgtgttaatataaaattatgctgtacagtattttcttgttatgttgatggtcaaagtgaacatcagatattaaaaatttagatgagtaaaatattaaacagcctatttttgtcatgtaacaaaagaccatgagatccatggaggaaaaaaggacagctttatttttctatagaaaacaatagtaggttggggatatgcagcctgtggtgtaaaatgaaaatgaggtcctagttgggggttggagagttagaaattataaaggcaaaaattgtaggacaggggaggtggggtcaaggaagtaaggaataaagtcttgattagatgacctttaatccccaaatcaccagtgtgtcttagttggttgtttccaggtggttggtcagttggcaccaggtggtcttttggtgatcatttggggaatttccaaatgatcaccaaaaggaactgttctttgacttggtggcagaaaaacaggttttgcaacacttttaaggacacagggtataattgctcccttaccctgtcattgcctcttggttctgcttttacctttgagccacaaggagtctatcttgtcaattaactgggggcataatttgacagtccaatatgtataatgatgacaacagctccactaacatgaatgccattcttagaatttctcatagatcctggcatttggtacatctgagttgaataaataaaagtctggggaatgaatgaaagaaaaattagttcaatgtcctataactttaagttaatttattagaattgccaccaacaaaattagctctagcatttagatactaaaaggaatttgttaagcaaacttacttttgcagttatctctccatggacagtcagaacaggtattcttcatttctaaaacatactgctgttctttaagaccattctttggcactgtggaactttagtcattttctagacatttgttagccactaaatgtctcataccagggactcatatttgtaaataatagtgtctgcctttgagaagctcataactgggtagtcaacgaacagtcacagtgcagatctggaatcagtgttgagggagtacaaaatcctttgggtgttgtaatcagagtcaagaaaagcttcacagtggcgataggcttaagcttagttgaaggaagaggaagctttcaagtggaggtggcagagaaagcattctgacatgtgaaaaggcaggaaagcctgcgtgcagcatatttattagttttgtctcccttggagcattttgtaaattttattgagtattcagagttgacagaaaggcagtcagggatcatttcatggagcgccatgctgagaagattagaggattttaagcaagtgatgtggtcaaatttgcagttttgaaagagtacttaacattatcctggttatatgtttagcagatttggcaagaactgattgttatgatttgatagtcatttaatacaaaaaggaacctggaatgctcttcgtctttagtgaacattatgtaacctatcttcatggccttcttagtgaggtaaacattttttttttgaaattgtaaagatttaaactttttgaagggtaaactttctcagataattatgcttagttgtgagcagaagtaaaataatgtttttacaggccagagcatttaattaccagtgcaagactgtccagactactctttccatttaccatgataactggtaaaatgtgagatggtgattgctccatcatcttgggtactgagatgaaaagatgtggggtggagtcctcaaatgacttatgatgaacagctagtgtaagcaagaaaatgaccttattgttttaagccactgatattttgcagttcttacctgataaatggtacatgaacctaacgtgtttttattgatgcaaccatatatcaaaacagtatttttgaaggaatcattgtagaagtacagacatttatagaaaattttttacctctctgatttagagaaatttttgaaagcacaataacttaggtaacatagtaacataaaagttctcataatatgtgtaaaccaaaatgagttactgcaactaagagtcattttgaaagagactaaaattgacttatctttaatttgttaaataaaagtgtgatattaaatccattacaaaaatgggtaaaaattgaagacaactgcaattttataggttactgaactttatattttacatgatattacagtcatccttcagtatacatgggcgggtggttccaggacccaagtctacaaatatgttaagtcccacagtgggtgctgtgaaacctacataaaggaaaagttggctctctgtatgcgcaagtttcgtatcctgtgaattctgtattttcaatccacatttggttgaaaaatttcagcctgtaggtggacttgcgcagttcaaacccacttcattcaagggtcaactgtattttatagtcagtatttgcataataaggaaatctaaatggtactttgatattcaaagtttcataataatctatatgtatgttttaaagtgagtgtggtgatattaatacttaaatgaaaaatatgagttaataaagcaatttataattttatatcaattgagcatattgtttttgaaatttaatttagaataatcatctatacataatctatagatactttagtctttctatatgacattcttatggtggtttattgattatcataactatgaataatgagtaaaaattatacaactatacaagccaatatatgcttgaaattattatttattgatagtaaattagattttgacatgaaatgatttctgtttaggcaataaatttaaactatagaaaaaaatgcagtgtaacttgtactgtaaataaacgattagcaatgaacattacagtgagagctgatagtttatgaattattcactgcaaacttattgtctctgtgtcattaacatgtaagataatgagcctaattaccatggctttaaactcaggggagttagcaatttatgtgtaaaagtttctgggctgtagttaccacccacaagggtattgagagaactgcagacactacttctgtgttttgtttcagaaatgttctttttcctcacttgcttccttcttaataaattagtttttatttatttttatagtgagaattatgagcttttcctcttgcttgaatacctttttaaaggagttatgagaaatatttaagtatttttttagtgtagtttagtgttgtaagtagacaaaatattattagatgtattcttttatttgcttacataagttggcatcacttactatagtaaatgaccactaatagtgtaatttcttggaaaatctagcctaaaaggtcaatattaataattggttttctcctctaaaaggatttgtactaagatgatttactttcaaagtactcagtattagcctatagccttttttctaatctttaatattgtatctttgatcttaatttaaagttttgatgaacttgttgcttctattttctctcttatagtataaattatctgtaataagccaccttaattaaagttggtaaatctacaactgcttcaattatacactaatcaattatacactaatttaattctacttagcaggatacggtacatcattaatcagttttagacttaatacaacagatttagaagtaatcaaaattgaagcattttatttagctgggaaaaaaatgaagggtcataatctagtaattcacatatcaattctgataaaaatcaaagattctttgctaaaaatgaaggaatgtagctgttatgtttactgttgagtgccatgggctgaagctgtgattatataatatctttagatgttaatagcataatagttttgtgctctacctttttctttaaattgttattcatgttactaaatgggttgttttctgtaacatgattgtttaacgtatacataatataagaattccttgagtgaatatcttttttgttgttgttgtttgtttttgtgttttttttttttttttttttttgagacggagtctccctgtgtcgcccaggctggagtgcagtggcatgatctcggctcattgcaacctctccatcctgggttcaagcgattctcgtgccttagcctcccaagtagctgggattacaggcatgtggcctagctaatttttgtatttttagtagagaagaggtttcgccatgttggccaggctgatttcgaactcctggcctcaagtgatctgcctgcctcagcctcccaaagtgttgggattacaggtgtgagccactgtgcctggcatatagaatatttactagtagtttgttttgaacatgtaagcatgtgcacaaatgtatttttttcagaattatgttaaataagatgattagatataattaactcaaaaatctttagcaaaatgatctttgttttctgtgattgaggtggtgacaaatttgccttagaattcttggggatgtgttataaactcgatgtaatcatttttcttttccttttttttttttttttttgagacggagtcttgctctgtcacccaggctggagtgcagtggcgcgatctcggctcaccgcaagctccacctcctgggttcatgccattctcctgcctcagcctcccaagtagctgggactacaggcacccgccaccatgcctggctattttttttgtatttttagtagagacggggtttcaccatgttagccaggatggtctcgatctcctgacctcgtgatccgtctgccttcgcctcccaaagtgctaggattacaggcgtgagccaccctgcccggcccatttttctcaattatctgctcattgaattaaatgactcagattgaatttcattactcattctttctatacatgttcatattattggaaacacttcttgtcctgctcagctttctttccaataaattagtaattctttgctcactcgtcttgtattcctttataagaatgttctagatagggatattctaagttttgaagactatgtatgttaagtgcattttacccttttgagagagttttagtaacaagtttcagggaacccctaggactctgacccattatagctttggccatttaaaaaaaaaaaccttcaaaggtaatatgtgtacatggttaacaatcaaatagaacagatggtctgtctaataatgaaaaacaagaaaaatcttgccctatgtttctctgttcccactccccccaaaatcagccacttgtaactgattctgttttcagtgcttattgtggttgtctcaacctgtagtagaattatagattcttttgtttgtttgtttgttttgctttttaaattagagacaagttcttgccctctcaccaggttggagtacattggtgtgatcacagctcactgaagccttgaactcctgggctcaagccatcctcctgcctcagcttcctgtgcagctgggactacaggcatgcaccactccacccagctaattttttaatttttttgtagaaacagggttttgctgtgttgtcccttgaatgcctggcctcaagtgatcctcctgccttggcctgtgattataggcgtgagccactgtgcccagccttagaaattatttctcaatgcttttgctcttctgtgttctgtgattaggtgactctttatctcacaccacttctaccttttctccatccttccaagttgtgatcactgttttcgttcctaaattggttatttttaaacttcaaataattcaggtaaatttatattttatgttttgttaactgtgttccctgcttactgtttcttccattaatttaaatatcatcgaagttgataatgctaagaacttgtttgtgttaaggtaattctcacatgtggataaaaactgattagtgccaaaagtttacaataaaatataacagtctcctatcctaccctgggttctccagaagcggcaacttataatactgttagtttgttctttctgatactagcttattcctaaataatatgtgtattcagcttttctgattaaccaattttagatgttatctattgacctttttattggggcctgggatacagatcatattatatacctgtgcacccagttctgaaaagttatataataattttggttcaatctataagcagtctataatcgttatttatattatagtgactatgtaagtattgagtgctgtaatatagcacattacattcatttgcttaaacaaatatttggtccccctttcccaccacattatttatagccttgtttattcatttgcttggtttcctattggctaatttgctaatctcccccctcagtgtttcagcagatctctccagcacctcccattaatttttctttgtttatcataggttcgaaactcaataattttttttcctggaagtttctctccttcagccctctattctactttaccaaggagttgtcttactcttttcagctctgatcctgggacttccctttgttgctcttttgggggacaatttgctttttgattgtttttagtcttattagtttatgcccttgttttgctcaagcacattctccagagcttcctgagaaaagaatatgtgagaaataaaatttttccatacatgtaggtctaaaatgtctttattctacctttacataggttggtatttcaattaagtctggaaatgcagattgaaaataattattcctcagaaacttgaaggccttgctccattagcaaccagtgtttcctatgtgaagtttgatgccacactgattgctgattctttatatgtgacctatttttttctctttggacattcttagaatctcctctttcctcctggtattctggcatttctcaatgtgatttttcttattatggcttttttttttcattgttctgagcatgtaatgggcccttatagtccagagacttaaatgttcttcctgccattcatgcaggtttttgaaatttcttctctactattttctttagagctatgagttatttttattagccagttttctattaatagacactggatttttcaagttttccaccacaaaaaacactcatgggccgggtgtggtggctcacacctgtaatcccagtgctttgggaggccgaggtgtgtggatcacctgaggtcaggagttcaagaccagcctggccaacatggcgaaaccctgtgtctactaaaagtacaaaaattagctgggtatggtggcaggtgcctgtaaatcccagccacgtgggaggctcaggcaggagaatcgcttgaacctgggaggcagaggttgctgtgatcacgccattgcactccagcctggatgacaagagtgagacttcatctcaaaaaaaaaaaaaaaaacaaaaaaactcctcacatatattatcttttttgcatgtacttttatataattgtgccagttcttctgtaagatatacatggcttttatcttattactttctctgagaggtagagggtggggcagggaaggcaaggagaggaagaagctttgagattctcctacctgaacttcagattctggtgtgatacctcaatattgagttagaatggctttatcaagcatgtttatttctagtttttcatattatttttgtcttagtcatgaagcacaacaaaccaacatagaacccatttcatactgatgaataaacaggtagcttcattcatgtattcatttattcattcagtcatgttgtgatactctttgggaatacaaaggtgatactgtacttgctgtcatgggatttacaattctagggataagtaggagtgtaattgataaaacatgtatttgtgcttttcaatagtaatattgactaactcaagaaaacttttggagacaggctttctttgaatggactgtgatgcttgcttgtttatgttttcatgaatacatttactagcttttgattttttatattaggagagaacagagtgtcttgttgtggcagaaatacctaatatgtaatcctctgaattcttcaattgttgcaaaacataaacatttactaaagagttcagcagagtagattaaatgttatttaaaacatatgttatattgacctcatggctaaatggcctggtttaggaatccatgaattatcccacaggtaatagcaaagttttctccctgcctcgtctcccaccccaaatatttgatttccacatatactgcacaggggaattgaatttgatgtcgaaagccataagaaaaagagaaactttgctttttactgcttttactaggaaatagaaaacatttttagtgacaggctatgcttcatcatgaaaatacggttgggtgttttaggccttcacaaatttgatttcattgtacttagtgatggatgttagtaagctgtgtgagatggagagaaattaaagaataaacaggaacctctcaaacttgctagtgatgttctacagtttgtagcatgaattttcttacttttagtttttccttatgaaatactttatgtagaacaaactagcagtactaaaacaaacacccatgtacccaatctgtcaacacttagatttgttgaagatttgggtgggcagagtcttccacccaaatggtaaaaggggaatacattacaagtacatctggggttctctgtatacctgtcttcagcccattttctgtcttatttcaaagttcactggtgttccagttttgtttttagctgtaatgcttttcttagtgcttaaaatatatgtgtatatattcataagcaatatgaagtattgatttgcgtgttctaaaacatattttacagtgcctctccttcggctcgctttttcgtgtaacattgaatttttagatttttccctgttaatgcacgtaatttatatgtaatttattttcacctgtatagacttgtatgaatacatcacaatttattctttggttgaggaattacaggtttttcagtattagaaacactactgtgtttaaggttcttgtactgatctgtttatgcatatgtgaaagattcttgaggactgtattttaaatatgtggatgtttaaatttcaattaattaaaattaactcagttcctcagttacactagcaacatttaaagtgtttaatagccacatgtaactagtgagtaatgtattggatattgtggatatggaatcattccattatcataaaaagttttataggctagtgctccttggggtttatacctgtgtgtggaattgttgtgtcactgggcttgcacatgttgcacttcagtagatgttgctgagttgttctttccagtggtatctgagcattccctttctcaattgtcttgctaagaattggtataaacagaaattctaatttctgttttgtaggtgtgaactgtatctcattgtggttttaattgaattttgaaaatatatagtgaggctgagccttttttcttatacatgtgtttaccttttacagttctcatcttgtgattgcctcttaatgtcctttactcattttttcttttgagatattttaaattactgatttgcatgagttttttttgtattttatggatacaaattctttgattatatttgccatatatctgtgcctagtatgtgacttgtctttcattttgtggtgtcttttgcctcacacaagttttaaaatgaaatgtaatcacattatcaatttttaaaaatgctttatcttcttatgccttatttaagaaattacttcctactctaaggtcagagtttcccatatgtgctttgcagaggtagatctttcatctggtagtatgtaatttttgtgtatggtgtgaggtagagttggagacttgagtttttttgcatatggataaccaattatctttgtataattttctgaaaacttcattgccttaatagttttttgtttgcatgggggtcaatttctgggttctaattctgttccattggtctatttgtccctataccaatgtttcagttgaattttcctttttgtcaaagtacctatttttttctttattttttgtagagacagggtcttgctttgttgggtagactggtcttgaacatcaaatgattctcctgccttggctttccaaagtgctgggattacagttgtgagcaaccacacctggccaaattttcttaaaatgaaaataacagtgataatttaggtccaagccctcttcccaaaattgatttagctgatgataagctataatattggaatttataatataaaatactacaatttttttttttttttgagacggagtcttgctctgtcaccaggctggagtgcagtggtacaatctcagctcactgcaacctctgcttcctgggttcaagcgattcccctgcttcagcctcctgagtagctaggactacaggtgcgcaccaccacgcccagctaattgtttttattttagtagagacggggtttcaccatgttggccaagatggtctcaatctcctgacctcgtgatccacctgccttggcctccaaaagtgctggctgagattacaggcgtgagccaccgtgcctggcctagaaaatgatattataaccagcagatgtgaacaataacatttttttctgtgatgatatttgagaaaagcgcaacttaattacaaaagagtgaaaaacaatcactttatcaaagtcagaacttctatacactttcaagtggtgaattgagcctcacttaaaatctaattttcacttttaatgccatttgttttcttttgagatataactgattcatttaccaccaatttttataaattggatttgtagtttggccattgtatgaaaatatttttttaaaaaagtatatgggtcatatgggtagtaatcaggcaaattggttttagatttgcagtacctgttcaattatctgagatttaggggatctagggcatgtgagtagaggttctattaggtttataaagtgcttgtgatgataatataggttaaggaccaagtacctgggaaagatcaagggcatactaaatagttgttcctaaagtaatgggacaattgcagagagagggatgagagaaggagacttaaggatgatgtgttgatgtgtatgtatatataaatgagacataaatgacttttggaaggattactaaagaaaaacagcaatagaagaagactagcctatgtccagcagcaaaaggaagtagaagacagtgagtcagatagtgaccagtacaggacgctaggtggtgccattagtcttagactgcttatttgaagtctctggaggctcagtaacctcagaatagaaagatcgaaaggcggccgggcacagtggctcacgcctgtaatctcagcaccttgggaggccgaggtgggtggatcacgaggtcagcaattcaagaccagcccggccaacatgatgaaaccccgtctctactaaaaatacaaaaattagcctggcgtggtggcgggcacctgtaatcccagctactcaggaggctgaggcagagaattgcttgaaccggggaaggagaggttgctgtgatcggagatcgcgccactgcactccagcctgggtgacagagcaggactctgcttcaaaaaaaagaaaaaaagaagaaaaaaaaaggcactgcttgtatagtaaatgagcgaattgtcttattgagtataacccatagtatattatagttcttgatattttcttctccagtgatcattttgaaaaattttctggaatttgcattgtaaagaagtttgtccaccaaataaactgtgttttaaaagtaatagttcatttctttctaattttaaaggttgtatataaaaaggtattttcatttaaaattcatattaaaaaagataattgaaattttcatattgaaattatataatcagaaggaacttggtgttttaataagctttagtggccttttcctaggtcaatgtacaattccactgaatttttttgaaatacatatccatgggttccacattggtggattaaaccgtggaaagaaaatattagggaaaaagaaattgcctgtgtacagagcatgtacacatttttccttgtcaatattccctaaacaatatgacaaaagtttacatacatttccattgtattagatattgttagtaatctagagatgatttaaagtttggggaggatgtatgcaggttatatgcaaatacagttgaccctcaaacagcacaggtttgaactgcatgcacctacttatattagtttttttccagtaaatacagttggccctctatatgggttggtttggcatctacaagcaaaaatggatggaaaatacagtattcaaggaatgtgaaagttgtgtatatggagagaagggccaactttttggatctatgggttcaacagggccaactgtggtactttagtatgtgtgcattttggtatccaagttgggtcctggatccctcaaagatactgaggaatgactgtattgaagatgattccttgattcctgttacatttttttttaagattccagattgggaataattaagtgcattatttgatttctggagatgagttacaccattaaatttttgttgatatgtgtatcgtgcaggtgacagaaaccctaactcatactggcttaagtaaatggaaattattggatcacatatctaaaaagatgttggtatggctgattttaggtgaagcttgatgcagaggttcaaataattttatttggaccctcttcacctcatcttctagaggtagggtactgccatcagctattggcttatatccttatttgtgtgtgtgtgtgtgtgtgtgtgtgtgtgtgtgtgtgtctgtctgtctgttttagtggctctaaaaacaggtgtaggattatgtcatattaggcctctttggcttgtttgggttccatatctactctgcaactggagatagagttaacactgctggaaatttatggattaagagtgttgaagggatgattccccaaagaaaatttggatcttattagggaaataaagaatggttgtaaaattgcacttatttctttaaggaagtcatcttaaagctgtttttctttgccaggtatggtggctcacacctgtaatcccagcactttgggaggctgtggtgggaggttcacttgaagccaggagtttgagaccgctctgggcagcataatgagatcccatttctacaaaatatttaaaagttagccagagatagtggcatgaacctgtagttctagctacccaggagactgaggcaggaggattgcttgagcccaggagttcgaggctgcagctcgattgcgccactgcactccagcctaagcaacagagcaagtcaccatatctttaagaaacagcaacaccccccaacacatgaaaaacttttttttttttttggctaagctgttcttacactattgattttatttcactagaatttgtttttactttaatctcatttgtgctacttattagttgtgtgacttctcagagtccatttcctcactggcaaaattgttgatacaactattgatatagttatggtgatgataaaataagataatgtgtgtgaaatacctagcctagtgcctggcatatattagatattacagaaatgttagtccacttgtaagcatggttattacccagacatgtttggattttatcagtctttgctatatgttttaaattagcctataatctgtaagtatcacagatgttgtagaatgatcaattttcagattatcagtttgatttattgattaccgctttcagtgctgaaaatgacagttggtagatattgtccaattcatgacttgccagtatttttatcctagtacttaatgtgcagatttagcttctgtaagatttttacaattaatctatgtggggaaatataaattatctttaaggagtagcagtaagtgtagtgaaattatgataaatggttttattgtttggggaaataatatcaactgcttcatgtgtttgaagaataaaaggaagttggcagcaagggagaaagatgaatgattaagtatggcttaaacttgttttttaattaaagtgcttcattgttgtacacaatattcaaattatatttaaatgtaacattaatttttctattaacattcatctttattagaaaatattgcttgtatttatcataatttttttccccaccaactataacactcttataatctatttgggttaatgcgtgtgtagtctcaagaaaagagcctccttaattgtttttaaactgtttgaacactagagatttagtaacctacatttccaataactaacaatacatatgaaactcttgatagtgatggaatagaactaatcatttccttataatatagtgatacatcattatttgacttatggcatatttaactctggttagctacaagcagctttatactggtgtcttttattcagatttgagaagtatcagtgtaacatataaagaacttatttttactaattttcaccatattttatagacacaaaccacatgagaccaaaaatagtgtatactgacctggctggtcattttatggttggttattgtgtttattattctgtactatgtttgttgtatttgtgctttagttgctatttatttttaagaatattgtgttatataggtgtaaaagtgataagaatgtgccaggtatggtggctcactgtaatcccagcactttgggaggccaaggcaggcagatcacttgagctcaggagttcaagtatatcttttgtaatcccagcactttgggaggctaaggcaggtggatcacttgagctcaggagttcaagaccagcctggccaacatggggaaaccctgtgtctactaaaaatacaaaaaattagctgggcgtggtggcacgtgccagtagtcccagctactcgggaggctgaggcaggagaatcgcttgaacccaggaggtggaaattgcagtgagccaaggtcatgccactccactccagcctgggcaacacagccagacttcatttcaaaaaaataaataaataaataaaagtgataagaatgtgacatgttaatagggagagatattagtccgatggtaattaaaagcagagaaagttttaaataaactaaatggtgaagaattggtttgttcaacaataggagttattttgaagaataaagcaagtgattaaacatgtgaaaagtaatgtgcctatgccccaaagtgctattgcttagtgggttatatctattgataattacaatattagaaattaaaatggaaacggttgaaaatattcaatacatttaaagataactgtaataaacccagtatttgctagcataaacacatttttctggaaaataatgatattttctaaaccagaaaaaaatagttaaaagaatggtattgctttttgcaaatctctttaatgtctgacttagtagaagacagctggattttcatctgcttctgcctgccatctgttgtaatatattgaactgatccagaactcctggtctcaagccattgttccacctcggcctcccaaagagctaggattacaggtgtgagccactgcacccagcaaagcaaatagttttaaccttgttggttccctgaaaagattttgtgggacccttgtagtccttagactatgctttgagaactgctggccttagcaattgaacgtaagtacagtaggagacattggtagaaatgcttttgaatttacagtagagtctgggcatcaatattagatgtctattgatcttttattaaaagactaagagtttgagaatttaaaggctaaaacattataggtcctgctgatcagacttttcatagccagatagttctgtaggcttaaggccctttaaatccagataatgtccaagtaagtggcaaggcagcaatttggattccatagctgctaaaaagttttttacggcatttgtacatagatcattaagaagagaggaattatttctcacaaccaatttttagtgtagacaaaactggaatattttggagaaaaatgtcttaatagaatgcatatagcggtaatgtagtcttctatttggcaggaatatatatagggatggtcactttagattaaagaacaaataaaacttaacctacttataaacagaggcttctgtattgagaatttttcttagtataacatatattcaccttagtatcaagttgtgggggtttttgatacccccaaattgacagttattcagctgaaacttggagataggacagaccttgattaatatttggcaataattgtcagttctaatgttggaatttttgctctaaccttgttgattaagcatttaacttatttacatttttatgcttagggattaaaagtatgtctactttacatttatattcaggtatatatatatttttgttgttgttgttgttttttcttattattattatactttaagttttagggtacatgtgcacaatgtgcgggttagttacacatgtatacatgtgccatgctggtgtgctgcacccattaactcatcatttagcattagtatatctcctaatgactatccctcccccctccccccaccccacaacagtccccagagtgtgatgttccccttcctgtgtccatgtgttctcattgttcaattcccatctatgagtgagaacatgcggtgtttggttttttgtccttgtgatagtttactgagaatgatgatttccaatttcatccatgtccctataaaggacatgaactcatcattttttatggctgcatagtatatattcaggtatattttaaggcagtttttaagtatatcttttttctttaatagtacttacaaaaatgtaattatttgatatgacaaagctgcttcatattttcatattagcttgaactttccattgatatgtcaagcaaataaatacttagtttttttctgagtagaaaccaactgtactgcaaaccccattgatagtaaattaattgcagggatttaacatgtagggaaaccttaattattctgaatatacttatgttatgatgtgtagatgatttgtttactgtctttaatgtgactgagtcaaaatatgtgtagttatttgcataaaagggaagtgttgctaatatattttgcattacttaatgttatatataaaattaattttccttgtaagggatgtgagaaatttttttactcctcatttctgtttattctcatctatttctttgaaaatgtagatttaatttatttaaatactgtgtgatgaaaacattacagatatgttcttgctctctttttttttttgagacagggtctcactctgtcatctaggctgagtgcagtggcataatcatggctccctgcatgtcaacctcctgggctcaggcagtcctcccacctcagcttcctgagtgtttgggactacaggcgcgcactaccatgccgggttaacttttgactttttgtagagatggggtctcactatgttgcccaggctggtctcaaactcctggatgcaagcaatcctcctgcctcagcctcccaaagttctgggattacaggcatgagccaccacagccaatatgcttcattttctacctctgattataaattaaaggatagtattataaatgcttaattttataacctccaaatagtgatattgtattgctccttattgtgatggataaattataagacatatgtgtttaactggtttggtggcaagtctgtttacagaaatttgctgttaatttctcagttgttcacatgaacttatctgatttatagctttggccagcaatttacaaagaaagttcagtctgtagggcttcctgttgctctgagtgggggctccttctacccctgttcaacttcagtcagcccatggtctatagtatacctctcacaaggtccttatactgcagatcctctctgctgcagatgcttgggcttttgccttaagcacactggtgtaattagaagaagtagaaaagaagagaaagggtgaataataagagatgagaggatttaaaaatggttgaaacaggagttgtgaagtttgagtgtggtggatatggagatgtgcagccctgatcctccttcaaggaagaattgtggcccagttgtggggaggtcagtcatcagaaaaccttcagctgtctggcctacagaggacagccagaaaaaaaaaaaaaattgccttaagctgtcagctccttcaggctctacctcagttgcggagagcctccttgcttaaggtcacatcctttccagggcagcacttatcctgcaatcaagcaagacatgtttaaaggcccagccattttgttcaggcctgagacaactctgacaggtgatataccaccagagatctgccaggttgcttgaggctttgttgggcctgaattgcaatttgatttttccctctgcccaattcggctttcttccccaaatctcttcttcttctttttttttttctttgagatgaagtcttgctcttgttccccaggctggagtgtgatggcatgatcttggctcactgcaacctctgcctcccaagttcaagcaattctcctgccttggtcccctgagtagctgggattacaggtgggtgctaccacccctggctaatttttgtatttttagtagagatgaggtttcaccatgttggccaggctggtctcgaactcctgacctcaggtgatccacccgcctcggcctcccaaagtgctgggattacaggcgtgagccactgcgcccggcctctccccgaatttctttcacagggattgactgctaataaacatcatatacccaaaactacttcagtgtccattttcagagaatccagcttgcaacaggcaggcgtatcggcttcatgttgtcctaaaccttacgtaaagttctatgcaattttttttgtgaatttgcatttttcttaggaggtctgtggcttccattatcttctttaagatagacttgaaaattaaaggtttttctcatcaaggacttaagaaggaaaggcttaaacattttttttttgactcaagatcaaactaaatacacttggccattgaacaatatgggggttagtagtgctgaccctttgcacagttgaaaattgacatacgactttttactctcccaaaacttaactattaataatctactgtgtaccagaagtcctaccagtaacatagtctataaacacatattttgtatatgtattaaacactgtattcttacaataaagctagagaaaacaaagtgttattaagaaaatcatggccgggcgtggtagctcacacctgtaatcccagcactttgggaggccgaggtgggtggatcacctgaggtcaggagtttgaggccagcctggccaacatggtaaaaccctgtctctactaaaaatacaaaaattagctcgtggtggtggcaggcgcctgtaattccagctactcaggaggctgaggcgggagaatcgcttgaacctgggaggcagaggttgcagtgagcctgaaattgcgccattgcagctccagcctgggcgacaagagcaagactctgtcttaaaaaaaaagtcataagagaaaacctgtttattattcattgagtggaagtggatcatcataaagatctttatccttgtcatcttcatattgagtaggctaaggaggaggaggggttgctttttaagagggggcagaggtgattagtaggagaaaaattttaatgtgtgtatatatatatatatacacacacacattatatatatataattttttgtagagacagggtcttactttgttgcccaggctggtcttgaactcctgggctcaagtgatcagcctgcctcctaaagtgctgggattaccagcatgagacaccgtacctgactggaggaactacgtttttgatatggtactcagagaactgagtgcagtacagaagcttatacacccccttttttttatagggaagtggggaaatggagaatgtagacagttcttttgagggccagtaaatcatttaggtgggaggcagacattgtgggaaggtgagaggtgaagctgcaggttgtcttaccatgcagatgaaggccccctgggtaatctgttggagctgccctgggaagaatagatgaagtctttctgggcagtaatgatcatgacttccagcttcttctcatgtagtcgacctttcctgatcatttgatgagatccctaggaagggagtttaagacaattgcatttcttttggaaagaagcttttttgggctgataaggaaataccagagagagcccctctctgcgctggggtgggggacacgacaagttagagggatcttgattgtgaggcagcttctaaggcctttaagcatgtctaagtgccagtctttgggggtgtggtttgagagaccaaaatagatgcccctttattaactaggacagatcttaaggttaaggaaacaaagttacctatcggtagaaagttcagggccctgctggtgtggcaaatttctaaattcctatggctacaagaaaaatcactcttattaaactctctaacaataggagctttcagacaaattatcacaattctgatttacagcccagactactacaactctggacagaattcccaacttagaaacattcttttcttttcttttttttcttctttgagacagagtctcactctgtcacccaggctggagtgcagtggcacaatcttggcttactacaacctccacctcccatgttcaagaaattctccagcctcagcctccagtgcggaccactatgcctgggtaatttttgtatttttagtggagatggggtttcgctatgttggccaggctgttctttaactcctgacctcaggtgatctgcctgcctcagccttccaaagtactgggattacaggcatgaaccactgtacccagcccttagaaacattcttttctgataagctttatagaccttgagtttcaaccagctttagaggctgggcacaaattgtctttgcatcgtatagtttttatcttttgatgtaaagagccaaattccaccttattttaatgctaaagccccaccccaaagtgagcataggatgtatattacacatatgtttacccattgcacgtgcgctcagctcttctcgtaaatatgaatagctttcccctaaatctgctgaatatatatgattctgttgtgtaatatgggccctgtgaggcataaaacccaacctatccttcccctgtttgaagacagagcacctttggtttgcactggagactttttcttcgctggttgcaaacccatattcccagtaaagctctcctttctactacgtagcttctggttatcttttggatgacaggggtattgctttctgggccccaacactgggaagcagcacttaaccattgtaagcaaggagaagggtgtattaattttctgtttttcagataacaaattgacacaaatttagcagctttaaaacaatacccttttattatcttatagttctataggccagaaatctgatacagtgtgtctcactcagctggttctcagctccaggttttacaaggcagaaatcaagatgctgggaggatagtgtatgttcctttctggaggctctaggggtgaatgtttccaagctctttctggttgttagctgaattcagttacttgcagttgtaggactgaggttcccatttacttgctggctttttgggaagtggtgtttacctgtttaatctcagtggtgtttacctgtttaatctcagtggtatgtgtagttatatgggattgtgtgttttaaattgatctcttttgtacctttcctttctattcctttgatttttgttctttttcatctccttttactttctttgggtttatctattgttccttttcaaatatctttttttttttgagacggagtctcagtctgttgcacagactgcagtacagtggaacgatctcagctcactgcaaactccacttccccagttcaagcgattctcctgcctcagcctccggagtagctgggattacaggcgcctgccaccacacccagctaattttcctgtttttagttagagacagggtttcaccatttggccaggctgatctcgaactcttgacctcgggtgatccgccctcctcagcctcccaaaatgctgggattacaggcatgagccactacacccagcctttaaatatcttaataagaatacttagctcattcatttacagccttttttcatttctaagatgagcacttaagtctatacatttttctcagaataccttttttgtgtgacctggactgtgtgagatagttttttactttttcattttgaagtgttttaaatttcttttgttttgttttgttttgttttgtttttttgagatggagttctcactctgtcgcccaggctggagtgcagtggtgtgatctcggctcactgcaagctccccctcccgggttcacgccattctcctgcctcagcctcccaagtagctgggactacaggcacccgccaccatgcctgggtaatatttttttgtatttttagtagtgacggggtttcaccatgttagcccggatggtctcgatctcctgacctcgtgatccacctgcctcggcctcccaaagtgctgggattacaggtgtgagccaccgcgcccagctaaatttcttttatggtttctttttgacctgttgattgtttgggaattgtttagaaatacgggtttttaaaaagctattttttctttgattgtacattgtggtcagagaataagttccatgtgatatctatgcttagaaattttttagatttatattttgccagtacatgactacttttgtaatgttttatgtatatttgataaaaatatagattatctaattattggatgcagaaattcatatattccatatatcattatatgatccatacatattcaagcttgttaattattatttcctgaatataatctttgtttatttatatgcttgactggtcagtaatagaaaaatgttgtgtcaaaatctactgggaggggtggcgacgtagctcacccctgtaatcccagcactttgggaggctgaggtgggtggtctgcttgagctcaggagtttgagaccagcctgggcaatatggcaaaaccccatctctactaaaaatacaaaaattagccaggcttagtggcaggcacctgtaaacccagctactcgggaggctgagacaggagaactgcgtgatcctgagaggtggaagttgcagtgagctgagattgcaccactgcactccagtctgggtgacagagtgagaccccatctcaaaaaaaaaaattaaaaaaaaaaaaaaaaaaaacaaccctaaaacaaatctactgtgatgttaggtttgtccatttttttccagatttttttggcttgatatattttgagactattttattagatgcacatacttttaaaattactttgtcttactggtaatgtgaacttaaataattttgttatgatcctttctttcctagttgatcatcttttagtttaaagtttatctgataacaattacatgtagttaaacttctttcttttggtcaacatttgaccaatatgtcctttttccttctttcactttttttatttttatttttagagttggggtctggatatattgcccaggcagaagtacagtgactgtttataggcatgatgatagcacactacatcctctaacttgtggcctcaagcgatcttcccgtcttagcctcctgagtagctgggactacagatgttagccatcacactcagcttctttcacatttatacattaggagtccttttgctttttatatgtcttttataatagccattagttggattctttaatcttataatctttattttttaacataatgatttttgatttttgttcatccctcttgttcttggcttcataaaaaaaattgaggccagctgggcgcggtggctcacgcctgtaatcccagcactttgggaggctgaggcaggtggatcacgagatcaggaattcaagaccagcatggccaagatggtgaaacctcatctctcctaaaaatacaaaaattagccgggcgtagtggtgggcgcctgtaatcccagctactcgggaggctgaggcagggagatttgcttgaatctgggaggcggaggttgcagtgatccgagattgcgccactgcattccagcatgggtgacagagcgagactccatcttaaaaaaataaacaaaaaataaaaattgaggccaggtgcagtggctcacgcctgtaatcccagcactttgggaggctgaggtgggtggatcatggtcaggagtttgagaccagtctggccaatatagtgaaaccccgtctctactaaaaatacaaaaattagctgggcatggtggctcatgcctgtagtcccagctacttgggaggctaaggccagagaatcacttgaacccggaggttgcagtgagccgagatcgtaccactgcactccagcttgggtgacagagtgagacttcatctcaaaaaaaaaaaaaaaaattgagtgccttttacccagagcctcaccaacagaattgccaaacttttgattttttctttttttgccagtttgatcactaaatagtgatgtttcatcttacctcgaatttttttttttcatgagtgaagttgagcatcttgtttaaaaacatttgtggccaagtgaagtgctcaggtctgtaatcccagcaagttgggaggctgaggcagaggattgcttgaaaccaggaatttgagatcagcccaggcaatgtagggagaccccgtctctaaaaaagaaaaattaaactggtgtggtattatgtacttgtagtcccagctattcagaaggctcagggaggaggatcacttgagcccaggagtttaaggctgcaatgagttattattgcaccactgcacccaacctgggtgacagagttagactagatctcttaaaacaaacaaaaagtttacttttctcttttctgtaaaatgtctgttcatatcgtctctaccacacttatttttttggtgggattgtgtctttttagtgatatctgtgtttttttgttttttgttttttgttttggagccagggtcttgctcactgcaacctccaccttcctcaagcgattctcctgcctcagcctcccaagtagctgggactacaggcatgtgccaccatgcccggctaattttttgtatttttagtagagatggggtttcactgtgttagccaggatggtatggatctcctgaccttgtgatctacccgccttggcctcccaaagtgctgggattacaggtgtgagccaccgcgcccggccttaaacaagtttaaacacacacacacacacacacacacacacacacgttttttagagttggggcttgccttgtagcccaggctggtgtctaacttctggcctcaagtatttctcccaccttggccttccagatagtttggattatgggtgtttacccctatgcccagctctaaataagttttaatgccaaccatcacttctatttgtagagattcctaatgccacccagtgtaatgcttttggggctatggcagtgtaaatttggttttctcactgctgtttataattcagctttcttgggtctattgagttgatcactgcacctcactctgctttccactgtccaaaattttgtcaccattatttttttgtttttcttgtctttcagagttttagtgaggtttcaggaggaatcagaagttcatgcatgtattaagtcctttggttttactgaaagtttgacacatattttgaattgtagttattttgtctttcctaatttagatgcaaaattaagttgtctagtgagatactcagttaatcaagttgagatattaagggttacaaaaaggtttaccacactggtttatatacaggttaagtatccataatttgaaaatttgaaattcataatgctccaaaatctgaaacattttgtgagccgacaagagactcaaaagaaattttgaataaggtatactcaacttggataatattcatttgaagcatgtaaaggaaataatggctgttatgtgttatacacaaatgtgaagatagtgttgatttgatgctttacttttgataatgttgatctgatgccctggttttgatcacttaacagatacccatgtgctttatgggaagttgagttcttcttatgctcatgggctgagcccgaattaatccaaatcagtaatggtaattttatgccctctcccattgatttgatagtgagtggccttgagagccagttcattgggggaagttccccacttttttggtaaagaaacataagcaaggggaaggcagtctctcttatgatcctagacattaaattgttacttgcaactagtgtagctactttgaaaccgttaggggacaaaaagtcatcacactaaagatgacacaggaaaaacaaggaaagaacttaggtccatgatcttgatgaggcatcataaattacctatccctggagctgctgtagctctggactttttgttatatgagataataattcctcagattgacttagaataccaatcaaaataactattattttagctagctaagaaaaaaaatctgagtaaataccataaggttcagattacataaatatgaagatcaaaactgcaagttttctgagaagttagttattattgttttttactaatatgagctgcattggaaatttattttctttttaaaaaattattgctgtctttgtccataacttttatggacctgacattttagttgtttggaaaaattggtaattttaatcttttgttttggtatgattcaggttgacctgacattttaatacatctggctcctaggactgattaaagagacattttatttgttgaaatatgcacattttcttcatgaaattggttttcttttttatgtgtgacttttcttgcaaaagcttacaaggcacatgcttttgatagcagtgttacatttttaattaatattttagatgtaaaaggtgacagtttaaaagattgttttattagtgggttatccttaaaagcaagtggcatttggttttattttacaatagagtttaatcttacatgttttttgttaaagtaatgttaccaaaaaatctcttattgaactatttgtggtgaactttttaaggatgtttaagatttcacatgcagtttaactgatcacagatgaagttgtaaattaatacctcatgagcgtatttgactgcagggcattgttgtgaatcaaaaccgctttgttcctgtaaactgtgaaaggggtttaagcatatggattaaaattgcatggtgataccgaagtacttatgaaaagacactgtagttggatcatttaaaatgtactaaaatattacgaatagccataaaatataataattccctgaagcttttaagagtggtaagatttagttttatttctttgttggatttaactactttaataagaaattgttttgttgcttttggaactatgcatagtaatgagaataaccatgatgatgagaacactggaagcttcccagaaaacatgtatttcttcagaaatgttcttggttgtgacaaatatatatatgaagcttttccttgttcccatctgagtcattcccttaccagaacctttagaatgaaaggtttaatgatatcttctagtataagattatgaaatgagcattgtttagtgtaaaatcatatttttcttttgctgttaattttgtcttatagtatatgaaaatcacctggtgtagaatgtatttttcctgccataagaaactgtcaagaatctattgaaaaaataccatgagagtagttgttctggatgacaatggtaggttctgatttactgacgtagaagcaagcttcagttagccactttagtcataggtaaacactagattagcctaaggaaaaattgttgggaagcttttggagttctcatctgtgtcactgttttagatctcttcaagttctttgaaaattttggtacctccctgtttaacaaatattctgttttctgctatctaattagttctcatgtagatgacgtttctaatactaattaccacactttcttggactcctcttttataacgacctttatctccattccatttgatcaactgttttttaggactatgttctgaacctacttcctacccaggactgctttaaaaaaagtaatctatgttagcttcctgtttggcttcttcctagtttgactttactctctatatacagcctgagtggcatgctcggttatttcagctacatcttaccattactcagttctctctcccttttgaccttgctggtttctaaatctgggtcaatttgtgtgccttgcttcttgacttgatattacaattaacttattttgtcatactagatgttttcagccatctttgatccccaggttgctcaccaactcttattatcctttgaaatgactctcaaatcttacccctctttttgacttttatgtttgttgccctcatcttcatcttttttttttttttaatgagacggagtttcgctcttgttttctttctttcttttttttttttttttgagacagagtctcgctcttgcccaggctggagtgcagtggcgccatctctgctcactgcaagatccgcctcctgagttcacgccattctcctgcctcagcctcctgagtagctgggactacaggtgcccgccaccacgcctggctaattttttgtatttttagtagagatggggtttcaccgtgttagcctggatagtcttgatctcctgaccttgtgatccgcctgcctaggcctcccaaagtgctgggattacaggcatgagccactgcgcccagctcgctcttgttttcttgttgcccaggctggagtgcaatggtttgatcttggctcactgcaacctccgcctcctgcgttcaagagattctcctgcttcagccttctgagtagttggcattacaggcgtgtgccaccatgcccggctaattttttgtatttttagtagagacagggtttctccatgttggccaggctggtctcgaactcccgaactcaggtgatccgccagtcttggcctcccaaagtgctaggattacaggcatgagccaccacgcctggcaaattctattttttttttttttttttgagacggaattttgctcttgctgcctaggctgtgcaatggcacgatctcggctcaccgtggcctctccctcccaggttcaagtgagtctcctgcctcagcctcccaagtagctgggattacagacgtgtgtcaccatgcccggctaattttgtatttttagtagagacggggtttctccacgttggtcaggctggcctggaactcccaacctcagatgatctgtctgcttcggcctcgccaagtgctgggattacaggcgtgagccactgctcccagcccttcatctcttacattaggtgccatagcactcacctctgtggctctgtttcttctatcccaacagcacatgagggattgggtccccttccatctctccaactccctactcctactaccacataaattaacagaaactccctttagtagtaattctcaaatgaggtgccaaatcttggtctgtatggaatgtgtatttggttttaaaaaaattctaaaagtgattctcttctgaggtcctaaagggtcttttgcaggacttcctcaaattcgtcttttacaatgctataggagtcatctttgtcaaacatagatttactcattttacaactgtgtaacaacttattttttgccaagtattgggatagctactggagttagtaaagtgaatattagggtgcttacttttgagaaaaatgctaataatatagtatagccatcatttactggaacttttttaagtgctaggcacttcatgtatttatccttataatagtccttcagtgtagatattattagccactgtacagatgagcagccattctcagaattctgaggactcacatagtaattcattaggcaagtgataagctttatgataaatacttgaaagggacctctaagagcatagaggagggatatctagtttagagttggaagattaacagaataggcttcacagagaagatgatgtattaagctgagtatttaaagacaagtaggaacttagacaaaatgatagattggaaaatgagtgtgtggcatggttatatttgtgaatagtctttgtacagagatataagagaagcattttatgagaacacctggtgctcacttaggcaacacatatactaaagttggagaacagctcaatatgactgaagcatagtatgtgagatggggaatttagagtggtttagatataaagacattaaactaggttgtattttatatatttatacatctatatctatatatctatatctatatgcatctgtggtcccagctactaaggaggctgaggtgggaggatcgcctgagcctgggagatcaaggctccactgagccgagattgcaccattgcactccagcctgggtgacagagtgagaccctgtctcaaacaaaacaaaacaaaacaaaaacccagttagactgctggaatagtccaaataagaaatcaggaggccttgaaacgtgtcagtgggattaaagaggagagaggtggaattgaaggttatctggtaggtgcaatcaacagacttagtggtttaaaaagtgagtgagaggttatagtcaggttgggactatgtattaatcctttatttttttaatttactgtactgtactatgtattattgttaatatcctttatttcagattgacatatacccttaaatattcttaagatcatatccttaaggtcttaatagtctctgaataaatattggtataagctgcttcctaaatgatttcccatttatttactggtgtttttatatatctatttagagactgaatctcactatgttgcccaggctagagtgcaggagcatgatcatagcttactgtaacctcacactcttgggttcaagtgattctcctgcctcagcttcccaagcagctaggactacaagtgtgtgccaccacacctggctcattttttaatttttgcagaaacagactcttgctatgttgctcagactggtctcaaactcctggcctaaagcgatccttcagtccctgcctcccaaagcagtgggactgcaggtgcgagtcaccatggctggcttgaggagtgttttttaaaacatcctggccaactgtgagcattgagacatcaatttatcaaggctttactgagtgctcaagggcccaggcacattctaagtcctggaagagggagcacagtggaagttctaggacttagctatctagttaaatatcttcagtttaaacagatttactcattttacaactgtgtaacaatttattttttggcagtttctgaacttccagttttcacgttctctagtattgacaacaagctgataatcttgctagacacaacagactcttgaggaaggaattattcattgtggtttatagacaatgatatttgaagttaacttgccccagggcaggagtatggttcttatataatgtaggaaaaggccagtcaacaccagacctcagagctaccatttaatgcattgtggcaaatgattcgcatgtattatcacacttaatgctcacaagaatactaccatgaaatagttaatatttaaaacaaatttttttattttttaaggagactgggtctcactatgttgcccaggcttgtctcgaacccctgggctcaagtgatcctcccacctcagcctcttaaagttctgggattacaagcatgagccaccgcgagtggtctttatcattattatcgctgttttacagatgagaaaactgaggcacagagacctgcttatggtgacacaagtaggaattgaaaagatgagatttgaatctagctggtctaatttatcctgaagttcaagatagcaatacaagaattatgaacatataaatggagtgagtggatatgatcgctcaagataaatctcttggccgggcgcagtggctcacacctgtaatcccagcactttgggagactgaggcgggcagatcacgtggtcaggagatcaagaccatcctggctaacatggtgaaaccccctgtctactaaaaatacaaaaaattagtggggcgtggtggtgcacgcctgtaatcccagctactcaggaggctgaggcacgagaatcacttgaacccaggaggcggaggttgcagtgagccaagattgcgccactgcactccagcctgggtgatagagtgagactccgtctcaaaaaaaaaaaaaaatctcttggatgagaaaactagacttaggatttaaggaaatctacgttaatggactggccagaaaaacaagtcataaaggaaaattaggaagtaatcatgagagagggggatgttatgtcctattacctgaagcagaaatataaatggaaaacatatcagtgttattaactgaagggaaaagaaaatataaaaatatatctgttataaaatatattctgtataaaactcgaataccagattgttgtttgcattgacgttgcctgtaatcccagcattttgggagggtgaggtgggagagctcaggagttcaagaccagcctgggcaacatgatgaaactccatctctacaaaaaattagctgggcatggtggtacatgcttgtaatcccagctactcaggaagctatagtgggaggatcacttgagcccgggaggttgaggctgcagtgagccataatggtgccactacactcctgcctggggcgatgtactgagaccctgtctcaaaaaaaaaaaaaaaaaaagagaaaaaaaaatttttaagtacttttttacttagaacctttcaaatgccatgttatgtgtctttatatacagaaaccctgggcaaagacagtatggctctttttttaagaattaggagacatgagtgtaaagcatatttgtaaataacgggcaataaaattaatgcggaaggtttggcttacattatttggggagggaacatataaaattcaatattcaaattgttacatcaacttgaagtacagtgaatcatgactcagaaaatgtatgaagatgagacaaggtagttgcctattggaatcttaaatgatacttttagtagagatcatgtaaatctgtgttgatgttaaagaaaagtgaacataggctgagcgcagtggctcatgcctgtaatcccagcacttcgggaggctgaggcaggcggatcagctgagatcaggagttcgagaccagcctggccaacatagcgaaaccccatctctaccaaaaatacaaaaattagccaggcgtggtggcgggcacctataatcccagctactctggaggctgaggcaggagaatagcttgaacccgggaggtggagattgtagtgagccgagatcacaccactgcactccagcctgggtgacaagagcgagactccatctcaaaaagaaaagtgaacataaacttttaaaacttcattacagagtaaaaagtcttattacgtttttctggccaaaatttataaacttttaaaatatttcagtgaagttgagctatattagaggtatctctttatgtacctctggaatggaactttgataactgtttattacagtagaaaataggatctaaaatgggtaagttcattatttcactttgctttcttaatattcatggaaggtattttgccgaaattatttttggagagtatatgaaaagtaagtaatattttataaaactgtattgcagctgatttggagaatgagtggctactttgaaaattgtcagtagataggaaataaaaataacagaatgaagcagctcacacacttcagagtttattctcaatattgttgaattgggccataatgaagcataatgcctggttaaactttattgcaattcaaacatcccaccagaaagaaatttttaaaaactatatcaacaaataaattcactgaagtctgtctatagcttcttctaggaactacaatttatttatttgtttattttaatattgttttttgtagagacaaggtctcactttgttgcccaggctggtcttgaactcctgggctcaagtgatcagcccgcctctgaaagtgctgggattacaggcatgagccaccgtacctggctgaaggaactacatttttgatatggtactctgctttaaacgcagtaggtactctgctgaattgggctaaataaacatttcacctctcaaaactatgtgaatatttggcttaagcaaagatagcctgggaccatgaagaaagctaaaacacttaaaaaaaatgtacccttatttaaaaagtagcatgtttctttctgatttggagtgttatgtttttgttgaaaaattggaaattacataaaaccaaaatgaaaaatatagagatgatcagtaatttcaccatgaatataatactcctcttatcattttgtattcccttccaactaatttttctcttaaaagtggcactatgtttttgaaaaagctgactactttaagaaaatttctctcagtttactttcttaatcgtgtgcttttctgaagagttggctctgacgttgactactatagtaaatccaattttgatgagtttttcttttttagtgggccaaaaaaaaaaaaaggaaagaaaattctcctttgtagaaaaaggagggaggatggaatgtatattgtagtacacctgaaaatccataccttttcttagccatatacacaattagtttactctttctcaagataatatttttatagtaaattaggattctttgttacaagtgatgggaaaccaaactagtgctatgctaggttaaaaaaaggaatttagggactcaagtcactaaactactcacgcgcacacacacacacacacacacactcacacacactcacataggggttcaattgggccttaggaatggctaaatctaaggtctcaaaagctgtcagtttttttccttcggttcgttctttgtctctgagagttagcttcactttgtcagcctgcttctttatactcttcctgtttttcactctgacttactgtgtttataattatcttgggttagtttttcttattgctcatttggaaaaactatcagtacttctgattagtaatttcagatgtttttatattttaattttgtatgcaaaataagtatccgtgatattttaaaaatatttactaagtatttccctagtctttctctaaagggtaatctcaaatgaaacaactggaactggattctcatttgtttaatgactgaagaagtcttccaattactctacaaaccattgataacttttgttatttgtgaccagtattcatctagtaagatgttaaatgcttttatgaaagagacaagtgttttacctaaagaatgagaaaaaaaaaaccctaattttttgtgaagttttctccttttttgctgagtgcttaaagaaaaaaagtttatgttgttttaggtttttcttcttgcttatcaccctaggaactaattgtgttactttttaaatgtttaaatttaatttttcctgtcccttccccatgcttgctaattatgttttttaaaggtgaccctttaagatggctcttatagaataaagagagacactgaattttctaatcttgtggaagaggttatatttagccattggtattttaagttggagcacttcattctactgtgcctttagtttatgagtcatctggagaaaatgggctgcttcttgcttttaggaagagtctgtagcaaataataataataagtgctatgggagattttttgccaaataatttaaaatggaaaatgttttgtaatatattttattgcccatatgtaaaatacgtactaaagaatataggagtttttggctcattattatctttagctcataaaaataaacaaaagaggctgggtgcggtggctcacgcctgtaatccagcactttgggaggctgaggtgggcggatcacgaggtcaggaaatcaagaccatcctggctaacacggtgaaaccctgtctctaataaaaaatacaaaaaattagccgggtgtggtggcaggcacctgtagtcccagctactcgggaggctgaggcaggagaatggcgtgaacccaggaggtggagcttgcagtgagctgagaccgcaccattgcactccagcctgggtgacagagtgagactccgtctcaaaaacaacaacaacaacaacaacaataacaacaaaaccctaatgtcacatataacaaaaagaaagcattttctaccaaaacattatatagattgttatgagttataggtaagtggaaagcaagcataaaccatatgaaattattttatatgcaggatgtacagcagtggtcaaatcttaatgataattgtcagtaactggggagaatattgtgattattgaagtattgattttttttcaaatatttttatattacatgtggtaactttttataatcttgttttatatctactttagtatgatagctttaccatactagatattctatgaggggtagacagttggcaaaggatgtgatattgattctaattttggctacctttgtattatgtgtatcataatgatttcacgcttcagttttctcatctgtacagtattttgttcttcgtgacttttcttgcaggaatgaaaggaggtagcatggaacaaagaaaaaagtgtatcatattgtaaaacaggaaattttaaagtcctagagttcagattttaaatccaagatgtcatttttgaggtaaatttgtcaggtctccctgggacacagaatgactgcatcactagaatcatgagcccgtgggattgtttttttctttttctcaaatgtatttatttaacatctctctccctctctacttacctacctgcctacctacctacttacctctgttgtgaaacttttgggagctcagtattgtctactataccaagaataccagtcctttactcatttttttgcattacaaagatcatatggaatatactggaggggaatttaggtcttttggttctgtgttagaagagcccattttgtttttccctgcatgtggtagtcggtgtataggcctgtttctgtgatgggaagatgacaccttttgtcaaatctctatcctttttgtatgtcaaggaatcatttctttgcagtgaagtagagtgtgccctgtagtatagcactctgtgtccttagtcatagcaatattggaggattggagagttaatcatgtttgagaagttaggggacttgttctttcagcatctatttaatgaatctgcttgtatttttgatatcctaatgtgtcccaacactgaactcctaatctttcctctaaaacctgttccacctgcagccctctctatttcacttgatggcagttttatccttctcgttattcaggataaaaacctgagactcattcttgtttttcctctttctcttatatcccacatctaatccttaaggaaattatactggcaccacttgtgaaatatatcctgaaatctgatcacttataccatctaaatcgctaaagtcatctgtacccccacctctcttttgtgccaccatcatcctttgcctagatttttgcagtagcttcttagttactttctttccacctttgctgccttcaatatcttgtcagcacaacagattggcggacattttaaaaacgtaagtcagataatgacactctaataaaaatgagaaaggtttaaaaatagtaaagataggaagcctggacaacatggtgaaacaccatctctacaaaactagctgagtgtggtggtgcatgcttgtggtcagctactcaggaggctgaggcaggaagattgattgaacctggaaggttgaggctgcagtgagctgtgattgtatcacttcactccagcccccgtgactgattgaaaccctgtctcaaaaaaaaaaaaaaaaaaaaaaaaaaaaggaaatattatttgcaggtgaaatggttgtatttagaaacaagaacatttaagtggcaggtagttacagaattgatacacacaaatatattttttatacttttgtatgtttaaaaaagccacaaattacaaattatgttaacagcaatataaaaagaatgaaacatgagtggggtttattctaagctgagttgttcaaaattagggtatctattaacataatttacgatgcttctcagagggtttctgttgttcactcagtgactgcagacccactagtactaatgaactactctcttaacttgttattgaactacaccttctccaatgagtctgagtctttaacattgcatactcttttaatctgccttggggtactatatagagctttcttatatcttatagttactcttttattagagttaaaatacttctttatgttaaacttctgtttaccttactctgtgatttatatcttttgattagaaaagactaatgtaccatattagtaggtttttggataaatttttatattattttcatagatgctagaagagcatttgccaaaattcatcattgattcttttattaactttttgtgaattaaagtataacatacatagaaaggtataaaaatcataagtgtacagctgaaagaattactgcaaagtaaacatacttgcttaactaccatttagttctagaaatagaacttggccagcagcccagaagcacccctcacccccaccttcttccccaaaggtatcttctgtcctgacttctaacattggagattacctttgctgttttaaactttaaatatatggaatcatatagtgtgtactttttgtctctggcttctttggctcatcattataagctttatccacattgttgaacatagcagtgcttttgttcattttcttttccatgtcctattccatcatatgaatttatctcagtttatttttatattctactgttgatgatgaatatttgggttgttactagtttggccatattacaaataatgttggtatgtgaacattcttgggtgtgtcttttggtgctcatatgcacatatttcttttctttctttttttttttttttgagatgaagtcttgctcttgttgcccaggctggagtgcaatggcacagtctcggctcattgcaacctccacctcccgggttcaagtgattctcctatctcagcctcccaagtagctgggattacaggcacacgccaccatgcccagataatttttgtatttctggtagaaatggggtttcaccgtgttggccaggctagtcttgaactcctgacctcaggtgatctgcctgccttggcctcccaaagtactggaattataggtgtgagccaccacccctggcccaaagtgttatctttagaacagcagaaatgggagttccagtttttccactgttattttctatcttcagacaaacaactgtttagttatactggtaaactggcagtggtatatcattgtagttttaattgtatttccttgaccatgaccactaataaagttaagcttttaaaaatttatttatatgttgatcaattagatatacttctttgtgaattacttaagttttttacccagttttctattgggtgtttaagaatattttatatttatttatgtatttatttttgagacagggtcttgctccgttgctcaggctggagtgcagtgatgtgatctcggctcactgcagcctccgcctcctgggttcaagtgattctcccacctcagcctcctcagcagctaggactacaggcgtatgccatcatgcctggctgatttttgtattttttgatagagctggggtttcaccctgttggccatgctggtctcgaactcctgaactcaggtgatctgcgtgcctcagcctcccaaagttctggtattcatctgcaagccaccacgtccggcctgtttaagaatttttaatgaatttggctggatgtggtggctcacacccgtaatcccagcactttgggaggccaaagcgggcagatcacctgaggtcaggagttcgagaccagcctggccaacatggtgaaaccccgtttctactaaaaatacaaaaattagccgggcatggtggcacgtgcttgtaatcccagctgcttgggaggctgaggtgggagaatcacttgaacctgagaggcggaggtggcagtgagccaagatcactttattgcactccagactgggcgacaagagcaagactctgtctcaaaaaaaaaaaaaatttttttaaatgaaaaatctctgtactcagggctatgacactttttggttggcatatgtctttttggacttgttctttcattctttaaatggtgtctttgatgaaccgatgttcttcattttaatatggaccctctttttggtgttcctccctttttttagttttcagaagatattgtctatgattggttttacttctattggttttatttcttaaatgtttggtggaattcactggtgatacccttgaagcctggagttttctttgtaggaatgttccattaaaaaaaaaatacttaaagggctttttagattttttttcacttcttaaatcaactttggtaaaatttctttttctaagtatttgtacattttgtcttaagtgttaaaatgcgttagcataaccttttccctacagtatctttctgtgatttttaaatatgcatatgacctatcatttctgctaatgattatttgtgccttctttgtaagagttcatcaattttattagcgtttcaaagaactaactttggctttgttggttctctgtagatcatgatgtatgttttctatttccacgtatttagctccttttttttttttttttactttctttgggtttcatttgcagtttttttccttaccctaaccctacagttgtttttaaaaaaagattcttgagatggatacaggaccatataaaaaattttttttatgcatggcaagaagtttgcataaagtcagaagacaaattacaaacttgtaaaaaaattatttaataccaattacatcaaagtccaaggcctacttctttaatatgtagtgagtttctaaaagtcaataagaaggaaataattatgtattaaaaatgagcaatgtttgtgaagagttgatgtgtagaaaagttaatattaatggcagtaaaacatatgaaaggatgttcatcgtctcatgaggaattcaaaataaaccttctattattaaattggcaagtattttaaaaatcagtaataagtagtatgggcaaagttatagagaataggcgctttcataagctatcataaggatataaattgctacaacctctttgaaggagaagtttacattatttatcaaaattttaagtattcttttttttttttttctttttttttgagatggagtcttgctctgtcacccaggctggagtgcagtggcgccatcttggctcactgcaagccccgcctcccaggttcacaccattcgcctgcctcagcctccggagtagctgggactagaggctcccgtcaccacgctgggctaatttttttttgtatttttagtagagacggggtttctccgtgttagccaggatggtcttgatctcctgacctcattaaccgcccctctcggcctcccaaagtgctgggattacaggcgtgagtcatcgcgcccggcccttaagtattctttaattcacgaactatgtgtataaagatgtttatttccatattacctataaaagccaaaaaactagacataacctaaatgtttattctagagactaggttgtagctacccaatggaaaactatgtagccactaaaaggcaatagactgttggtactggttgttacagaacaagctccaggaaagtttttttgcagaaatacacattttattaaacgagtttgtgggtgaagtgtttgtattttgtgtgtgcatagtaagtttctgaagtgcataactttgtgtatctcactaggtaaatttgagtgttgtatttatggagttggatttacaacatctggtatttactattcagtatcactttaggttatgtttcgttttctcacttatattgtaagctcatagaaaatggaagatatggactgtgttttatgcttcataattttctccacattgcctagcatagtatattgagtgtgaaacagacttggtttttaaaaaacaatttaagaacaaatttaacactaaatatttgttttccagtttcagaacctgttcacattatctttggtgagctgtattgtagctctctgtagtagataggtataatactcattaatttattcatatgttaccatagggcgaactgagcccaagtgaataagtgagttatttaaagtaggggttggcaaactatgagctgtgggctaaatttgtcccacctcttgttctttatggcctagaagttaagaaaggtttttatatgttttaatgtttgggagaagaaagcatattttatgacacatgaatgttatatgaaatttaaattttagtgttcataattaaagtttattagaagacactgatgcatattcctttatgtattgtctatggctgccttcccaccactatggcagaattgagtcgttgcaacacagattggagttggcattttcattgcttcacactgctgcttggcatactacacatctcagtaatgcagttataattcaacagtgtttcaagtgccatatgtattgctgtgctataacactgtattttttttttattactagggcatacctatatgtcaaaacaagaaaaggagaaaatctcatggttttaaagcacagtggactggggattattttatccaattagatggtaaagcattaggtttattatgcccttctaaagaaatagaatatatattgccattaccaggctaagcacttacagtgttccaaattcataggaacataattctcataaaaattcaaaaatttgaaatgtaatatgttacaacagcagaatttttcatgcactcactttttctctcactcactctcacactgaaaaggaggctggacttaatataagattttgaatgacccatttgttagcaaagcaaggagagctatttactaatggtaagttagtaaattttcattgtagcagctaaagaatattttcagaaaaaaattacatttttaaaaatatcattagccatttggtgaccatagttgctttaagaattgaggacattaggctcgttgcagtggctcacacctgtaaccccagcattttgggagtctgaagcaagaggatcacatgagcccaggcgttcaagaccagcctgcgcaacatagtgagaccctatcttttcaaaaataaaaataaaaagagtattgaggattttaggccaggtgtggtggctcatgcctgtaatctcagcactttgagaggtgaaggtgggagaatccacttgagccctggagtttaaattcagcctggacaaatggcaagaccctatctctaccaaaaaaaccccccaaaaaaacaaaaacaaaaacaaaccagaattgaggacattagccaggcatggtggtgtgcacttgtagtcttagcttcttgggaggctgagatgggaggatccgtttgatcccaggagtttgagttcagcctggggagcatagcaagaccccatctctaaaataaaaacaaaaaagtgaattgaggacattgggtgtaacatcggtagtcagttaaagaagatagtggttttacttggctctgatgaaccaacagatgttactgacactgatcagttattcaaagagccaatgctgagtttgaagtgactgaaaaattagctttcatgaaaagtcgatgaaacatctgcagacgtgaatattttcaaaaaatttgagaaaacactaattcagcataatctgaagtagaatctgttaagatgtgttgctactgatagtagtaaaaatatatgtggaggccgggcacagtggctcaagcctgtaatcccagcactttgggaggctgaggtgggcagatcacttgaggtcaggagttcgagaccagcctggccaacatggtgaaaccccatctctacttaaaaaaaaaaaaaaaaattagcagcgtgtggtggcatatgcctgtaattccagctactttaggaggctgaggcaggagaactgctcgaacctgggaggtggaggatacagtgagctgagatgatgccattgcactccagcctgggtgacacagcaagactctgtctcaaaaaaaaaaaaagaaatatatatatatatataaaatatattaaaatacatatttatatcataaactttgtagatttctccacttaacctttttgctccatatatattttaaatatacattatacatatatatggatcagaaaaaagggttaattggagaaatctacaaagtttgtgaaactataaggttgtaaagcctatggctattcattgtattatttattagcagctattttgtagacaacatttgaatctatgatttattatttgaatatcatttattattgaaccagtattatcaacagtgaacttcatttgctgtatgaagagatagttctgtaagtttttatcagaaatttaagctgtatatttgacttgcctgaccacccatcagtttgattactgcagttgtttgagcttatggtcaagattcaaatttttctaaacaaggagaagctccttcaactactgttattgcatatgaaatggctttgaaaattagcttttactgaagactttatattgtttcttttctttcttcttcttcgtcttcttttttttttttttagaaacaggatcttgctatgttctccaggttggtcttgaactcctggactcatgtgatcctcctgcctcaagctcccaaagtgttgggattataggtgtgagccatcatgtccctggctaatacattatttcttaatgatactgatattgttgttgtttgtttctttctttctctctctctctctctccttgtttccttccttccttccttccttccttccttccttccttccttccttccttctttccttccttccttccttccttccttccttccttccttccttccttcctttctttctttcttctttgtctcttttctcttttctcaacagggtttcactctgtcacgcaggctggagtgcggtggtgctgtcttggctcactgcaacttccacctccctggttcaagcaattctcctacctcagcctcccaagtagctgggactacagcctcatgccaccatgcccagctaagctttttgtatttttagtagagacaggatttcaccatgttgaccagcctggtctcaaactcctaatgtcaagctatccactcactttggcttcccatagtgctgggattacaggtgtgagccactgtggcagcctttatatggtttcttaattttgaggcataccagtgcttatatgtaaaacttatactatggtaaagttatttgacagcagctaatgtagtttgaatcacaagtaatgtcaagctgctttatatacaatgtcccattctgtcaaaagttaaaacaagaagtgatacttctatttccacacacatttgtagcagatgtttgtgggctcaaactatagttttagcaatattgatgccagagcagagataacttctttatttcaaaatccatctaacactgcaatcacggagcttctaccttatgttacattagaagtgattaatctgcaatctacatgctaaaggggaaatatcaagaaaaagctctgatagaattctataaatgctttctaagtgataaatatgcttaatttaaatcatatgctattggatttatatcagtatttgggagtatctatttgtatatagagacattcaaagttgaaatatgtgaaattattatagatcaatgttaacagatgaatatttgcgatcaattttgattgataacagtaactttggccaggcacagtggctcacacctgtaatctcagcactttgggaggccgaggcaggtggatcatgaggtcaggagttcaagaccagtctggccaatatggttaatccccatctctactaaaaatacaaaaaattagctgggcgtggtggcgtgcgcctgtagtctcagcttctcgggaggctaagacaggagaaacgcttgaacccgggaggcggaggttgcggtgagcccagattgcaccactgcactccagcctgggtgacagaatgagactctgtctcaaaaaaaaaaaaaaaaaaaaagtaactttaaacaccaattaaatgaaatgttatttcccctaaaagaattacattcttctcattactaaacctgataaacaaaaaattttattgttattaatattcctaaatttgtcagtaaaagttttttgttttataagtacctagataatgtccttggtttttttctcattacccatagagcccaaactatttactacctggccttttacaaagaaagctttctgaccctcatcttcttctaaaagaataatagatgtctaattagaaaccagttatgcattgggttgagtatcctttattagcattttaaagttcttgcatttcgaaaatactaaaaatactcaaatttagaaaagttagttgtcttcataatgtaatttaaatgtttgaagtgttacaaaagagattcacctgcaattaaatatcagcagagtgtgtcctgtacccttatcctgcaacacttttctcctatagtaactgaatgactttggaattcagggctttgtatttttacctttttttaaagcttatttttgctttcttttcttttctgttttttttttgtttgtttgtttttttttttttttttttttttttttttttttttttgagatggagtcttgctctgtcgaccaggctggggtgcagtggcgtgatcttggctcgctgcaacccctacctcccgggttcaagcgattcttccacctcagcctcctgagtagttacaggtgggaccaccatgcctggctaattttttgtattttagtagagatggggtttcaccatgttccctgggctagtttcaaactcctgagctcaggcaatcagcccacctcagcctcccaaagtgctaggattataggcatgagccactgcccccagcctgtttttgctttcaaatggactgttgatggttttctcagagtgctttacttttgaagtccagtttgtactggaaagaatttatattccaggctgggcacagtggctcatgcctataatctcagcactttgggaggccaaggcagatggctcacttgagtccaggagttcaaaaccagccggagcaacttggcaaaacctcgtctcttaacaaaaatattttaaaatgagctggttatagtgctgcatgcctatggtcccagctacttgtggcactgaggtaggaggttggcttgagcctgggaggcggaagttgcagtgaacccaaatcgtgccactgcactccagcctccattacagagggagagcctgtctcaaaaaaaggaaacgaatttatattccacattttactgagtctagtgtgagtttttgtttaaaaaaaaacaacccaggaataatttcttcaaattcataagcatggcaggcagttttattttaaattctgtgggaaatatgaatttaaggatctcatgtaccatgccttgataatcatttctctgtaatgtatattttggcaaatgatattgttatgaaacatacttttgcattaatattaactttatgcataataaagatgcatcttcagttttttgtttgtcctatgagagtttacagctggggacatcttttacaaaagtatatttataacctgttcagaagatatgaaacacaataatgagataatcacctatgtatttttcagttagcagttacaaaaggattattgacacttatagttgttaatatctcagtaaaaacatactcttgtgcttattttaaaattgaacgctagtctatatttttaaagtttccttttatggaatattttgtcttttggcactttgcatctggattatagttcccccatttaagaaagaaacctgtttctattcaataggattaaaaacacactttcagttttagagcagatttatcatctacccttcaggctattctttaatatggagctcttaaaaatgagtatattaagatattccccagatgttttaaacttcagcaaacttgtggttttctttatttgtagtatttggaagatgaaagaaagtatctccagtatctaaacacttttcatattggttttaatgttgttttttttttttttttttttttttttgctagaaaggcatgcacaagataaagcttctacactgataaattttcaaagtccttgcttttaaaatatcaagctgggtgcagtggctaacgcctgtaatcccagcactttgggaggctgaggcgggtggatcacctgaagtcaggagttcgagaccagcctggccaacatagtgaaaacccgtctctactaaaaatataaaaaattagctgggtgtggtggctggtgcctgtaatctcagctattagggaggctgaggcaggagaatcgcttgaacccgggaggtggaggttgcagtgagctgagatcgcaccattgcactccagcctgggcaacaagagtgaaactcttgtctcaaaaaaaaaaaaaggtattgtcaaaatgagagttgtattagcagtaatgtaaaagtaatattgtatgtctgtatacttttgaatttacattgttatgtgattcatatttgttttgtatagctgtaacatttggttaattgtttagtgggttattgaatagattattttcttcattacttagtacagtggggattgagaatgctttgtatcaagtgtcttacaagtattgggaagttcgaattaaaaatattaaagatgtcagtcatttacttctttttttttttaaggtggtagcccaattgaaaattttctgcaaaatcagtaactaagttatttttccacaattataaacttagttgatggcatttattgagtgcttactacgttcaaggtaaatgaaatgaaagagtggaatagtgcattatacacgcacacactcaagggaagcaagtataaacaccttatttcatctcacttgtttagaaatttgattttgttttttcttgctgggtaacatatctgtgttaatcgaaaatttatgacttagagtggaatttctctaaaaagcagtaggtgacagggatacaagataaataatttcatcagagaatagaaattcttttttacaatggataaaattgtgcttgtaacagggatacaagcacaaaccaaatcaatgtttaattattttaaaaatattcaagggaaatctagttttgttaaaatttgtataggttggtagtgtgcatgttcttaaaaatccaagaacaatagcagcagcaattcttatttaatctttctttagtgtgtccattcaaccattcattcatcaatttttttttctgtgtacccattattcatcaggcactatgcttaaatatcgtggaacacaaaaagaaatagtctttaatgctgtgttttacaaatgaggaaacctaatctcggagaacttaaattacagttgtcctttggtattcatgggggattggttccgggaacttcctcagataccaaaatccaaggattctcaagtccctgatataaaattctgtggtatttgtatataacatatgcatatcctcccatgtactttaatttctagattacttataatacctaatataatgtaaatgctgtgtaagtagttgttatactctcttgtttagggaataatgtcaaggaaaaacactctttacatgttcagtacatatttttccaaatattttcaatctgtggttggttgaatccatggatgtggaacatacggatatggagggccagccgtacttgccccatgtcatataattagatgaatatagaattaaagccaggtccgtctgacagagcgtttgcttctaaccattgaggaatgttgcctaccctgatgactctactataggaaatcatatattgatatcaaattgatcttatatgtctgtagtgaggaacttggccatgttggacctatccccttccctccttgctcctctcctttcttcctcccttacccccacagcttcacccctcccttagctcttttttctgacaggtggctgtttccatccctgtttgctggcaccttctccacttaaattttggtatatcccttggttccactctctgtgttcttctcttgtgtatgagtgtggattttgtgtttgcttatcctgtgtggagtttctgagcttgaatctgttaagagtatgtcattaatcaaatttggaaatttttaagccatttttttttctttctttcctttccttttccttttttagaagcaggttcttgctttgtggttcaggctgcagtgcagtggcacaatctcagttcactacagcatcaaactcttggactgaagtgatcgtcctgcctcaacctcctgagtagctgggactacaggcatgcatcactatgcctggctatttttatttttttgtagaagtagggtctcactatgttgcccaggctggtttcaaactcgtgggttcaagcagtcctcctgctttggcctcccaaaatgctgagattatagttgtgagccaccatgcctggtcaagccattattttttcaatttttttttttctgcaccgcacttcttttcttctgttactcatgcacaaatttagatcttttagtattgtcctataggtctgagtcttttttcattttttaaaaaaatcctttttctgtcctgcagattggaaaatttttattgatttatttttaagtatactgattaacagtcttcttcattttactattaagcccatctagttagttttaaatttctagttattgaatttttaaattctaatatttttattttatcttctttatcttctgtttctttgctgagtcttttcactttttctagctgtctgaagagtcctagtagtttgtggttccctggagctctccgccttggtaatccagccagagaactggggctttattttctcagctctgcacatacttcctgtgactgtaaccatgtctgggtctaagtagtaggcagatactcttctcttgcttttttctttcttgtgttttagtcaaattattttacctcttattataactttgtttattattatttaccaacactttatatgcaaattgtagattattcagattgtatcttctaccagagtgttcactcttttctgtatgaggctgatacggagtgaggggagagcttattaccttaataaaaattaagggttaagctaggtcaaagttgatttttcagtgttgacagttcagttgagcctgtttgcttctgttcctagagcctgaacctctaggacttttaattgataccagtggtctccgctctgaaacagtccaccagaatgagggtaccaaactgacctcagaggtttccaggttaatgcagaggtttctagcttaatttctttctgccttcaaaatttggcaattatgtcaaaggggaaaatgatcttttgttttaggttttcagtttccaatgttactacttcagccttatgtaattgctaaaatccctactgttttccccctattgcccccttccttatcattatcttctgctaagcacaaagtgtgaattttcaggttccacatgtaaccagtataagtatatccttccccccaaaccccagtggaaatgtgccacggatccttatttttattctccactccttctagggctttcatttcttgcctattatgtttttagttgctcttttcttgttctgtctttgtaagcacagctagagtcagagaactttctgcttttggaactattttggttaacctctttaacttagcattcagtttcagaattcagcaaatgtgttttggggcaaactagctgtgtgttttaggtttgggaaatgtcaaattttgtttctctgtcttcatgcttctggctgcaaatgttggcaggtggaacaaaaagctgccagttctggcctgcccctgtgaacaggtctcacctctccggaaatttatccactttgtccttgttgcttcagagctctttggtaccattaacaatgtgacttatgatttatatggccttcctaggtgtcatcagtaggaatgttggctgtgatgcagtatatgctacccagaatcggaagttccatatattatgttttgataagagattttaggtgtttgagtatttctgatgagtgacattttttgaagtttgctagagagaaataattagctagttattgcttaactactctctctccatatctattacatatgtttctggaatatttctatggtcagagaaactcaggcccattataaaccatggactctggtagaaatagaagctgaaagcaaaccagtaagggaggtggagtgtataatttgtgttttggaagtacctgccggtggacttgggggtgatgctctaggtttaccatgagattactcatctaattttgagaaccactgtcctgcagtatttttcttttgcttacatatgactttttctttttatgatttaaaactaaatgtcaaccagttactatttaatgaaaatcataaattggtttagtgaaattttgttgtgttcttacaatgggtagaaacctaatgcacttatcatgcatctaaatttaggaataattcattttattttaatcatctatacttatatacaaaatgcttttcagcagtatatttgattatcttaggtacaatgatcttcatgttcagagttataaatgggaataattaaacctttaaacatattagagttgaataagggcttatctaagcaatacatgcttaaaattgctttcttatcaaaaaaataaaattggaggttcaagaagtgtctttaaattacaatccttatgaactaatagcttaaccttagttttgaataactgttactttttccgtcttttaaaaagatgcttaaaaataaacgcatgtcgaaaatgttattttggcttttagcaaactgacatttgagttttttaaaacctcactaaacatttgtggtaaaagatttcaaagctttgaattttacaatttgcctgtcgattccccccctgtgttattctattaacatttgatcttaataagtataacctgtttagaatgacttatgtttttaattatttgtttagatgagaagtttaaggaataacttcatcagaaattctacttggcagttatgaatgctttcttaaggaagttaaatttttggaatttcactgtaaagattttaatcacatgtcctattcttcatacatcaatctataaatgttcaaaaattgttaatgttgtttttatgctgtgctgatgttaacacaacgtgaggtcttctttcttctcctgataatatgctgagcgcacacacactctcatatgctcactcgctctctctctctctccttccctcccacccctgagtttgaaataagttagtggctttagtttctttgaaaatggaaagcaattgcccttaggtagaactggaaattgtaaagtgttggttttgtggacattttcctgttcataattcttgttatatcttatttataagtacttttattcatataggaataaatgattctatgttgaagggtataatcatgaagtcttttttattttttcgtgttagataaggagaaaaatgacacattaaaaattacagtgctatttgtgttttaaaatttcttctgtcgcttttgtattccttattgttctcttcactttttctattgtttttctagcttttcaggatacattttctaaatgcatcctaaatataacttacaatagttgccttttatttaaaagtaatacatttagtttccaaccacaaagtgtttaattctacatatttctatttttattttacatgatcttaatatatccttgattactgtgttgatcttctagtttttaggctgccacttataccatcaaaagccatttaaactggacttagaggataatgaatctaaattttcttatcttcctcaaaacaacagatacaattaaagtcacaaataagctgtaccttcagaattgctaggagacagaacatagtaagaattcaaatctcttataagcagagttataaacatcatattccaatattgattctgctgctttgtctgtacatttggagagcagaggtagcagggaggtttaagagactgaaaaaagggagaggggtgtatgaagtgtagatcagtaacaaacaccatcactcttgaaaagaaaaagtccaacagaggtcctagacctgtgttttagacaggtgggaggacagtaaattaatttttaaagacaaaataattatattgaatgaatttattgatcattttgttgaacagttagtataaggacatcccgtattatatttcagctttcataaactataagtgtttatgtcttatattttgtgttctttcaactttatcttaatttgcttctgttatttttaatgccatttttgtacatttgtttaatattactatattcatctttgttgtaattttttcctgtaataatgtaacataaataattataatattacaaagtttattaaatttcttccaatgataattaatatagtaggcttgtggtggaaaaatggatcaggtactgtccttccaattctgtcaggcttttgattgaggtgtttatatggccaccccgttcagacaaagaatgtcaaccaaaaggagaaagtaagaaggaatctataaattactaaaattcccatactttatttcctatggaaaaagtcatgtaaggaaaatatatagaagtttcccgtaaaatgtaataatatcataaactctttcatccttaaacacctgttagtcttgccacagcacaatcagttccctaaagataaatatttcttggtttgttagttggctacttaggagttccttttccttcttatgagttttcttctctcctgtatttcttttctaacaccatccaactggttatccaaactagcaacctcagaattttcatccctcttccacatcttacatttctttatcacatcctgtgtcttcaacttcggaatgattccttactttggtctcgtctctctatcctgtctttcgtatgagctattctaaaggcaggtggtctgcttctctttactctgtccagtgttatcatcatttttaaaaagtctgcttttcacactgttgctaaatagagtttaataatttctagtagccttcagaataatgtctacacttattagcctgatagttaccttttctttgtcagtttttactactttgattttgacctgcattttagtctgtgtttaactggtttttctgaatacgtcatgtttattgttttagcctcaaccctgaattttttttttctcccttaagtgtcaaatttcaattcagatgttaaactttccctgcctttttcattcagaatcacttctttctttgctcttgttttttattcagctttgttctatatatggttctttaaaaataattgtatggaaaattgctatgttcttttattataaaatgaagttgatttttcattacaaaacagtttatatgcttattgcacaatctaaacagatgtataaaagagccataattgttcctaatttggcgataactactgttaataccttggttgtattcttccaggttcttttcagtagacatgtatattgggtaattttgtttacacaaaaagattacattgtgcatcagttttcataaattagcacttctcatttgaaataacatggaaaatacctatcaatagatgtaaatctattttaaatctgtaacatttaaaaatgtttaacacttaagtagaagcaacacatacacatagtaaaactacatcaaggtggaaaattaaacgcttatttgaagacttctaattttgggaaattgactaattctgctattcttcaggatttctcaggccaaaattcagaacaaggctaaatttgcccatttccacctactattatttattctttctttatattatgctagagcttgtaggctctgtactaacacaagaaaggggaagaaaaaaattgtccttattcacaaatgataattatgtttaatttattaaaaacacataaatcattggagttaattaaatattagaaacttggctggaaaaaattgatataaagaatgtttctaaatatcagccacaaataaagattaaacaatatcataatagtattaaaacataggaagtatgaagtagtgatcagaataaaagatgtggaggctttgtggcaaacattatgaaactttgagagatactgtaatcatggattagatgatttaatattggaaatatatcacttttcccagcatagatatagataagtagtgcaatcactgttaaaatcctaacaagttgggctgggcatggtggctcacacctgtaataccagcactttgggagtccgaggcaggcagatcacgaggtcaagagatggagaccatcctggccaacatggtgaaaccccatctctactaaaaatagaaaaattagctgggcatggtgggatgcgcctgtagtcccagctacttgggaggctgaggcaggagaatcacttgaaccagggagtcagaggctgcagtgagccgagatcgcgccagtgcactccagcctggcaacagagcgagattctgtctcaaaaaaagaatcctaacaagttggtttttggagtttgacaactagttgtaaatttatatggagtgcaaaaaaccaagaacggccaaagcactcatgaagaacaacagggtaaggacacttgtagatagagtgtgtgtgtgtgtatgtatatatatgtgtgtatatatattatatatgagagatagttataagatactggggtttctaagtcagtccagtgtgttttttcttaacctgggtagtggttacacagacattcactttttttttttttttagaacagaaagtttctaagaatttatagcaccaagacattcattttttaaaaattgcacatttattttacttatcctagagaaatttataaaaaacaaaagtaaactataaacaccagttaaaaaaatccttttatattaactccatagagatgcaaatactgttaacagttaatgttttcaggggcctggctccatggcttgcacctgtaatcctagcactttgggaggctgaggtgggaggatcgcctgagctcaggagttcgagatctgctgggcaacatggtgaagcctgtctctaaaaaaaaaaaaaatacaaaaaaaattagccaagtgtggtggtgcatgcctgtattcccagctatttaggagactgaggcgggaggatcccttgagcccaggaggtggaggctgcattgagctatgtttgcaccactgcactccagcctggatgaaaaaggaagattctgtctccaaaaaaaaaaaaaaaaaaaaaaaaaagttaatgtttttagcttaccattataagtctaaataatgaatttgtgcttatttttaattaacaaacttatacaatgtctgtaaactctatactggaagatgaagaatgtagtgcacttacactgttttgcctttttattcttccttatatttgctttagtttgattttttattgattgactttatgacttcaacaatatatttaaaacctttttaaaaacttgatttttaacatttgagatatttatggagtcttctccatgaaagggagaattttgcatgcaatagtgtatgatgggcacttttaacttttttatggctttctttttcaaagtcatacaccactttacttttcttttaacctaattccatctttcttctgttttttttgggggggagaggttggaacatctccttagtaattttttccacataggaaaaaggattattaaatattactttgccttattaacctgataatttgagtacatattgaaaatttctagtttcaaaaatttcctcccttctcagcatagaatacattactccattatatttttagcatccggtattctttgagaagttaagtattagtctgatttttattccttttaaggtaattattatttttcacattatatgctttaaaggttttatcttaatatgagagattaaacaagatgtgtccaagtatggggtcctagtccctaatcccttgtaaaactgcttgatgtttggaaaaatctgaccatatttatgtttcaccttttttttttccaacatttctctcttactcttcataatctctattttccctttctgtatttcctgttaaacagatctcagaccacctaataaattctctacaccttttaatttttatttcatatttttaatttcttatattttctatctacttttttggtctttttaaaaatttcaacttttctatttttatcttagtttttacccatgcatattttgattgctcaggtaatccatccaactattgatttttcaaaaatttttcaataattgttagtgtacagaaactgtgtcattctctagctgcatcttttcatataattagataggtctgtttgtggcatctttctttccttgctttacaggcagtactgttatacttttgtttatttttatacataaaacatattttttgacgtttagtaagatgtggaagaggaaatgaacatatacttcatctcttttgaagtgtaaggtcttataattttcatacttcttgaactgattccaagggtaacattaagtgaaattttgtttagtttctatagaaaactctgttagttgtctggaatgaggagaaatacatgctgatttctgtatgtttgtagtaacaagtgattctgagactgggattctgattttgacttaaccagtttgccacgtgacctccatttggcaatctattaattattacttttactttctgtttagtttaatggccaattatggacagtctgttttaaattcttaaattcttatagttgtacacttatggaaaacatttcttaaatgtggaaatttagtatttttgttataagatatttcaattcatttattcaacatacttaaacaataaaaacattttactatttgtgttttaatactcttctgctcagaaaagtttactttgttgcaactcacagaaggtaacttacttttttctactgtgatttccttataggtttgatgaacttgtgaaaaaattcaaagtcgaatatcatgctggtggctctacccagaattcaattaaagtggctcaggttggttaattattttaaaagttaaaaggattcaaaatgattctagacccatgtctattttgcataattgtttccttttatattgtgttgctgtagaatagttttgttcatttgaattgggattttagtagtcattgcacatctaatcaaaagttattttaattggtatttctttggttattggtaagcttgaacttttaatgtttattgttcatttgtgtttcttcttaaattgtttcctttcactatcattttataatttttcatgttacagatttgtagaaacttcatattttatagatagtattcctttttattttataagttgaaagtatttattttttgttatgtgtacattaactcttacagtgtcttttactgtgccttagttcttaatgtaactttcaaagtttttaacgtaattaaactttatggcttcttcatttcctgcatgtcccccttacgaaggacgtttctgccacaagatagtagaaattgctctgtattatatatagatatctatatacataaatgtacattcatatattcatacctaaatatctatgtatagacatatatgttggtagatatgtatatgcatctatatatctataccggtgtatatcttttataaatctatatatctgtctctattcccatatcttccaatgagtaattgaataaacccattaggcatatactctttgagttaccagcttaacctaatcttgattgagagagttagtgatctgtttaatcttccagctttgaaagatatgaacaagttttacatacctctggttcttacctctgcagtttgaagttaactcaaaattctgctcattgcaatcatgtgtcagttctgcctacactagatttctttttcttttttattgattaatgctttccccttgaattctgattaacttcaagaactggggaagtggaaaattgacaaataaaatccagaatgatttcttttcaagtaactcttagttgattgagacatatagtatgattattccacatacttccaagctcagatttaatcatagttttcaaatattttgtaaaaatgaatctttaaggcggtcattaatatgaagtggcctgagtctttgtattggtcaattgatttgtattgtttttggtaaaacatcctggtggtcactttatgaacttccagagtaatagaaaaaggatgatttacggccaggcacggtggctcacgcctgtaatcccagcactttgggaagccgaggtggacggatcacttgaggtcaggagatccagatcagcctggccaacatggtgaaaccccgtctctcctaaaaaaatacaaaaattagccaggtgtggtggcatatgtctctaatcccagctacttgggaggctgaggccagagaatcggttgaacctgggcggtataggttgcagtgagctgagatcatgccactgcactccagcctgggcaacagagtgagactccatctcaaaaaaaaaaaagagagaaaaaaaggatgatttacttaagccttaatttatcaaggcacgttttgcattttgcagttttcagtcttttctcctgctagaactgggggtgatatggttaggctttgtgtccccacccaaatctaatcttgaattgtaatctgtataatccccacatgccaaggaagagaccaggtggaggtaattgagtcatgggtgcagtttccttcatgctattctcctgatagtgagtgagttctcacaagatctgatggctttataaggggctcttacccctttgctcggcatttcccattcttgctgccttgtaaagaagatgcctttcttctcctttgccttctgccatgattataagttttcagaggcctttccagacatgctgaactgtgagtcaactaaaacttttttctttataaattacccagtctcaggcagttctttacagtagtgtgaaaatgaactaataccgggaggctattagctgttcactaataaattgtctcctttcttggggatcttcatcagtttctgccttctaaaagtttattaattatataattaagttctccctcagctttctccctgatattagtctcataataaaacagtcattgcctacttttattcttttgcacttttttttttacaatatttcacattcattctaacaacgtattctagtagtggtttatttgttcctgtctttagcaaggtaataaaaggaatttgaagctttgggtaacttattctgtcagatcttactagtaatcatactttcatgtatcaagtgatatggcaaattatgtcaacaagaaaatgtccccaaagctcttaggtattttgatatgtcaaatcatgtttttgaagattttaatgaaaccataggcaacaaaaacaagtatggttgatatcttgtccaaacacaattctagatttatttgatacacagcacaaatgtaaattttggtaaatttcatttggtctgaacttcttcctaatgaaagtgaaaagttcttatctgctcaatatcctgcacagcatgtatataacactgctaaaaaggggtataacttgcttaagtttgataattgatgctttcttaatgaacacttttggttactttgtcagtttttaaaaaatttgtagaagcacttaatgtgagttttgacttgaaagaaatggaaaaacgttggcattgtgactcatgcctgtaatcccagcattttgagaggctaagttaggagaatcgcttgagtccagtagtttgagaccagcctggacaacatagtgagaccctgtctctaggaaaaaaaaaaaaaaaaagaaatggaagaaaatgacttccttggatatgtgcctaaaagatggctattattgttgctggacatagatgccctgcagtacaatattaacaaaatatgggaccaaaggaatgcccatctctgatttggcagtacattgagaatgagaatggaaaaagaagattatagtaaaacaaatatttttatgctgtttctggtttttttgtttgtttgtttgtttcaagacggagtctcactctgttgccaggctggagtgcagtggcgcgatctctgctcactgcaacctctgcctcccgggttcaagtgattcttttgcctcagcctcccaagtagctgggactataggtgtatgccacaaagcccagctaatttttgtatttttagtagagatggggtttcaccatgttggccaggatggtcttgatctcttgaccttgtgatccacccgcctcggcttcccaaagtgctgggattacaggcatgagccaccgtgcctggcctgtttctgtttttgaagaggccacaagtgggctagaaaaaacacataccaaaaaaatactcaaataattttatttgttcattatttattaatttttttgagacagaatctcttgctctgttgcctagactggaatgtagtggtgtgatcatagctcactccagccttgaactgctgcgctcacagggtcctccttcctccatctccacctccatctcctaggactacaggcacaccctaccatacctggctaatttatttgttgtagagacagggtctctgtgtgttgctcagattggtcttgaacttttggcctcaagtgattctcctgtgttggcctcccaaagtgcgaggattacaggtgcgaaccattttacctggctcaaatggctcatttttatatattaagagtgcttcagaactcaagtaaaaaagtcacagaaaagagcaatgaggttaaataaaactttttttcagtttctttactaaaactgtaacttacttggaatccagttttgacatcagaaattcaaattcaggtgttttaaaaccatttctgcaagaaagaaatttaagttaggatgatagccaatgtctttcagagtgttttaaagtgatggacattttgaacattgataagcctatataatgaatctgtaaacacaagggatatgattcataaagagctggaatgccaaaacctgcatttagctaaaagatagatggatatttttatagaactataaactaattcctatatctaaacacctattattgatagtaattaaaatcctaagtattctatgtttacatgcttttgttgagaggatatttagcttaatgtcattgcactggactgacatcaagaatgtgggcttgatgcatcagaggtataagtcacagtgaattttacctttgactgtattacgttttaccacacatacaagaaggattgacctaatggctctagtcaagtatagaaaggaaacataaaagtaaaaatattttattatttcttaggcaaaaagaagcatgcctttattctttttaattaaatattggtaaaatgtttaatccaactgtggttacgttatttttttaaaaagtgtgatagaaataaacaacagaataatatatgattttgaataagttcaatattagtttgctagggcagtcttagcaatttcagagactaggtggcttaaacaacaaagatttattttctcacagtgttggagtcccagatcaaagtgttgacaccttgattccttcagaggcctcgcttcttagcctgcagatggctaccctctttctgcctctttgcgtggtggtttctgtgtacatatgtacctctggagtgtctctgtgtgtcctaatgtcttcttataaggacaccagtcagattggattaaggcctaccttactgccctcattaatttaattaccttgttaaagaccctatcttcaaatgtagtcacattgtgagatactggggtttagggcttcaacatatgcatagtggcaggagggtctgtggaggggtgtttataattcagccgataacaactatgtgtttttaaatttttgtgtctaagtaataaaacatgaataagttaatttttggtagtgttcttttttgataccttcttccttttctttcctgtatatgttttagttacttttattatttaccatttgaattacaatgaacattctaaactcataacaacctaatttgaataataccaatgtagtttcaataatatacaaacactctgctcctttacatctccatcctcttcttatatattattacgctcattgattacgtctttatatattgcatgcccattaacatagatttgtaactattcttttattcatttgtcttttaaatcatataaaaataaaaggaattacaaaccaaaagttcagtgatagtggcatttatatttactatgtagctacttttaccagagttctttacttcttcatatggcttctggttactatcaaatgtcctttcatttcagcctgaaggactctctttagcattttgtgtagggcaggtctattgttaacaaactgtcttagcttgtgtttatctgggaatgtcttaaatagcccctttattataggatagttttgttggatatagaattcttggttaacggtgcttttcttttagtatgttaaatatgtcaactcactgctttttggcctacatggtttctgatgagaattagttcttattcttactgagaatcctgacttgtgaccagttgcttttctctcactgatttcaaaattctttccttgtctttgtctttcagcagtttgactataatgtgtcttggtgtgaatctttttgtgtttatcatgtttagagcttattaaattcatgcttcaagttcatgcttggatgtgtagattcattcattttatgaaagtcaggaagttttggaccattatatcttcaaaaatttttttcttttattttctctttgttttccttctggcattctcataattaatatgttggtctgtggtgattgtttagtgataaggattctgattaaataagatagaaaaaaacaccatggtgagtaagcaaagcagaaatagaaccccactgttttaactagtaacctcagcttgctttttttaccggagatttttctctcatcctgagaaaacttcaatttttacttctctaaatgttagagattttgagtagtgtttcacatgctttcttcacttcttactgtcttcttcaatttgggagtaattgtaggttgtcagagagagtgtcgaatatgcatcactttaaatacagttatcagtaaatggactctttcattcatgcttcccagagatgacagttttccttggtgcctagatacctttttgttccttggagattcatagtattatgtgactcattgaatttttcagaagcctgatggtgagcttcgtgaggtatttctatttaagttgtaagttcgcttgtttttaagcttcctgcaatttaacttacctatagtatttttaaatttattttaaaaatgccatcttggggtatattctaggcatctcaaaaattttaaataccatcttatcctttgttaactggaatataagcaggtaatcatttgaatcattttttttcctgtaattattataacattgaggctatatggatttttttttctttttttaatttgaggcagagtcttgctctgtcacccaggctggagtgcagtggtgcgatcacagctcactgcatccttgacctcctgggctcaaggaattctcctgcctcagcctcctgagtagttgggactataggtgcacaccaccacacccaccttatttttaacttttttgtagagattgggttttgccatattaaccgggctggtcttgaactcctgggctcaaatgatcctcaagacattagcttggtctcttctcaaattagcagatccttatttctgtcttataatttctaatctgcttttataattattgacttacattcaatcttccagtttttcatgtctcttccaattagataagcctccatatttgtatttaacttccagtaaaattttaaccatgttgtttcatttttaattaaaatttaagaggactgcctaaatgccagtgtgtttatgttgtatacatctcggggcatgcttttaagtgttttcttgatgtaaaacatcacataataaactagtgttcataattgtattttaaagctttccaaaattctatgtaaaatgagtttctaaaaacactaaacaaaagaagttttaggaattatgtttgaatgaaatagaaacattgaactcaaaattgtaaagctgatatttcaagaactaccaattagtgtaacattactaattgagttacagtatttagaagttaaaactgatgtaaatcaaaggactcatgttgtttatctattttgaatccttttttgaaaaaagttaatctttaaagtttttctgtattaaaaaaatctgattatctcttgtgacctattttacctagaaaagctagttagaggttaaaaggttttttatgagacatacttctgtgcatcggaacagtccagatgtaaatttaaaaagaagaaatgacaatgaagtgatcaaagagaattctgtgttcaaatgctttcacctggagcagttgtagaaatgtcagtagcacaactgtatttataattatagcaggatgtggcagatggtgatgcaacaccgtctcgtcaattctttgtgtcattgaagaaagtagtaagtattaattctgccaattttatgattaatgaataattttaagtaacacaggccctacgaataaggttgactgttcaaattgtgatacctcattatagtttttaaagtttaaatatgaattaatactcctctttgcctttctgttctctttccttttcaaattaggttgttaagttttcatagctaaaataagatgaaggaagcagtggcttgctgtcctcaattatatttttgatgtgtttgtgaaattattataacttagatcagattctttaaagaaaaatcagtatttcattttttcctttcctcccttttctccctctctcctttccttgtctctctcctttcctttctctctcttcttccctttacccctcctctccccttcccttctttctcctcctcctcccttcctcacatctctttcccttctcctcctacccttcctcttccctcccctcttcttcctttcttcctactttgttttatgcattatgttaagaaattgttttactgctattagtgataacatgcttttagttctgtcttagcagttatggttgtgctctccaggataaatctacacatatcacagttatccacttcataaaagaatgacatatctctactcttgtgggccttaatgtcatgcagtgtttctgggtatgacattaaacatgggtacaatttgaaattgtatttttctgtctaaaagcaaaacaaagcttcatcaagaaatactacaagcagtgggacctaatttcatcaaggggataaaactctattcctttttattctattttggaattggaattcagaaacatttttttttggtcctatggatggtatattcacttatttgaaatgaaaattgaactcagacttttctgaaagagtctcatttgttaattggttgacaaggatggtctttgccatttaaatgatacagtggtactgtcagctgtcattgttcttgaaagcaaagaaaatatttaattgtattgattttctgacttacgttcgaattaatacacatttccttcttctttaagcaactttattggaatatagttcacgtacaattcacctgtttaaaatgtataatcttgtggcttttagtgtgttcacagatctagctagctgtgcaaccatcaccacagtcagtttcacaatattttcttttcttttcttttttttttttttgagatggagtctcgcactgtcgtccaggctggagtgcagtggcgcgatcttggctcactgtaatctccacctcccggggtcacaccattctcctgcctcagcctcccgagtagctgggactacaggcacccgccactgcacccggctaattttttgcatttttagtagagacgaggtttcaccgtgttagccaggatggtctctatctcctgaccttgtgatccgcccgccttggcctcccaaagtgctgggattacaggtgtgagccaccgctcccggccccacaatattttcattatcaaatgaagaaactctataaccattagtagtcattccccatttctctctcaccccctcatcttctgtccattcaaccccttggccccagacagtcacttatccagttttgtttctataggtttgcctattctagacaattatttttatttttggagatggcatcttgctctgtcttcgaggctggagtgcagtggcacaatcatggctcactgcagcttccaactcctaggcacaagtgatcctcccacctctgcctcccgagtagctgggtctataggtatgtgccaccatgctcagctaatttttaacttttaaattttctgtggaaatggaatcttgctttgttgcacaggctgatgttgaattcctgacctcaagcaaccctcctgcctctgcctcccaaagtgctgggattacagttgtgagccactgtgcacagcctttcaccaattgtcaaaaacttattcatgtatgtgattgtagattctttgaccaacatctctccatccttctacccctctaattacccaagcctctgataaacaccattttactttctccttctatgagatcagctttgttatagttcacatatgagttgagattatgtagcatttgtctttttgtacctggattatttctgttaacaagttattctccaggttcctccatgttatcacaaatgagaagattttgttccttttttttgtggatgaatagtattccattgtgtatatatatcgcattttatttattcattcattcattgcctgataaactcttaggttgattacatatcttggctgttgtgaataatgaagcagtaaatatggacgtgcagatatatcttaatcatttccactgaatatgtacccagaagtgggattgctggatcacatgttgtaccgttaatttcttaaggaacctccatacctgttttccataatggctgtgctagtttacattcccatcagcagtgtacagggttcccttaatatttcgggtactatagccttttgtaatatattttgaagtcagatagcatgatgtgtctttgtcatttttgctcaagattgcttttgctatttgggatcttttgtggttctatatgaattttagaattttttttctatttctatgaagattatcattgtcatttgagagggtttactttgaatctgtagatcactttggatagtatgggcattttaatgatattctttaattacatgaatgcaggctgtcttttatttgtgtcttctttaatttctttcatcagcgttttatacttttcatcttagagatcttttatctccttggttgaatttatcactaggtattttagctatttttatagctattttaagaggaattgtttacttgatttttgtttttttcagatagtttgtggttgatatatagaaatgcttttgtatgtttattttgtgtcctacaactttactgaatgtgattattagttctgacagtattttggtacattctttagggttttctgtgtatgagatcttgttgtcttcaaacaagaacaatttaatttctacctttccaatttgtatgccttttatttctttctcttgcctaattgttctggctgggtcttctagactatgatgaatagaaatggtgaaagtatacatccttgtcttgttccagatttcagaggaaaagctttcaatttttccccattcagaataatagctttggatttttcatatatggcctttattgtgctgagctgcattccttctatacccaatttgttgataatttctaacatgaaagaatgttgaattttgtcaaatgcattttctgcatctattgaaatatggttttttcctgcatttaatgtgatatatcacagttattgatttgtgtatgttgaaccattcatatatccatgggatgaatccacttgatcctggtgaattatcttgttaatgtgctggcttttttttttcttttttaagacagagtctctctctgtcacccaggctgaggtgcagaggtgctctacctcctggattcaagtgattcttccgcctcagcctccctagtagctgggattacaggcaccaaccaccatgcctggctaatttttgtatttttagtagagaggggtttcaccatgttggccagggtggtcttgaactcctgacttcaagttatttacttggcctcccaaaattaatgtgctattgaatttggtttgctggtattttgttcaggatttttcttctatgttcatcggagacattggcctatagttttcttatttttgttgtgtccttgttaggttttggtatcagggtaatgctgattttgtagaatgagtttagaagaattctttcctctttattttttaaaaataatttgagaagaattcgtattagtttcgctttgaatatttggtagggtgtgttggcttacgccagtaccccagcactttgggaggctgaggcagaacttcaagaggccaggaatttgaggtcaacctggacaacatagtgagaccttgtttctacaaaaaaaaaaaaaaaaaattagcttggtgtggtggtacacacctgtagtctgagctacttgggaggcctcttgggaggctgaggcaggaggattgcttgagcttaggaggtggaggctgcagtgaactatgatcatgccactgtactccagcctgggcaacagagcaagaccctgtctctttaaaaaaacagaacaaaaattttggtaaaatacagcagtgaagccatcaggtcctaggcattttttcttttttctttgatgggagactttttatcactgatttaatctctttacttattggtctgttctaattttctatatcttcgtaattaaattttggtagattatatatattcagaaacttatttcttctaggttttctagtttgttggtgtataattgttaatgagagtctcttataattctttatatttctctgggatcaattgtagtgtctccttttttgtttctcactttattatttgtgtcttctcctttttttcttagtctagctaaaggtttgttgcttttggctatcttttcaaaaacctaattctttgttgtatttatcttttgtatgttttttaggtctctatttcatttatttcttctctttattatttatttttttctgctaatttggagtttggcttgttcttgtttttctagtcccttgaggcgcaacattaggtttatatctttcctctttggggatttatgtgttaattactataaacatcacttttagacctgcttttgctgtatctgataggttatgctttttttccattggcattgtttcaaaaaatctttttgtttctctttaattttttcattgaccatgttgtttaatttccatgtatttgtagagtttttgattttcctcttattattgacttctagtttatgccattgtgatcggaaaatataatctatgattttgaactgaaacttgttaagacttatgttgtggcttaatatgtactctatcctgaagcatgtttcatgttcaattgagaagaatgtgtaatcttcagccgctggatagaatgttctgtaaatgtctgttaggcctatttggtcaagagtgcagtttaaacctaatgtttcttttttggttttctgtctggataatgtttctgttgcttaagtggggtgctgaagtttcctactaggtagaggatcagaaaaaataaatattacatactcagcttagtatctgggtgatgaaataatctgtacaacaaacccccatgacacaacctgtacatgtaacaaacctgcacatgtaccgctgaacctaaaataaaagttaaaaaaaaaagttgtctactatgattgttttgtactctatctttccctttagatttattgatatttgcttatatcaggttattttaatctagtaacaacttaactttgattgctaaaaatgtttaataaacactgtgtactttaactcctctttttctctcacattttgaatttttttctgagatacagtctcactctgtcacccaggctggagtgcagtggtatgatctcagctcactgcaacctccacctcccgggttcaagcgattctcatgcctcagccacccaagtagctgggattacaggtgtgcaccaccttgctcaggcaatttttgtatttttagtagagacggggtttcaccatgttgcccaggctggtcttgaactcctgacctcaagtgatctgcctgcctcggcctcccgaagtgctgggattataagcatgagccaacttgtccagccacatattttgaatttttgatgttacaacttacaacttttaaaactgcatatcccactatcaattgttgtagttataattatttttaatagttttatctttaatcttcatattaaagatataagaggtttacatactatgcttacaataggccgaatagccacttcccactcattttttccaccatagaaaacttgcatccaggggacttctgcatatgtgggcttaggggaagggtgttgcagtcaaagcaccatttcccttactgtctgatatggtttggctctgtgtccccacccaaacctcatctctagttgtaatccccataatccccacatgttgagggagggatctggtgggaggtgattggatcatgggggtggtttcccccatgctgttctcatgatagtgagtaagttcttacaaatctgatggttttataagtgtttggcagttcctccttcactctctgtctttttctcctgccaccatgtgaagaaggtctttacttcccctttgcgttccagcgtgattgtaagttttccaaggcctccccagtcatacagaactgtgagtcagttaaacctcttttctttataaattactcagtcttggatatttctttatagcagcgtgaaaatggactaatacactgttctcagatttttctcagctctgtggtacaatgagacaccatcctgagttccaagagatccagggtagtcgtcttgccactgagaagatactaattgtgacaagttaatgggtgcagcacaccagcatggcacatgtatacatatgtaactaacctgcacattgtgtacatgtaccctagaacttaaagtataataataataaaataaaataaaaataaaataaaatctaatcttctgtgcaggcaaaaaaaaaaaaaaaaaaaaaaaagaaattctatagggtgtggagaaccagacaacaattcctacccttccattttgcaagcatcactctgccatattttttaaagaataatgtttttagagtatttgtgttctttggtacttttgctgctgagattcttgggataacaaagtaaaaaaccaaatagtctagattgtaacataccacagtgatttggggcaagaaggatgtgcagtagaattaagccaagctgggcaagtatgaacttgggactgtcaccaaactctgtctcattcttttctccttatttaattctttccatatcaagcatttacaacccactatgtagaggtccatacaccttggcttatagacttcacttggtagttactgttgcccacctatctattaaccagaattttcatttaaaaatctctacataaaaattagcagttatgcagtggagttttcaaataaggaagaagattggttggatggatggatgttaggtgaccactgggaaactatggttttagaacgagtagctggtaggttgcaggtggcatgtattttaatacatgtagcagaaaactgaaaatttatgagcattttagaaattagagctctgtcaaaataagagaaaaacttagatttaattttataaaagcagtactaatgactttatgaagatggcatatgatttatgtatgtatgaacaattatatgtatcattaaatagatcagataaattttttgttcttttaagaataataggccagatgtgatggctcacgcttataatcccagcactttgagaagccaaggccagaggatcagttgagctcaggagttcaagaccagcctgggcaacatgacaaaaccctgtctctacaaataataaaaaaaaaaaaattagccaggcacggtggtacatgcctgtcatcccagctagtcaggaagctgaggtgcaagaattgcttgagcctgggaggttgaagctgtagtgagccatgattctgccactgcattccagcctaggcaacagagctagaccctgtctcaaaaccaaataataattttttaaatatttattatctaatgtgggtttttgctttatgttacagttgtcacctactccaatatgaaaaatgagaagaaagccaggtgtggtggtgcatacctgtagtccctgctactcaggaggttgagatgggaagatcacttgaggccaggagtttgaggttgcagtatgctatgattgctcctgtgaatagccattttactctatcctgggaaacacagtggcatcctgtctcttaaaaaaaatttttttttaaagcatgttcacaagttctttaatacttctccattgaaaaggtagaacctaatttcccttctcttgaatatggcccagacttagcgacttgtttctaataagtagaatgtatgtaatgatggtgtgctatttctgaggctagatcattaaaggcatcattacttccatattattttttcttgggacacccataatggggaattcaactgctatgttcttgaggatacgcagtcagcctttgaagacacccacatgggcaggaacataagccttccagcggcaaccagcaccaatatgttggccttgtgagtgcagccagctccagtcaaatcaccagattactggagccctgccttacttaaccgactacaacctgatgagacaccccaagagagaactgttccactaagctgctcccaaattcctgacccaccaaaactatgtgagatagtatttcttatttatagccaccatgttttgaagcaacaatgactattaaaataataaaataactttcagacattgtttttaatccctcttttctgtagtccctgtactttcccaccccaatttatatttcctgtttctatttgaacttttttcttttttgttttcatttcttttatacataatcgttttgagctataagaataatttatgccaaaaattatgcagctaatattttacacccgtattgtaaccagtatactggtataaaactagataataaactactatggctgtgttttgcttcttacagatggaaggaaatgcctaaaatttaattttatataccacaatgtgttttgaaagttttgaataattttctggttttgaaaacctgttttgatttttttttctcacaaacacgatattcttaagtaaaatagagtgatttatgattaatagaaataatgaagattatgcaagttattttacttcaattgaaatagcaaggccagaataatttaatcatgttttccagaagaataataaaatagaatcagtggcaatactagtaaacattagtctacatttctatttatttatttatttttttagacggagttttgcctttttacccaggctggagtgcagtggcacgatctcagctcactgcaacttccgcctcctgggttcaagtgattctcctgcttcaggcctcccaagtagctggtattacaggcgcctgccaccacacccagctaattctttgtatttttaatagagacgggatttcatcatgttggcaaggttggtctcaaactcctgacttcaggtgatccacctgccttggcctcccaaagtgcagggattataggcgtgagccactgcacccagccaacatttatatttctttaacttcatatcatttgctgtagttagctggatcatatttcttaaattttactttatttatttatttttgagacaaagtcacgctttgtcacccaggctgaagctcagtgtttgcgatcttggctcactgcaaactctgccttctgggttcaaggaatcctcctgcttcagtctcctgagtagctgggattacaggcttctgccaccatgcccaacaaatttttttttgtattttttgtagagacagaatttcaccctgttgaccaggctggtattaaactcctgacctcaagtgatccacccacctaggcctcccaaagtgctgggattatggccatgggccactgtgcccagacaaattttactttcatagtaacattttgcaaatgtaaaaattttataatttgattagtaatgtcagactctatcaaggtgatgctctcttaaaagttgttgatgataatattagatgagagatgtatgtagttatgaaagaccctgaaatgattgtatttttttatttctgtacaaagtttactcacatttctatgtctagccatagctattctaagccatagcacaaagaactgtattgtgatggtgagactataaaaaggtaaatttagagaaagcttccagatctgctctagaatttattaccatctggtctctttggagactagtataattattcatgggaatgttttcaacacagaaaagcatggtttgtgtattggcagaaagtaaaaagtaccagtggtttaaaccatatgtagcttttttagagttaggcaagggaaatgaactgaagacctaattgagagtcatcagtagtgatgcaatttgtgtcaattttgtcagaatctgttcataatgaacaaaatattgcacaacaagaaaaactgaaggtattagaaatataactccatttgaagagtattactttatcttaatttaaccaatgaaatgtaagatggtgtcagctaagtatttgtgtaaatctctgaaataacataaggaatatatgtcaaattttgatgacttttaaaaatgaaaacactcatgttaaaataattttaagcttgaacactggaagaatgtcttattaaggttatttttcttaaattgaatatgaatgtattattttagatcattttagatgtggcatggacttactactgttcctcttaagaagcagaaatattttacagtctttcttaagcttaaattgattttatagaaaaaggaaaaaaaaactaaatatcttttcactttccattctaacagttacttggagtctataaaaaatgagatgacaaatcaaaaaattgaaatcgtctattttttcagctattttaaaagaaaaatgcctagtgggctgggaatacacaagaaatttaaatttgtgattgagaataagaaatgcatttgtggttttaaaaaagaaataccagcatgtcacattaaaaatatggcatctacagtattgtacaaaggaaaatgtattacattaggagggggtatgttgtactttatttagagaactagtgcagggatacgaatgagaagtataacgccatagaaggcatgagcattagtaatccagtcagagaggaagaattttgctgcctcccatgtaacataaaacagatgttccattctattagaaccttactaaaatgagagtttagatcattggtcaataggagaaacatgaacaatggcaatttaataattttgagggtttatcttatttgtgagttaatatccatggtggggagtatgaagggatgcctgccaaatgttattttatttttgatatcttgattgagagagctgaaaggcaacagtaagctatactaatttttaatttattgttttgcaaatttaatctatttttttctcaaaaactgttgtaagaaaaaaagatttcaaaattataagtcctgatttaatgcttgaataggtattgaagcatatctgaaagtataattaattaacctcaaatgaatactgtaaacattaagtagttggcaactgaaagtagacgtatgcagaaagggacaccagggatggtaccacagggtcctgggtatatttttgtttttttaagggaagatttacttttttctagaaaagaaattcttttcaaataaatttatttttcaaaaaatactttttttcaaaagtattttttccattttaaaattaagttataatttatatacaaaaaagtgatctttgtagtgtatgtttctgcaagttatgacacatgcacagtctagcaaccagtatcagaaataagatagagaatagtttcatcacctcaaaactttccctgtgtcccctttgtagtcttcctttcccctacttcagcccttggcaatccctgctctgtttttgttgacagagacagttctcctcacttgtttgtgaagactgtaaggttctgactgccctttttcctgggacatttctcagggttatatatgcagctgataaacttgagacatgagataacatctgttcccagacaaaaagcaagcttatttactgcttgctataaaattggtggattccctgagttcagtgcttctcatttgctgatgcaaactcactacaagcatagcatccatctgagcatccccaaaggacttgggatgaagggaactgatgcaaatgtgctgatgttcttctgttttgtcataagtaatgaagtgttttttctttgactgaggagtcttgtgtcttctgcctgcatccatgaattagttaagaggcttttgtgttagcttttattaaatagggtaaaatcaaatcccagtctccataattttctgtttgtatagttttgccttttccggtgacttgtattgagggttcctgcttctggccaacaacctatgagtgattttttaggtctgatcataaggcatttacagaggttttcctggcaggcttcatagggggagggctggtctccagagcagacttggtgcaaagcttttatagtctctgaggggaattgcagtcaaggacccagccatcctcttatacatatctgcgttcctagcctaggtgccttcattcagaggcctctttatgtggggcttttggggaggctttccttaagtgtctctgtcaagactttattggggaaaagaggggaagacacttaccaactctttctctactatgacttgtacttttctgtttctaacccttccctctctagccttcactcgactcctgggtctgtaaaactgccagaatcttttgttgggggttccctttggcaatgatgcaaccctcacatttgtgctggtctacctgccctgtgaccaatgtgccatgccacaggggaaaatggaatggggggtagctggcactttctccaatttagcctcttatactgtcacagtgattacagacctattctttattttattttattttatttatttatttttttggcttgttgccattggctgtgccaaaacgtggcagcccagctttctccagctctcctgaggtactgatacacacaaatggaatcatgttgtgcatagcctttgaatctgactttcttcagttgacgtaagttcatcttagattcatccatttgctttgtcaatagtttttaaattttaatggctgagtagttttctatcatcgtgatgtactgcaccttgtgtctctatccactctagagggatatttgaattgtttctggtgattatgaataaagctgctaaaaatatttatacgtttttgtgttaacataaattttcattttactagatgtattgccaaactcctttccaaagtggctgtgccatttcacattcccactagtaatatatgagaggtctagtggtttcacatcctttcagcacttgatattgtcagcttttattactacatcaattgtaagggggagaggagcatctcattgtttgtttctacttccctaattatgtgaagcacatttttatatgcttatttgctatctgtatatgttctttgaagaagtatctcttcaaactctttgccttttttttaaaaaaaattgtgtttatttttgttacagagttttgagaattctttatctgttctgcagacaagacttatcagatgtgtgatttgcaaatattttctcctagtgagtggcttgtgttttcattttcctaacaatgtctttcagtgagcagaagttcttacaaatttatgtacttttaaaatggattatgcttttgtgtcatataagaactctttgcctaatccagggtgagaaagatttactcctatattttctactagaaatttcatagttttactttttacatgtagatctgtgatccattttgagttaagttttgtgtatattgggtgaggtctgtaacagagtttttgattattgttttttgctattgttttttgctttggcatatggatatccaattgatccattactcttccctgaagtctatttaaatctctttaattgccattgtacttttttgaaaatcaattatgtggttgtatatctatgttccatattctgtttcattgatctatatgtctcttctttctccaatatcatacttctctgattactgtagcttaatgtgtttgttttttttgctgtctaatcatggaagttgaatttattgcattttacaggtcaatattttttgtagttgtagacgtctgtaattttgcactgttaattttaatgtaatggacatattagaaattaggttttcaatatgcaggggaaatgctgttaatttacaattgaagagagttatgaaataataataaatagaaaaagtaaatagagaaaggaaagtacagtcatcccttagtgcccataagggattggttctaggaccctctgtggataccaaatccatggatactcaagtcccttaaatggcataatatttgcacataacctatgcatatcctcccatatactttaaataatccccagattgcttataatacctaatacactataaatgctaagtaaatacttgttatactgtgttatttagggaataatgacaagaaaaaagtctgtacctgttcagtacagactcaacaactatccatttcccccacttccaagtatttttgatctgctgttggttggttggtctgcagatgcagatcccatggatatggtgggcctatatatatgtcttatttattgtcactaccttttgcttccaagtattttttatttttaatgagagttattttgttgtggtgggtggtttaacatacataagttttcccagcagcagaaccctgaagcaaggattttagaacaaagtctactttggagacgtatgtaacaggcaagaattgatgcaaggaaagcaaggcagctaatgaagacttactaactaaactaacacaataggttgctggagctttatcttgtgggataattctgggaaagtcagtgtcaaatttagtttcgggactaactcacctgaagtgtgagagagtgagtatatttcctgttactggttgtggactgccatacagaagacattgcacctgcctggtgctgtggtgggcagagtagcattcagccattcagaggaaagccctgagggatacagaggaagatactggctattggaagtaatttggaatggtgggaaagggttaggtccaaaggatactgtacagacactgacattatctgactcatgccttgtgaattttaagtgcctttcctgggttatcaaagtgaatagctttaatcaaatcatctctataaagacatttctaagtaaattttctatacttacactcctctactttttattactacagctggcttcattagctttttgtatattaatctgtgttgtcctactattagctagaagagcttactaactgtgagcttgaagatattgtatattccctcttcggatgatttttttttttttttttttgagtcagagtcttgctcttgtagcccaggctggagtgcagtgatgcaatctcggctcaccgcagcctccgcctcccgggttcaagtgattgtcatgcctcagcctcccgagtaactgggattacaggcacctgccaccacgctgggctacaaatgtatttaagaatcttaaatgagctgtgattgcaccactacactccagtctgggtgacagagcgagaccctggcttcaagcagtcctcctgcctcagcttcctaaagtgctgggattacaggcatgagccactacccctggcctaaattccttttctagcctctatacagaatttctaggataacaacaacaacaacaacaacaaaaacttaaatgataaaaatgaatatataaaatagcaagtaagccatgtaaaatattttcaatattcttagccattagagaagtgcaaattaaaactataagatactgctgcatacatatgtggatagcgaaagtaaaaactggtgagaatacagaatgaatggatttctcatctgttgctgataggaaaatgacacagccactctggaaaacagtttggcatttttaataaaattaaagataaatattccatatgactcagcaatcatattcctgagtatttaacatagaaaaatggaaatttatgtatatgtaaaaacttgctacacaaatatttacatcagcttaatttgtaattgcctcaaactggaaagaatccagataactttcaacaggtgaatagataaacaaactgtgatatatctatcgaatggaataccaagctttgtaaaagaataaattactggtacagtcaacagtttccgtagatcttaagttcatcacacgaagtaaaaaaaaagctaaactcaaagtgttacatactgtatgattccaattatatagtattacttaaatgaaaaaaaattagtgttggaaaattaacctgtcattccaggagttagagataatgtgggagaaggggataggtatgactataagggagttgcaggagagggcttctttgtggtgatggaatagttctgtgtcttaattgtgctggtgagtacatgaatctttacagctgataagattttatagaatagtacacacacactaagaacaatgcatgtaatgtctactttggggagctttttttaaaaaaatttcttttaagagacagtgtcttgttccatttcccaggctggagtgcagtggcacaatcatagctcactgtagcctcaaacacctgggctcaagggattctcctgcttccagcctcccaggtagctaggactataggtgcatgccaccatggctcgctaatttttttatttttattttttgtagagatgggggtctcaccatgttgcccaggctggtctcagtctcctggcttcaagcagtccttctgccttggccttctaaagtgctgggattacaggggtgagccactgccctggcctaaattccttttttagcctcttcacagaatttctaggataaccaatataagtaaagtagatgttatttttaaaatgatccactttatacactaaattaaaagacagtcttgatttcttcaaaattctttgctgtgaagtgaaacgtttggtaatcatatatcttgttgacataaacatacagattcctctgcatgtaacattcttttccttcactttaccaatttgtgcccatttcacgtatctcagcctatatccctttttcatgatcatcttacctctgacataactctttcacccaccaaatctgtgtttggtgtcatttctatgatggtcccatacaaagctggactcattttacagatgcaaaaagtgatgaaataatgaacaagttaatggcccaactgaaactgtggtgttggacataaactttagaataaatcctaaatcttaagtgtgcaaataaattattcaaaacatgagattacctaacctattctagtgatatttaacagagatatgtttgtaactggtggaagaagaatcactccctaggtacaagatcaattactgttcattttattcacctgaagataaatcactttcacagattttgcagactacttcttttcctgaaaaaatgatttattaaagtggaggtttctttactatatcaacactggcttactcttttctttataatacttctatactgaaagaagccagaggccaaaagtagtcttgtttgtgctgctctttatttcattgttatttttaaaccagatgatgaaattcccttccattttgaagggccatttttcatgtacataggagggaatttaaactgtttgagttaatattaacatattctattactataaattggttttagtttgattttaaaatagcatattaatttacatttaattttagtattcaactctgatcagaaaaatagtattttggatgtaggggtaaggaaaaggtgtgaaattccagttaaaaatctaaagtactgtgtttattgtttcattgtgtgtctgcatttagtattgtttgtatgagaaaaagtcagttgtttccttatattcccatataatttttgagtagtatgacaatcttcatttatatacctgatgacttttaatttttaaaatgttgtctaaaccaggtttcaggtgatatatcttgcttcctaatttgacaactctgaatattactattgaaacttgtaagcaagtagaaattaaaatgaagccatacatagcatttgctttgattaaaaagaatagaaacctagactgttttggaaaattcagtgtatatttcagtgtatatatattatgtgtttatatattgacagatctgggcatcagaatagagtcaagaaataacataaatagaaattcagtaagaacacatatgaaactggaaaccagtggaggaaaactgaggaattgctgtttgtgagagacttatttttcactcagtatacttttttttactgttttaattgtctatatagcatgctgcatattaccaattttaaatacttaattttgaaagattaaaatggctggcaaatttattgcccatttgcaaagtacatttatatcaggcatagtacaatatgtagaatgttattggaacattggaacattgtgtctgaaatacttttttaaaaacctcataaaatatgaaaatacttcttaatgatttcaatattaactctattcattagacatctatcattatcctttatgtcagaaacttagagtgaaatcttattagcttgattgaagaacacttgttctcatttcattgtgctatagttaacattcaaagttaaagttatttttcttctccttgatagtatactataataagtatattcaaagtgatgctctagatttgtttccttcacatttagacttgcatttttacaatgtttatactaaggtttcttacacttgccatagtatatctgtgcggtggcttactcctgttaatcccagcaattagggaggcccaggcaggtggattatgaggtcaggagtttgagaccagcctggccaacatggtgaaaccctgtctctactaaaaatacaaaaaaaaaaaattagctgggtgtgttggcgggtgcctgtaatcctagctactcgggaggctgaggcaggagaatcacttgaacctgggaaggtggaggttgcagtgagccgagatcctgccactgcactgcagcctggacaacaagagcgagactccgtctcaaaaaaaaaaaaaaaaaaggatttttgcaatcattaacttacttcttgctgtctgtttttattgtctttggctgtccttcttaacttcttcaaagatttctagtatatttacactccttaatcctaaatccagtgtatgttggctctcatggtagttttccatttcatgtacttgcttgtataatataaatccctgttcttggtgttttgtgtatttatttatttggctgccattgtattgaaaattgtcttgacaattcatttatgaacatcattagtacagcaatatgtaattcaaaaccagcatgctcaaatttgtactattctggttagttattgctatgtgtgtattttcaaatttttaaagacttagagaatagtaaaacatatacttagcacaaatgatatcacttcttggtacctttctgtgagtccttcttcccataaggaaattaaattgttctttgttttcatgctaagtagcatgaaaaaaaagctttattgagataaatcaaatttagagcatttttatcacctcaaaaagagcccatatacattagctctcacccactcaattatccctccttggctattttgggtccattgcaattccaagtgaattttagagtcagtttgtcaatttacacaatgagtatagcttggattctgatagggattgtgttgaatctctacatccataatgggtaatattgccaatcttaataaaattttccatgaatgtgggatgtttttccatttatttggatcatctttaatttgttgcaacaatgttttgtagttttcagagtataaattttacactgtaaagaaaacttattcccaaatattattttctttttgatgctattgtaagtggaattcttttcttaattttatgttcagattattcattgcagatggcttagagatacaattgtgtgtggtttttgttgttttgtttttgagacaggctcatgctctgttgcccaggctgaagtgcagtggcacaaacatggctcactgcagccacaatctcctaggcccacctgattctcctccctcagcctcccaagtagctgagaccactagacatgcaccaccatgcctggctaatttttaattttttttgtagagacagagtcttgccatgttgcccaggctggtctcgaactcttgggctcaagcaatcctctggccttagcctcccaaagttttgggattataggcatgagccgctgtgcctagctcagtttgtgtgtgtgtgtgtgtgtgtgtgtgtgtgtgtgtgttttaatattgatcttgtatcctacagcctttctgaacttacttagctctaatattttttagtgggttctttatgattttctataaacaaaaccatgtcatctgtgactatagttgtgtttccttctttctttctaatttggaagcctttaactattttcccccttccttaattgctgtgactagtagttgtaatgtaacagtgaacagaagtggcaagaagagatgtccctagtcttgtttctcatatagggggaaaatatctaatcattcaccattaagtttgatgtttctctgcagttttcttagatgccctttatcagattgaggaagttactttctatttctgtttttttttagcgtttttatcttgaaacagtacagttgacccttgcacaacatggcgattgtgggtgctgacccactgcatagtctaaaatccatgtataacttttgattctcccaaaacttgtcaattaatagcctactgttaaccagaagccttaccagtaacataaagtcaattaccacatattttatatatgtatcatataaagaatatattattaagaaaatcatgagagaaaatgtatgtactatttattaagtggaaatgtttcgtgagaaaagtcatcattgtcttcatgttgggttggctgaggaggcagaggaggaactggttttgctgtcttaagggtggcagaggtggaagaaaatactggtgtaagtggatttgtgaagttcaaaccagtgttgttctggagtcaattgtagtggattttgccaaatgctttttgtttgtttgttttttgagacggagtttcgctcttgttgcccaggttagcgtgcaatggcatgatcttggctcactgcaacttctgcctcccaggttcaagcaattctcctgcctcagcctcctgagtagctgggatttcaggtgcccagcaccacgcctaacttatttttgtatttttagtagagatggggtttcaccatgttggccaggctggtctctaattcctgacctcttgtgatccacccgccttggcctcccaaaatgcgagattacaggcgtgagcaaccatgcctggctgccagatgctttttctatgtgtgttgagatgatcatgtaattttgttttctattctattgatatgatgcattgaattaattgatttttggatcttaaaccaaccttgcattcctgagacaaactccacttggttatgttatatataatttttaaatgttgctggatttgttttgctagtattttgttgaggatttttgcatcattctcatatgagtatcagtctgtagttttattttcttgtgactttgtctgattttagagtatcatagtaatactggcctcataacatgaattgggagatgtcttccctcttctaatttttagaagagtttgtggagaattggtattaatttttttaaaagaagcagcaattgcttatttttctaatcaggtgtctatgctgctgaatcttaaggcctcaacaaatgttgcaccttattatttcattgaacaataagaccttctattctgattattcccggtaaataggaataatcactggtttctccagtggtttccacttgccaaaaactcatgacagatgacttaacaaggtggcacctgctttcaggggattgtatcagatgcatactcatttccagtgcagcagctgttggcaatctaggacttctctatcatggttggccaagtagtcctgctttggctgccagagcttcattctgctgaatattacattcctgaagtctcatggatattctttttgtcatttaaaaatatttccataaagtgttctgaacaggctggtctcttcaggttttacatctgttgtgcagtcttaacacagtccaaaaagcagatttctgcaagtttattgtcagtcccaagaaattccttcaactgtttaatctgatcagattctggtatttgtgcacccatattcttttggtacatttattagtcatcttctctgatgcatgagtttcctttctgttcttgtaaagtagtgttccaacctttgtttgaatgtcttcagtgagacgtgatttcttacctaagcacaggctctcacatctgacgtcagtacaaggctggaggcctacactgccagtcgagtctgaggatggaggatcaggatcagggcaagcattgcagccgctttatctaattcttctttaaacgttcattagaattcaatagtgaagccattcagggctaggcttttctttgtgggtagtttcttgattactaatttaatctcttgttatataggtctgttcaagttacctattttttcttgaaatttttttagtcatttgtgcctttctaagtatttgtccatttcatctaataaataatctaatttgtttaatggctattctttctgacattaatatagccactttgtctttcttgtgggtgttgtttgcatcacgtatcttttttttttttcccagacagggtcttgctttgttgcccaggctggagtgcactggcaagcagaggttgccactcactggaacctctgattcccaggtttaagtgatcctcccacctcagtctcctgagtagctgggattacaggtgcataccatcatgcttggctaatttttaaattttttgcagagacgaggtctcactgtattgtccaggctggtcttgaactcctggctcaaagtgaaacccctgccttggcatctcaaagtgctgggtttacagatgtgagccaccacatccagcctgcatgatatatttttccacccgtactttcaatctgttagtaactttctatctacagtgtgtctcctgttgacccacataactgtcttttatgtatagttattagaactattgataagaaaatgtgaaagtatagtcccattatcttatttgagtggaatcagtagactatttcataaaatgtattctagtttatagtttagaatagtttgtttttcatggcttttgagaaaaacatttgaatgagcttacattttgttgcatttaaaatttctgggtttttgttgttgttgttgttgttgttttgagatgcagtctctctctgttgcccaggctgaagtgcagtggtgtgatcttggctcactgcaacctctacctcccaggttcaaatgattcttgtgcctcagccccctgagtaactgggactgcaggtacatgccacgacctggctaattttgtatttttagtagagatggggtttcgccctgttgggcaagctggtctcaaactcctgacctcaggtgatctacctgactcagcctcccaaagtgctggaagtacaagtatgagccactgcgcctggccaaaatttctgttttttaatgaatccaaagttcatgtttttttttcttcccaatgccatggtacatatcatcaccaaaaaaagtagtgattttgcttcagtgaacactgaattttaatattattgatagaatggctatatcgatcagggttttacacttatagtacagtatacttgcaatgtaggtaggcctcatcctttgtaattaattaattagcttgtaattatgtaagctaatctaaattttcatattttcagttttaacatttgggcttttgagttacatttcttatattttgatttttttctataaattttaaaaccagaaagacaacactagaatcaattaaatgcaagattgaaagggtttcataatgtaaaagagcaatcttgtttttgaaatgttcagtttacagtaaggatcgagtagctctgcagctaccgatttgggaaatacctgaggttttttttccccttgcacttacaggctgttttagccctgaaggtggctagtaaggacacagactttagagtgccacgacagttccataacaggaatgaattgaagaagagaagcagtggagtcaggagcctcacaaattaaagacaactggtgaagagaaaaaccatttattttcgatacttaagatggctgagcctgtaattccagcagtgctttgggaggctgaggcaggtggatcacgaggtcaggagattgagaccatcctggctaacacggtgaaaccctgtctctactaaaaatacaaaaaattagccgggcatggtgggcacctgtagtcccagctactcaggaggctgaggcaggagaatggtgtgaacccgggaggtggagcttgcaatgagcagagatcgcaccactgcactccagcctgggcgacagagcgacactctgtctcaaaaaaaaaaaaaaaaaaaaaaaaaaaaaaaaaaaagatggccgaataggaagagctccagtctgcagctcccagcaagaccaacacagaaggtgggtgatttctgcatttccaactaaggtacccagttcatctcattgggactaattaggcagtggttgcagcccacagagggtgagcagaagcagggtggggtatcacctcacctgggaggtgcaaggagctgggggacctccttcccccagccaagggaagccatgagggactgtgctatctggcccagataccatgattttcctatggtttttgcaatccgcagatcaggagattccgtcgtgtgcctacaccaccagggccttgggtttcaaacacaaaactgggcggctgtttaggcagacacttagctagttgcaggagttttttttcgtaccccagtggcacccggaaccccagcgagacagaactgttaactcccctggaaagggggctgaagccagggagccacgtggtcttgcttagagggtcccactcccacggagcccagtaagctaagaaccactggcttaacattctcactgccagcacaacagtctgaaattgaccttggaccattgggcttggtagggggaggggcatctgcaattactgaggcttgagtaggtggtttttccctgacagtactaaggtggcggggaggtttgaaccaggtggaattcaccacagtgcagcaaagcagctgtggccagactccctgtctagattcctcctcactggacagggtatttgtgaaagaaaggtagcagacctagtcaggggcttatggataaaactcccatctccctgggacagagcacctgagggaaggggcggctgtgggcgcagcttcagaggacataaactttcctgcctggtggctctgaagagaacagctgatactgacaaggaggattctcccagaacagtgcttgagctctgcttagggacagactgcctcctcaagtgagttgaggagactccgtgccttctcactgggagagaactgccaacaggggccaacagacacctcaaacaggagagctctggctggcatcaggctggtgcccctctgggacgaagcttctagaggaaggaccaggcaacaatctttgctgttctgcagcctccattggtgatactcaggcaaacagggtctggagtggacttaaagcaaactgcagcagacctgcagaagaggtgcctgactgttaggagaaaaactagcaaacagaaagcaacaaactcaacatcaacaaaaaggacccccacacaaaaaccccatccaaaggtcatcagcctcaaagatcaaaggtagataaatccatgatgatgaggaaaaaccagcgcaaaaacggtgaaaattccaaaaaccagaatgcctctttgcctccaaataattgcagctcctctccagcaagggcacaaaactggacggagcaaccccaagacacctaatagtcagattctcctctgagctgaaggaccatgttctaacccagtgcaaggaagctaagaaccttgataaaaggttataggaactgctaactagaataaccagtttagagaggaacataaatgacctgatggggctgaaaaacacagcacgagcacttcatgaagcatacacaagtatcaatagccaaatcgatcaagcagaagaaaggctatcacagattgaatatcaacttattgaaataaagtgtgaagacaagattagagaaaaaaaaaataaaatggaatgaacaaaacctccaagacatatgagactatgtgaaaagaccaaacctatgattgattggtgtacctgaaagtgacagggagaatggaaccaagttggaaaacacacttcaggatattatccaggagaacttccccaacctagcaagacaggccaacactcaaatttgggaaatatggagaacactgcaaagatactccttgagaagagcaaccccaagacacctaatcatcagattctccaaggttgaaatgaaggaaaaaatgttaagggcagccatagagaaaggtcaggttacctacaaaaggaagcccatcagaccaatagcagatctctctgcagaaaccctacaagccagaagagagtgggggccattattcaacattcttaaagaaaagaattttcaacccagaatttcatatccagccaaactaagcttcataagctaaggagaaataaaatccttttcagagaaggaaatgctgagggattttgtcaccaccaggcctgccttacaagagctcctgaaggaagcactaaatgtggaaaggaaaaagtggtactagccactgcacaaacacaccaaaatataaagaccaatgacactatgaagaaactgcttcaattagtgtgtaaaataacctgctaacatcatgatgacaggatcaaattcatgtataataatattaaccttagctgtacatggcctaaatgccccaattaaaagacacggactggcaaattggatgaagagtcaagatccatcggtgtgctgtattcaggagacccatctcacttgcaaagacacacataggctcaaaataaagggatggaggaatgtttaccaagcaaatggaaagcaaaaaaaaaagcaggggttgcacttctagtctctgataaaacaggctttaaactaacaaagatcaaaaaagacaaagaagggcattacataatggtaaagggatcaatgcaacaagaagagctatcgtaaatatatatgcacccactacaggagcacccagattcataaaacaagttctcagagacctacaaagatacttagacttccacacaataatagtgggagactttaacaccccactgtcaatatgagatcaatgagacagaaaattaacaaggttattcaggacttgaactaagctctggaccaagcggacctaatagacatggggttgctacagaactgtctaccccaaatcaacagaatatacattcttctcagcagcacatggcacttattctcaaatcaaccacataattcaaagtaaaacactcctcagcaaatgcaaaagaatggaaatcataacaaacagtctctcagaccacagtgcaatcaaattagaactgaggattaagaaactcactcaaaaccacccaactacatggaaattcaacaacctgctcctgaatgaatattgggtaaataatgaaattaaggcagaaataaagaagttatttgaaaccaatgagaacaaagagaaaacgtaccaaaatctaggacacaccaaaagcagtgttaagagggatatttatagcactaagtgcccacttcagacagctggaaagatctgaaatcaacaccccaacatcacaattaaaagaactagagaagcaacagcaaacaaattcaaaagctagcagaagacaagaaataactaagatcacagcagaactgaaggaggtacagacatgaaaaacccttgaaaaaaatcagtgaatccaggaggtggttttttgaaaagattaaccaaatagatagactactagctagactattaaagaagaaaagagagaagaatcaaatggacacaataaaaaattataaagtggatatcaccactattctcagagaaatacaaactaccaacagagaatactataaacacctctatgcaaataaaccagaaaatctagaagaaatggatacattcctggatacattcctggacacatacaccctcccaagactaatccagggagaagttgaatccctgaatagaccaataacaagttctgaaattgaggcagtaattaatagtctaccaaccaaaaaaagcccaggaccatacagattcacatccgaattctaccagaggttcaaagaggagctggtaccattccttctgaaactattccaaacaattgaaaaagagggagtcctccctaactcattttatgaagccagcatcatcctgattccaaaacttgacagagacacaacaaaaaaagaaaatttcaggccaatatccctgatgaacatccatgtgaaaatcctcaataaaatgctggcaaacgaatccagcgacatgtcaaaaagcttatccaccacaatcaagtcggcttgacatgtaaggctggttcaacatacgcaaatcaataaacgtaatctatcacataaacagaaccaatgacaaaaaccatatgattatctcaatagatgcagagaagtcctttgataaaattaaacatccttcatgctaaaaactctcaaaaaactaggtattgatggaacatatctcaaaatataagggctatttatgacaaatccatagccaatatcatactgaacaggcaaaagctggaagcattccctttgaaaaccagcacagacaaggatgccctctctcaccactcctattcaacatagttttggaagttctgactagagcaatctggcaagagaaagaaataaagcgtatttaaataggaatagaggaagtcagattgtctctgtttgcagatgacatgattgtatatttagaaaaccccatcgtctcagcccaaaacctccttaagctgataagcagcttcagcagtctcaggatacaaaatcaatatgcagaaatcacaagcatttctatacatcaataatagacaagcagagagccaaatcatgagtgaactcccattcacaattgctacaagagaataaaatacctaggaatacaacttataagggatgtgaaggacctcttcaaggagaaccagaaaccactgcccaagaaaataagagaggatgcaaacaaatggaaaaaaaattcagtgttcatggataggaagaatcaatattgtgaaaatggccatattgcccaaaataatgtatagatccaatgctattcccatcaagcttccattgactttcttcgcagagttaaaaaaaaaaaagaaacaaaccttaaatttcatatggaaccaaaaaggagcctgtgtagctaagacaatcctaagcaaaaataacaaagctggaggcatcatgctacctgacttcaaactgtactacaaggcaacaataaccaaacagcatggtactggtaccaaaacagatatatagaccaatgaaacagaacagaggcctcagaaataataccacacatctacaaccatctgatctttgacaaatctgacaaaaacaagcaatggggaaaggattccctgtttaataaatggtgttgggaaaactggctagccatatgcagaaaattgaacctggatcactgccttacacattatacaaaaagtaaccaagatggattaaggacttaaatgtaaaaccgaaaaccataaaaaccctagaagaaaacctaggcaataccattcaggacataggcatgggcaaagacttcatgactaaaacacccaatgcaattgcagcaaaagccaaaattgacaaatgggatctaattaaactaaagagcttctacacagcgaaagaaactatcatcagagtgaacaggcagcatacagaatgggagaaaatttttgcaatctatccatctgacaaaggtctaatatccagaatctacaggaacttaaacaaatttgcaagaaaataacaaccctatcaaaaattgggcaaaggatatgaatggacacttctcaaaagaagacgtgcaaccaacaaacatgaaaaattgctcatcatcattggtcattagagaaatgcaaatcaaaaccacaatgagataccatctcatgccagttagaatggcgatcattaaaaagtcaggaaacaacagttgctgttgaggttgtggagcaataggaatgcttttacactgttggtgggagtgtaaattagttcaaccgctgtagaagacagtgtagcaattcctcaaggatctagaaccagacataccatttgaccgagcaatcccattactgggtatgtacccaagggattataaatcattctcctataaagacacatgcacacatgtgtttattgtagcgctatttacaatagcaaaggcttagaaccaacctgatgcccgtcaatgatagatagagaaaatgttgcacagagacaccatggaatactatgcagccataaaaaaggatgagttcatgtcctttgcagggacatgatgaagctggaaaccatcatttttagcaaagtaacacagaaacagaaaaccaaacaccacatgttctcattaataagtgggagttgaacaatgagaacacatggacacagggaatggagcataacatacctgggccagctggtgggtaggggtcaaggggagggagaggattaggacaaatacctattgcatgcagagcttaaaacttagatgatgggttgataggtgcaccaaaccaccatggcacatgtataccaacgtaacaaacctgcacgttctgcacatatatcccagaacttaaagttaaaaaaaaaaaaaaaaagccaggcgcagtggctcacgcctgtaatcccagcactttgggaggctgaggcaggtggatcacaaggtcaggagatcgagaccatcctggctaaaatggtgaaaccctgtttctactaaaaatacaaaaaattagccaggcgtggtggcgggcatctgtagtcccagctacttgggaggctgaggcaggagaatggcatgaacacaggaggtggagcttgcagtgagctgagattgcgccactgcactccagctctggcgacagagcgagactctgtttcaaagaaaaaaaaacttcagtttacttgattttgcttatagagttctttgagaatttaaatcatcctttctgaattacagaaagtcatagattagaagtgtagctttaaaatgctctagatcactctgaattaagaaaaagggtttcctttgtccagaataagcatcaatttaaaacagcatttaaaaacaagtattcaacaaattggtatacgaattataacacaagcaactaaatcactgactttgattagtctctctactgattactactgttgaacagaagttgtgtgtaagaataggagaaggtgaactcattgtcttgagcatgtggaattagttcttgtctgaggccagatagcaatttttatcttattttcagtatagcagatcctatgctgccctgataagaatcacctgcacagcctcattgactctcacggaagtattccagtaactctttgaattttttcctagaaaaattggcatctgttacccctacacaattccttcataaacagtagaaatttcccccatgaaacctttcctttaaccttaacattcttcgataattatttatgaagtccttaaataattattacaacaagtattggttttgaatacgtaccagctttggaatactgcttaaggaaaccatgataaactccaactcctttatgattatttagaggaatatatctatttgttatagtcttaaggaaaaccttgtcaacatattagatgatagaaacagtcataaccagcgaccaccaggtttggtgggaactcatgatgtgaagggtctactccatgttctgccaaccaagtaactaagtcattttgggcaaatgattcagctgacttgatctgttacatgattcctaaggtctgttatagctccaatatttcatggcatcactccactttaatgtattatctatcttaaaaaagttaaacagaaagatcaattagcacttatattaaatttgagttgctgaatattttattttttctcacttccactcactgcttccactatttgggtaatgattgttggagctgtatgcatttataatgcattaagtacagtgtggtatatcagtaaaacttcattacaaatattcattccatacatttgtctgtactggggtcagtttttttccccttcttcttctttttaaagacagggtcttgctctgtctcctcctgtcttggtctcccaatgtgctagaactacgggcatgagacactgcacctgctcttttctagttttatttgtctatctgaagagtttattatttggctaagctcacatggcaaggtaggtatcatgaagtgttaaaacccagcttttctgctaatgttcttgtgagataaaccaactattagtaaagatacttgcttcctaatcaagattacttggaattgttaagagagtatgtatgtatgtataagttaactttttaaaaacttctctgctgcctggaggaataatgaaatgacccaaagggatagaagcaaaatatttcagatagtacataacgtatatacttagccttgtgcaatcaagaattaatgatataatgtgtatggagtaatatttaactttatttcgttataagcccttttgggatagtggttgttccacataacttttatcttctttaatgcttagtatctgctagaaatgtagtctgtgggatcataagagttggggaagatttacagatagcattttcagagactgaacagaaaagcatattgtcatttggaaaaattttaaaagtgtctaacttttattcaggaccatttgcttttattttcctgttgttatttatttctattatcttgtttacagttgaaatttggacaattggtctgtatcttttctaattttcattatatataaagacttaggtttcctctttccttatgtgtttgttggtaaacattaggtgctatttttaagttttcaattctcaggcatagtgctacttatccatgttatttatataagcaaatgagcatatttgccaatcaatccacggtaagaaacacaatttaagttcctaccaaggatacctctgtgtgtgtgtatgtgtgtgtatgtatctgaaatatttcactaaataattcatttttttttttttttttttttttttttgagacggagtctcgctctgtcgcccaggccggactgcggactgcagtggcgcaatctcggctcactgcaagctccccttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaataattcatattgttaatacctcaaccatatcttgatattctgttagctttttaaatgatggttgtgaccaactacagttcacatttttcactagtggatcacactctgcagcattaaaatcaccgtgaaatagattaattagaataaatgaagtgttcttttttcattctgtttgtacagtagatattattggattattttataaaatacccattttataaattggatggtatgttataaatggatagtaggatttttcctttcttcattttgtaccaagagaataaaaaacactcctgttcagtacatctctagcaagcctatttcaacatccaatgtctcaaataattaatttttctatactttagtcacccttacacctaaacgttacagtgcttcagtataacttctatgtaaacattattaatcccatttacagatgggaaccagagtgttgggagacaggtcatggatttctcatgttcctgcacagtctaagtgttctaaggagaggcatttacagtgccaattgtataaggagaaatttcaggacagtaaaactactgacatgtccctccctggagacgtccaaggataataaaaataaaagaccttctcttccccttcccagaggagatttgcttatatttgagtgtaatgagcaatctttctgggcagagcagggtggcaaaccaatagaagatcagagttccttcatttgggggttactctcctgtgatgctctctactgtatgcactagtaacatccatcccttactgcattgcctcatggagattggagctcagggaactggtctaaatatattgttctaggtgctgcttttgctacgagtaataaattgtctttgtttctgatccacagttcttgtgtccttatgtcattgtgtgtgtgtgcatatgtgtatgcaggagaacgaatgcggcagattgaagagcagttgaatatcagacctttgtagtgtggtggtggtgattatggtgttgagacagaattttgctgtgttacccagtctggtgtgcagtggcgcaaggctcatttcagccttcgaactttcaaactccatgggctcaggtgaccctcccagctggtactgaaggcacaccccaccatacccagtgattttttttttttttttttttttaagagacagggttttgtcatgttgccgaggctggtctcaaactcttgggctcaagcaatccacccacctcagcctcccaaagtgctggggttacgggcataagccaccatgcctagccctttgtgatttttttaacttaactctggctcacacaatttaactgtaggtctgtttgtaaacctgaagcgctttctatgctttcttccttacatagaccgataaaataagtagaaaatatggtgctaatgactagtatttggtataagtagataaatgttttgtatcacatttgcatgcttataatctgtgatcaatgagcagtctgaatatttttccctccatcctcataagttaaactaaaaaaaagttatagattgaggctgggatatctggtggcgaaattatatttatttgaacagagtttgtgtatatacatacatatttcagaatatattgaaaaataaaagtgtaatgaccttgataaaaatgaaatattcacttaaaaactccatttaataatgcccacaggaaagaaatgcttctagaattttttaactaatcatttttctcagtacttttgattgtcatgcaaactaaagaaatggacttaatgaacaatttagttacaataataaagtttcaaaaattctaaatttacctcataattgcaacagatgcaaaattatttcatatctttatactcgttatgaaattacctcatatccaaaaatatttatgtcaagtgacaggctttttgcagcatttttgatattattacccttgtaatatataattaactttgtaagttaaccttgtggaacttttaagggaaatgcattaacttagcattaatatagacttctaaaatttactgtgatgtagaacatttgatttaatgttgtctgtgtctaatacaaaataactgtggtccacttacttatttcaaattttattctcaaaggtacctactagattatgtgtgaagaagtttgtgaccaaagtaatataactgattctgttttgaaaatctagaataaagtttatgcaaaagcatatggattatttctttatgaatgcagttttatactaaaaactcctccatacccacgtaagtagatatattctcatagtgatgtagaaaactgacaaaacttttcatcctcagagctaggaattcttgtgtttggccacaagggaaagacaaaggtattagaattttaaataagctatcatcaacaaatactacatctctccagctccattcataaatatagcaacattttggaagtgcagatgaatcgaacatagttaagtgagaaaaatttttagtaacatacataatttgtaaatattgaatcgttttttaaatgatactctgagtcataattatttcaaattgtacataatgctagaagaaactaggataatagcagaataagttacagtgactaaaatcataggtttttttaagagattggggagtctctgtggtgcccagtctggagtgcattggtgcaatcatagctcactgtaaccttgactcctggcttcaagcaatcctcctgtctctgccttccttttgtagtttcaggtcttaacatttaagtctttcatccattttgagttgatttttatacatggtataagatgaggatctagtttgattcttctccatatggatatctttggtctatatatttatttatatgacagtaccatgctgttttggttactgtagcttggtaatataatttgaatttgtgtagtgtgatgccgcagctttctctttttgctcaggattattttagctatttggggtcttctgtggttccatatgaattttaggatttgttttttctatttctgtgaagaatgcctttggtattttcatagagattgcatttaatctgtagctcactttggttagtaaagatattttaacaaggccgagcatggtggctcatgcctgtaatctagctctttgggaggctgaagtgggaggattgcttgaggccagggattcaagaccagcctaggcaacatggcgtgaccgtccctacaaaaaaatatttttttaattagctaggcatggtagcatacacttgtagtcctgtctacttgggaggctgaagcaggaggatcctttgggcccaggtggtcaaggctgcagtgagctataatcatgccactgcactctagcctgagcaacagagagagatcttatctctgtgtaaaagaaaaagaagtgtaattaaaggaaaaaaacattttaacaacagtctttcaattccaaaacatgggatgtctttttttccttttctcttcagtttctttcatcagtgttttataattttccttgtatagatctttcatctgcttggttaaatttatttcctggttattttatttttttgtagctattgtaaatggtttgctttcttgatttctttttcaggttggttgctcttagtgtatagaaattctactgacttttgtatgtcgattttgtatctgacaacttaataaattcacttaccagttctaatataatatggtctaattaatatattagactagaagtataagatctctcctggagaatgttccatgtaccgatgagaagaatgtgtattctgtggcagttggatgaaatgttctgtaaaggtctgttaggtttatttggtctagagtatagtttagcttcactgtttgaagttaaacactgatgttcttacatttcttataagaacattttatgtttcttatgtataagaacactgatgtttttatatttctagtctaataatgtattattaaactaaaaatataagatttgtcctggagaatgttccatgtcctgatgaaaagaatgtgtattctgtagcagttggatgaaatgttctgtaaatgtcttaggtttatttggtctagagtatagttttttacttcagtgtttgttgattttctgttgggatgatctgtccattgccgaaagtaggaaattgaaatcccctactattattgtatttatctcttgctcttgctcttatgtattcacacttgctctctctcatgctctctctctctctctttccctttgtatctaataatatttgctttatatatttgggtacaccaatgttgggtgcatatatatttactattgttatatccttttgctgaattgacccctttatcattatattatgatctcctttgtccctttttacagtttttgacttaaagtctattttgcctaatgtaattataggtattcctgcccttttctggtttttatttgaatagaatatctttctgcatcccttcactttcagcatctatgtgtctttataggtgaaatgagtttcttgtaggcagcatgtatctgggtcttgtttttaaaatccattcacccaccctgtgtctttatttgggttttatttgagatggagcctcactctgtcccccatgctggagtgcagtggtgtgatctcggctcactgcaacctccaactccctggttcaagcgattcttctgcctcagcctcccaagtagctgggactacaggcgtgcaccaccatgcctggctaatttttgtatttttagtagagacggtttcactatgttggccaggctggtctcaaactccggacctcatgatccacccgcctcggcctcccaaagtgttgggattacaggcgtgagccactgcgcccggcctatcctgtgtcttaattggagcatttagttcatttatattcagtattattgatagataaggttttactactcttattttgttacttgttttctagttgtttttaacttttcttctgcttcttttcttactgtctttctttgtggttaggtgattttctcttaagagtacattttaatttattgctttttatccatttttgctctgtggttaccaagaggcttataaataaacatcctgtagttatagcaagtatttaaaactgataatcaacttaactttgattggaaaaaaaacacacaaaagtgaacattaacttccttctcccccttcattttgaatttctgatgtcacagttcacatttttatattgcctatcttgtaacaaattgttgtagttattatttttaatagttttgtcttttagtcgtcttactacagatattagtgttttaaacactgcaaatacaatattaatataacactcattttagtgtttcttccagtttgaagaagtttttaaagcatttcttattggacaagtctgattatggtaaattccctcagcttttgtttgtctaagaaagtctttatttctccttcagttttgaaggataattgtgctgagcacagtaatcttggttgacagtttcttctccaccagcattccaaatatattcttccacattttcctggcttataaggtttctgctgataagtctgctaccaggcatattggatcttccttgcatgttatttacttctttcctttcagtgatttcagaagtttttctttgtgcctttgacctttgtgagtttgattataatgtgtcctagagtagtcttctttgtgtttaatctaattagtgatctttgaccttagtctacctgaatatttatatcttttttcaggtatggaaagttttctgttatcatttccttgtataagttttctacccctttgtctttctcagtccttctttgacttcagtaacctgaatatttgcccttttgatgttgtcccatagattttgtaagcttgcttgcttccttttctttttttttctcttctcaccatatttttaatcatttttctttgaactcactgattcttttatttggttaattctgcttctgttgctctctattgagattttcgcttcattaattttttttttttagttgcaggatttctggttttttaaaaaagttatttgagtctcttatatttctttcataattttctgaattgattcttcatgttttctttaagttctttgagctgtcttcaaacaggtattttgaatttttggagagatcacatatctcggtcactttcaggttagtctgtggtaccttattttgttcttttggtgtgatgtatttccctaaatgttctcaatgctttagaagtgtgatgatgtctgagcattgagggatttgtaatttattttagtcttcccagcctggctttgtttgtgcctgtccttcttcaagaggccttccagggattctaaagctgacttactattgcattctctgagcctctgaccaattacagccatctcagcactagagtatgctttaagcccaggttttctgagtcctgcaagggcaccaaggttgacacagctttctggcccagatggacctcgggaagacccaagggaggtagttgggctgcctgggaatgctgtccagacacctgaagccagaagactctcctagtggtcctgataggtatgcctcccaacaaatctctgcacagatgggataggtccctgactacaaagagagtggctggagttgagactgtgcgtctttggaatctactgtggaaaggaggctgattggctcacctcattggctcagattagcatgcatcacccaacaggtcccagtatctgggcagtttcttgactgcagcaagagggcttggagccaagactgggccccttcagtatctactatggatatgcctgtcacatggatccagttgggcgtgtgtctcccagcaagtccctccatagatggaatgattccctgactacagcaggagaggctggaggtgtgactgtgcccccttgggatttgctgtgggacagaggattgagagcctggtcttggctcagaggggtgtgcatcgccctgaatgttcctgcacatacaggatatttccccaactgcagtgagacgagccaaagctgaaactgcaccaccctgggatctgctgttggatggaggttgatgtgcttgtcatgttggctcagatgggcgtatgtctcccagcaggtctctgcatagacaggagggttccctaacagcaggaggagggtctggatctgagactggaccctctcaggatctgctgtgggatggtggctggagaacctggtctgagcatgcatctcaccagtagaccctgtagacaagatagtttcctggttgcagcaggaaaggctggagctgagactgggctccctcaggatctcctgtgttgcagaatctggagagcctgtcttgtttgcccggacagatacccctcttccagcagatctctgcacagaattattttcagaccacagcaagaagggtcagagctgagaatggaccacctgaggatctgctgtgggatggaggttggcgtgcctgtctcattagctcaaatgggcacccatctcccagcaggttcctgtttctgcacagataggatgcatcccctactgcagcaggaggagctgaggctgagtctggggcctcccttgggatctgtggcatggagtctggagccccttgtctcattgactcagagacacacccacaggagataacttttcaacttctagtaagcaatcatttgaatcattaagtatttttggtgtattatacataaccacacttaattacaattcatacctgtaccttcttattgctacccatatttgaggaataggtctttcccttctttccttctatatttaaaaccttttatctatattttcttctcatgccttgagtctaatctcaaaccttgttctcttcttgatctttgctaactttgttgtaaatgtgctcctatcccactattgaaacaaacaggcaaactctccaacattcgccttatctatcctcatttcagctgaatttcttgacagtgtagttcacacttctttatctctgatgcattcagctgctctcaccacgtttttaaaatccagtgggcacgagtcacccatgaccttttagttgccaaatccagtgaacacttttcagttcttgtctgacttatctctggcatttatcagtgttgaccttaccataactctgaaacttttcctgtcttgcttagcttatgtgataccttttccctcaggtttttcttcttttctggctcctcttcttccttttccacagctggcaattcctactcttacagctcttctaatgttttcctttcctttcctttatctttaggcaaaggctatggtgtgtgtgtgtgtgtgtgtgtgtgtgtgtgtgtgtgtgtgtgtgtgtgtgtgttctagcaacctctttcaaatgaattccaatggattctaacactaagctggagtgtcaggtactacttgtgatttcttctcttttatcttcctgggagttttacagaatctacagtagtgatcactacttcccacagtcttttcctgacactttctttctccctttctccagtttattcacttctcttttagattacaggacaattttcctctgttctccgtacatccagcctggctgtcctccagtctgtgttccatagagctactgaaaaccctactaagaaacaaattttgtaataccatttccttacaatgcttcagtaattaatgttaacatttaggttaaaaacagccttatcattaagaaaacttttaaactgatttaaaatttatataatgtgaaatcattttaaagtatacaattcagtggcatttactgcattcacaatgctgcacaaccacaaccataatttctaaataattctaagttttcatcaccccaaagggaaactccatacccatcaagcagtcatttgtcattctcccctccagctagccccgttcatccattaatcagctttctgtgtccgtgggtttacctattctggaggtttcatatacatgaaatcatcactatatgtgaccttttctgtctggtcttttacttagaataatgtcgtggaggtgcatcccattttgttgcatatattagcacttcatttttttgattgaataatgttccattgtatagctataccacatttgttattcattcatcaattgatggacattcgagttgtttctgccttttgaatgcctgattttgattcatttttgtagagtccttaggttttcctaagtataagatcatttcgtctgggaacaaggctaatttaatttcctctttttcaatttggatgccctttatttctttgtcttacctaaatgctttggctgattcattttgggcaaatacctgggaagagtgtttaattgctgggtcatatggtaattctatatttaactttttaaggaaatgccaaactgtctactacaacatctacaataagataaattttcaccagcaacttatgagggttccagtttgtgtacatcctcactaactcttgttattttattttccagttttaaatactattaatatctaactcagtgggtataaagttatatctcattgtatttatgatttgccttttcctaatgactaatgatattgtaaatgttttcatgtgcctgttgcccatgcatacatctttttgggagaaatgtatattcaacttactttcccgttttttatttgagttttatttttaaccaagaaataccttttaagtgatcagacctggaaccttgccaggtttaatgattatcaaagcagagccatattttgacttttgatgttatctattattatagtcttgttattcataattacttgaatattatcagcatctctagatcctttgtagttaaaacatagtaaagtattttaagtctttatactaaaatagtacgtcttgaaagttttaatatagaacactctgcttagcatttctttataacctaaaatgcaattaataaaagggtgtcatttcctctgccaattaagtagccttcattggttgatattgaacaaattgctgatacttatttctgtgatgtttactttttaaaaaaaatattttttgctttctttttaacacttccaaacaattgctaggttaatttgtcagttgcaaatctgaaataaaattgtttttagcagtctttcaaataaaattttcgttgagactaaagagatcctggattacaatcaacatttgtagatatgtcatacatagagaaccaaaaaaaaattataaatctgatataaatatcagtgtgccatacaggcatggtggctcatgcctgtaatctcagcattttgggaggctgaggcaggtggatcacttgagtctaggagttcgagattagcctgggcaacatggtgaaaccccatctctataaaaaatacaaaaattagccaagcatggtggtacacacctgtagtcccagctgtttgggaggctgaggtgggcggattgtttgagcttggtaggcagaggttacagtgagccaagattgtgcctctgcactccagcctaggtaacagagcgagaccctgtctcagaaagcaaaacaaaaacgcccaaatatcaatgtgctatgaaaccacacattgtatgtgttcattcccacaaattggagcattttaagaagcgctctaaattagtttatgtcttgcttttcttcttatgttctgtagattctttagtactccataagaaaaatttgctatagaaagcataaaaactgcaaatgcattatatcctccatgaaaccagctttaatttagttgctaaaccctgatcattgttgcactatacactcagaaaatgtatagcagtgactattttgtaaatatgaagagttcatattcagcacattcagcaatggtttatatctaaaatgatttttgaagaatgctttaaaaaacttctttgcctagagtctttaaagctggcactttaaaactatgtttcatggattgtcagttggaatggacttcaggaggtccataagtccatgaaattacagttttttaacatgaatttttctgaggatacatgatttttatcatactctcaaaagaatctaaaactcaaaaatggttaagagacacttaaataaaatgttgataaaggccatggtcattgattctcattcttcagaagctttgcatgtgtgagtttacctactcactaaaatgtacttgtaaatccaaaaccagtactcggtgcttttgcagtcatttgtaaacatatttggagaagcaaaaattttgagttaccttatgtgttcattcctctctgaggtcaaagaaggtgatggtttgccttgtttcagctgtcatactgtaaacaagtgtccttttcaatgcgtatttagtgccatattaatcacattttttgttgttgatttttctgtttaaaatggttcccaagcatagtgcagatatgctgtctagtgtttctaagcataagaaggctgtgatacacctgagagaataaaaatctgtaatagacaaacttggttcaggcatgagttacactgctgttgactgtgagtttattgttaataaatcaaatatgaagtatcaatatctgtataaatagttaaatataattatatatagatgtaaatataaattgttaaaatacggaatctttaaacagaaacatacattttagaaattatgtattggcattggttgaccaagatgatgtttggagaggttttcaggaaactaaccctgtctttttcccaggaacaataattctgcaggaggcagaacctgttgtctaggttggagtacagtggcatgaacatggctcactgcagttttgacctcctgtgcttcttctgccccagcttcccaagtagttcaggctacaggcacatgtcaccatgcctggtaatttttgtattttttgtagagacagggtttttcttgcccagactggtcttgaatttctgggctcaaacaatcctcccatcttggccccacaaagtactgagattagagatgtgagcctccatgcccagctatagttaaccttttgcagtgtttttttttttaacttaatgtttctaaatttcttctagggtaaacatttactacgtagaggctgtgtgtcatttacctcttcatggtatcacacatcagatacttctaacataatcatgataaatgttagtggtttcatggtcttatttacactccagctctaccagaattcactaatctacttcaagtttctgtctgaaatattctttttttttttttgatacagagtctcactttgttgcccaggctggagtgccgtggccccatttcagatcactgcaaactctgcctcctgtgttcaagtgattctcctgcctcagcttcccaagtagctgggacttacaggcacacgccaccacacccaactaattatatttttagtaaacatggagtttcaccatgttggccaggctggtctcaaactcctgacctcaagtgatctgcctgccttagcctcccaaagtgctaggattaacagacacgagccaccgcatcctgcctctgtctgaaatattcttattgttcatcatacagtatattgggctacagtactgtatttttctccagggtgttggtaaccatttatgctgagtttagccattttacttaagagtctactaattcactgtagataaagagttactactttggcatggtggagcatgcctgtaatcccagctctttgtgggaggccaaggcaggtggatcgctcgagtctaggagctcaagaccagccaagacaacatggcaaattttatttctacaaaaattacaaatattagccaggtgtggtggtgcatgcctgtagtcccagctactgaggaagctgaggtgggaggattatttgagaccgggaggtagaggctgcaatgagccatgattgtgccgctgtgctccagcctcagagacagagcagtaccacaaaaagagttagaagagttctttatctaacaaatatgagttgtatatttgcatagttgattgcattcatgaagtctaagtatttttttattcattaaatctaaaggaagttggggctctctgctttcgataagatgaagtaacaagtactgtacttatccttcacctaaaataatgattaaagaaaatttgtgtgtttatttcttaagacacagaacaagcatttgataaaatccaacatccattcctcataaaatcactcctgaaactggtgatagagaggaacttcctcaacctgataattagcatctataaggaaccaatggtaatattatatttactggtgaatgtctgaatgctttctcactaagatcaggaataagacaaggatgtctactttcactacttctgttcgatactgtactgcaggttctagccagtgcaattagttaagaaaaagaagtgcttctagattaaaaaacagaagtaaatcaatcattatacttcagtgatatgatcatctatgtatattattctatagaatctacaaaaaggtactagaatgaataattgagtttagcatgcttgcagaatataagatcagtatttaaaactcatgtagttttctgtactaggaacaaaaatttgaaattaaaatttaatagaagaaatattttctatcacataaataataggctatacttggggacaaatctgacaaaagatctggaagacctttactctgaaaactgtaaaaacattactgaatgaaaataagtgtgcagattctttacatatgatactaatagaatgatctgtttaaaattgattaattgtgcatcagctatatacataagccaaaacttaaacaattgtacaccttaaatatgtacagttaattttgttaattcaaatccctatactactgttaaaacaaattagaaaaacaaactaaaggaatttatgttcatatgacagtgaatgagttgtctgaactcacctcaatttttaatcctaagatgaatccatctctaaaaagtactgaacatctctgaaaagttatgaatatggtgtatgttttctcccataacctcatatatagcaattattgttattaggaaatcagaactagcttaaataatcataacattgaccatctgctttccttgttaaatacatttgactactaacttaatgttttcagttagccctctaaaatttgagaaagcaacatcttttttacctttttgccagatttctacaggctttctgatatatagttggccctctagatcattgctggcagtttgaaatatgtgtgattatgatagagtatttaaaatattttattataaatatttgatcaattttttattatataaattttcttcttttaaaaaaatacaatttagagatggggatcatactatgttgcccaggtcttgaactcctgggctcaagtgatccttctgccttggcctccaaaagtgctgggattatagatgtgagccactgcacccaggctagggtaaacttttgataaatatttttgattatgtagaataattttatggtgagttcaaagtagggttttgcaatttttattgtggagatgtatttatactgttagtttcaggatatctgtactgatcatctcctgtgtttttaatcatgatgtttccttttcaaacaacacattatgatgaaagatcaattttcaatgaaatcatttataagtatatactagctattgcaactttggggtttggaaaggaaaaattaaagtgtgttatgtttacatgttggaaacatgttagaaaaatcagtctaggattggaaggagatgggaagatttaggagtaactgctaatgggtacaaggtttcttcttagggtgagaaaatgttctacaatgatttgtggtaatggttacagaagtatgattatacctaaaatcattgaatcatatgctttaactggataaataaaaggcatttatattggaaaggaaatagtaaaactgtatctgtttgtagataacatgatcttatataccaaacaaaaatcttaagcagtcccctacagatctattagaagtaataaatggcttttcacactacccacatagacgtccatacggcgttctttctggattcccatcgtagcttaaagcgaaacttttcaccatgtctggagcccttgatgtcctgcaaatgaaggaggaggatgtccttaagttccttgcagcaggaacctgcttaggtggtaccaatcttgacttccagatggaacagtacatctctataaggaaaagtgatggcatccacatcgtaaatctgaagaggacctgggagaagcttctgctggcagcttgtgccattgttgccattgaaaaccctgctgatgtcagtgttatatcctccaggaatattggccaaagggctgtgctgaagtttgctgctgccactggagccactccaattgttggccacttcactcctggaaccttcactaaccacatccaggcagccttccaagagccacggcttcttgtggttactgaccccagggctgaccaccagcctctcacagaggcatcttacgttaacctatctaccgttgctttgtgtaacacagattctcctctgcactttgtggacattgccattctatgcaacaataagggagctcactcaatgggtttgatgtggtggatgccagcccgggaaggtttgcgcgcgtgtggcaccatttcccatgaacacccatgggaattcatgcctgatctctacagagatcctaaagagactgaaaaagcagagcagcctgctgctgaaaaggctgtgaccaaggaggaatttcagggtgaatggactgctccagctcctgagttaactgctactcagcctgaggttgcagactggtctgaaggtgtgcaggtgccctctgcgcctattcatcagttccctactgaagactggagtgctgagcctgccacggaaggctggtccacagctcccaatgctcaggccattgaatgggtaggagcaaacactgaaaggtcttaagctgttattgcacacgctcttaagcaacatggaaataaggttgacggaaaataaatgtcagtttaaaaaaaaaaaagtaatgcattcagcaaggttgacagataaaatatcaagatagaaaaatatattggatttttgagcaatattaatgggcaaattgaaaatgaagttatgaaacaatttcatttaaatatcttaaaaagaaataatgtacttaagtataaatataacaacagaagtgtggaacttatactctaaaaactacataacattgaaagacattaaaggaaactaaatggaaagacattaaatgttgatattttgaaaagatttaatatttttaggatggcagttctcccccaaattgatctaaaataaatttcctactaaaatcacagctaaattctttgcacaatttgacaagctgctcttaaaattaatatggaaattcaagggacccagtatagccaaaacaatcttgaaaaagaccaaaattgtgtttctcacttcccaattaaaaaacgtatgatgaagccataccaatatgtagttctggcataatgatagacatatctattaatggtatagaattgagaacagaaataagtcttcacatttatggtaacctgtctttctataagtgtgccatggcataaagaatagtcttttcaatgaagggtactagaacacctgcccatccatatgggaaaaaaaaaaagctggacccctatctcatatgcaaaaattaactcaaaatgaattaaagacttaaatgtaagaactaaaactgcaaccgttagaagacatagggatacatgtttatgactgggcatgggatatgagctggcaaatgattcttagataggtcaccaaaagcatgagcaataagagaaaagaataaataaattagatttcatcaagttttgaaagttttgtgctttaaaggacaccatcaagaaagtgaaaagacaacccacagaatgggagaaaattgcactcacatatctattttatcttgaatatataaagaattatttagactcaataatgatgaaaagacaaataactcactttaaaaaatgggcagaatatctgagtaggcagtttcccaaaagaagatatacaaatgactaaggagcacataaaaagatgctcaacataattagctatcaggtatattaaagtcaaaactacaatgagataccatttcactcctgctaggatgatgggtataatcagaaggacagagttttggcaaggatttggagaaccctaaggcattgctggtgggaatgttaaatagtgcagcctttttggaaaagagtcttgcaattccttaaatattttaacatagagttaccatatccagcaattctgctcctaggtatatacacaagacaaatgaaaatgtttgcacaaatgtttatagcagcattatgtataatagcctaaacatggaaacaacccaagtgtgttactgataaatgaataaacaaaatttggaatatccatgcaatagaatattatttgacaaaaaagaaatgaagtactgatacatgctacaacatgggcaaattttgaaaatatcgtgctaaatgaaggaagccagtcataaaagtacacatgttttatgattccatgtctgagaagtggcctgaacatgcatatttttagagacagaaaataaattagtgtttgcctgggacttgtgaagatgaggttttcggaagtgatgactcaagagtgaactggtttttttggggggtgttgaaaaatgttctaaaattgatgtggtgatgcctatacaactccaaatatactaaacaccattgaactgtacacttcaaagggatgaattgcatagtatgtgaattatatcttaaggagctgataaagaatatatatttattggtctgttttaccctttgaatggattttacccatatgtgatgtttttaccatgatacattaatcatttgccagagtttttgttccttaaattatgcatatcttacaaatgtaaaatgtcttatttgtcaatatcactactaaacaagaaaatagtctttaagcattgggaacctcactggtggatatgagttttacacgatcataattttcagagacccagggagaattatctcccattttttgattagttttctgtacactgttgcctaattatctttctgaaatacagattgatcaggtaactctctgatcccagcctgcttgtcattgtcatgcatggttagtccttcataaaatatgctattatggaccccatcttttactaaattcagagaaagcatgcccatgtctctctgtgttttttgtgtgtatgagtttctctatgtataattcactttagtttatttttcttcttttcgcctggtaaaatcttcaaacttcaagaaacagcatatctgttatttactctttgaccttttcattataccccatattccttggtgctttccaagttttttgttcgtacctttattataacactcctcgtatgttgttttcatgcttactcctccagtagagctatgaacttctcatgactttatttgtgcttctattccctcacagagtactttagatataataagagtctcttggattaatgagttcctaattttattgtgggtgctcagtaacatttttattttgatgatgttataattgaggtatgaatcagactccccttacactttctgcatataaatcttttttgtaaaagaattctatacattttaattatcctataaaaacttaattaccaatattgtttgtagatgtctgttgccagatttttaaaaaatgatgcattaccatccccataaatgataattgccttttgctttttttaatataaaaatgacaactttgcctgtcaaattataaaaaatgttttctcattattttcatttgccattctttggttactgtgctagagaatatatatgtctattgtttgttagtgtttatatcattgccctttaaaaaaattgtagttgtgcaagaatggatgtaggcaggctaaaatatggactctccagagatgtggatatgcctgggaaattgtcatttgatttacctgtcttcacaatcagcattttggaccgtgatacagttgttactacctatttacacttggctgataggcaggctcaaagctgtagcctcttattagagtcagtcaaggggggccagaatggcaagagccatttttttttttaaactgctggtcctacctcagcagcaccaggagagtggcaaagggggcttcttcaaagattttatggtatcttcactttatgtcaaagtctaagctatcagtatttttctttgtagtagttggtgtatgtgccaaagttagaaaatctttctctgtcttggttattaaaataagtggctgaattttctaatacctttatgggttctgttttgttttggtttgttttttcatttgtgtggggtttttgttgttgctgctgttgttgtttttacacttttggttaaagtgtgacaggaaaaacttttctttttttccctgaaaatggttctgtttttatgccagcttaatgtactaattccctcatttccgtctaaaaaaaaaatcacctttattttaatactatattgccataggtacttggatccgtgtttgaactctgtatttttctgttgatctgtatattagtaccaaattgtttctaaagcaattaacaaataatacattttaatacctggtagtaaactgctcccttaatcccatcattattactcatctatttcagaaggtactttcttattattcttccacatgaatttaaaaatcatattgatattttcaaaatatcacattggaatttgtaggttctttaggaagaaataacattttagggtacatttttgttttcttatcatatatcaagtttttcattttaattatttatttcatagctttttattatcgaaagtttcaaacatacacagagaaagaatagtaggtataatgagctccacgtttctattctctatctagcttcagtaattatttacatttgccaaacctgatttaagtacctctcctatgaagcaagtcccagatgtcttatcatttcatcctcaaatgctctagattgcctgagaatggtctcaaaaaacccaccatcatattattcacaatggtaatttcttactgctatttaatatccaatttagatttgcatttcataattgtttcaaaaatagccttttacagtaagtttatttgaatcagcatctaaagaattcaaacactatatttgtaccttgtgtcttttattattactgcttttctctctctcgtcttttttttttttttttaatactgtcattgacctttttttaaaagagaaactgtgttatttttccaggagaatatctcactttctgaatttggttagttgcttcatatttagtatttgctgagaatttgagctagagatttggttaaactcaggttttatttctttaggcaagaatcttcttaaagtgatgctccatcatttccattttatctcatctgtgagccatcatatctggtggttccacttttaatgatgctgagattaatcaatatgttcaggtgtaggttttttgtttgtctggttttctttctgctattgtatatagaacattttccttactgtttttctagtaggttattattggtatctgagaagatttttaaagcatgtgttttagtaactggacatctgaccaaactctcattactgtgtcaacttaaaaatcatgagatctgtaaatctggaaaagagaactttatttctgagaagggttacaacctgtaggctgggaagcacagcctctggattagatcaaaagtagccatttcaaagacgatgggtgagagaggagttttacactaaatgggttagctgaacatacatatttaacaggttataggaggagctatgagtattcatgaaaggggttacatgtatgtatgataagcaaacataacatgttacatatgtcccatgttcgctttggaatggagacttaacattaaaaatgtggtaaaatcagactctatacatcaaaggtgaaacttaggactcaaaggtgctttgtgcacattctctgtaaactgaccagtccatggtcaattgtcgtttatcaggaaggattgctttgtaagttggtcagcagtcatgtcaaaaccatgaaaagggaggggaatctggccacaacatcaggcagttggtcagtggaagaattttccattctttcttttccagggctggtgtttgtttaactcttaggaaaaatagtctaatgacaggtagtgaggaagagtgtatactgagacgtgaccaacctcctatctcatcaaggccgggaaacttcgtttttaaagtttttctggggcctccttagcccacagacatctgttcagtaggttggggcacttaggattttactttatctcacaaatatctaataaaatttttgggtgatcctcttcagtgactagtatagaattgtcacacttgagctttggagatgaggtgtctcaaattaaaccctaggatggttatttagtctttctgtgcctcagttttttttttttttaatctatgaaatggagatcatgtgtctacctcataggtttataatgaagattgaatcacttcccataataatcagaaactacatatttgggctgggagcagaggctcacacctgtaatcccagccccttgagcccaggagtttgaggttatagtgagttatgagcatgccaaagcactcagagtgagattctgtttcaaaaaaagaaagcagatgtttgttttttaatttttccatatcttttgcagattgtgatattgtgctttccctttttttcatattttaggcctttaattttaggatgtaattatataggccataacagttaaaaaatagcagtgataacatgcatcctacaataacatgaatagctaatatttattttagtataattttcttcttgtataattatgttgttttagtagtatgttttgaatatcaccagaataaatttttggtatctattaaaataatactataatttctttacattgatcttttaagatacagtttatccaatacttatgatgccaggttccagaatgcattagaagagtgtttgtggcatagggaatgttggaacagaagcaacactttacaatgttaaatagttttattgagaaggtgagatttgggtaaagactttcaagatgagtgaggatccatatgggtttctgggggaaatccagttcagtggaggggttggcatttgctaaaggagggcatgtttggtgtgtttcaaaatccagtagggagccgggtgtggtggtgtgcttctggagtcctagctgctcaggaggctaaggtgggaggattgcttgagcccaggagttcagatctagcctggacaacatagcaagatcccatctctaaaataaaataaaaatttaaaaaattgtttaaaatcctgtagagagttcagagtggttggagcagagtaatggagaatagtagacaatggagttagagaggcaatgagaggtaaagggaagtggcttgaacctgtagggcctcatagactattgtaaagatttttgctttttagtgagtgttgttggaagcattacagggttttgaacaaaggaatgacatactttggcttgcatttaaaaaggacagctctatgtgcgtggagtcaaggatggaagcagagaggttaggaaatcatcgcaacagtctaggcaagcagttatggtaacttggatgggtggtagcgtggagttaatgaaaagtggttgaaatctggaaatagtttgagaacaggcttttcaaatggactggatgtggtgtgtgaataacactcttctcactggtcttgttgcctctccaatccagttatacacagtagcaaaaatgatcttactttacatttgataatttcaccttcttgattaaaatccttcagtgacatactattacactgaataaaatttatccttcttaatataaccaacaaggcccacataatctagaactgcatatttttctaaccgttttcatctccctgagctccagccatacaggtgttaaattgttttaatatgccaaagtttttcctgcctcagatgctttgcattgctcctccctctggaaacttcccctaaccgtaaggtcactctttacccaatcagctcatttgcatgtttcacgtctcagtttaaatgtccttttgtctatttaaaatatattttagctgagtgcctttaatcccagctacttgggaggctgaggcaggaggataacttgaggccaggagatagagaccagcctgggcaacatagagagacctggtctctgaaaaattgaagaattagctgggtttgatggcttgcacatgtagttctagctacacaggaggctgaggcagggaggatcacttgagcccaagagttcaaggttacagtgagctatgattgtaccactgcactccagtctgagtgacagagtgagactccatctctaaaaaaataaataattggttccttctttgcctgcctcccactctttgtctttctcaaacatttttttcttcatagcatttcttacaattatgcattttatttctgtgtaatgtttttgtttgctatgctttgcattttatattgtgtggaatctccatgaaaataaggaccagcctgacttgttcaagtttgtggtcaagtaacaggatggtacctggcccttagaactatctttataaatatcattagattggattgactgactcaattaatgaacaaatgaacaaacaaaataaatcattatatgctgaagtagcagtcctggacattgtatctaatttagattttaatttaaccttgttattttgatactcgcttcccttaatcagtcattgcatgttccttattgtaaggtggttgtttttctttatcatgagaagaatagttcttctccgggcgcagtggctcacatctgtaatcccagcactttggggaggctgagacgggcggatcacaaggtcaggagattgagaccatcctggttaacatggtaaaaccccatctctactaaaaatgcaaaaaattagctgggtgtggtggcatgcacctgtagtcccagctacttgggaggctgaggcaggacaatcgcttgaacctgggaggcagaggttgcagtgaatcgagatcgtgccactgcactccagcctgggcgacagagtgagaccctgtctcaaaaaaaaacacatttttttatttagctattagcttctaggcaaaatcttaaatttcagaaaataattatactcatatagtcatactacctgtcagggaaatgtgtcaaaggaaatatgaaacaatagctttaaagttgtcccgcaccctcaccctgtttttcttttgaaggtattatactaaaggaagaaagggaaaaagagaaatctatggtgtgagttcaagtttactactgtaagtgtttaagaaagggctctgttaccatgacaacaaatgcatgaatttcatgtggaaaattttcagtgtatgggactgataaaattgtaacattctgattttctctggtatagaattgttctttgtcaagttaaaaaaaatctgttaatatatgttaaaattaaatttttaaatgttttatgatattgttttctaattgtttattataacttaaaatcatagccaaaagagtgtactttcgtagatctgtcaagcagaaagttaagtatttgatttgacattaaaaattacttttctaatctgtattagatttttgctaaatggtaaataaaatggtaaatagtttcatgtattgggagttcttgacaatagaaaatgacctgccactttatagattcctttgccttaaatgcttactaactcaggtagaggaaagctgttaagctttaagtgctttgtcatatttgcaggcttttatagtggaagagaacagcagtcagcaatgatgatggaaaactgtggcaggtagacttaaaacaccataaagcacagacgattgtgtgtaatgccttgaattgaatcctttttgaatgaaatgatcagccatatgtgccacccttatggaccctgtaagaagagtagaagaaatgtgccctaatgctaactgtgcatgaaattgcagtgttaggagatattgaccagatgtttcaatctcagcaaatggcttgttatgtgactgagtgaaaatatctttgctgctttgatcacatacaccttgaaggaaggggtaatttaatagaggctgtcatagttcatcattgtcaataaactttgacttgacctttgccttacgtttttgatgttgctgctgttaagtgttgttgggcagatgtttactgccttgagggattttgctttttataaagtgtatactagaaaaagtaaaggagaaggattttctcaattcttttcttattctttggttattagttggcatgcttctctgtggattttgtagaatttctgggcagatgcatttgagtgacattcttatgtctaaagatcactgtggtgtttctctaaaggtttcttcctttcctcaccttcctttttcttttctcgagacatggtctcactctgtcactcaggctggagtgcaagtgatgtaatcttggctcactgcagcctctacctcccaggctcaggcgatcctctcacctcagcctcctgagtagctagaactacaggtgcacaccaccatgcctggctaatttttgtattttttctagagatggggttttaccacattgcctaggctggtctcgaacttctgagctcaagccatctgccggcctcagcctcccaaaatgctgggattgcaggtgtgagccaccgcacctggccctttctcaccgttttgtcctggttttaatttaccacaataaacttccttggtggtttttctttcttattttatatacagcctattcttttgttctgatgaaagtcacattgaattaaaacttgacacctattgtaacaccataccaggtgctgtgttatttttttatccctagttttggagacctttggagataaatccatgctattttgtaatccatttttgttaatcttaagaaattgagtgaaagtttcagtaacacaatttttttaaaattataagatacagtattttaaaattttggtaaatagctttggattaaatgagtttcttgtttaatttgatgaatttgactcagttctgtaacctttttgctctttttcttgaaaagaaaaaggcttcctcactggctatatctgggttctgcctacactcttccctcacttccccttggtgtaggtggcctagaccgtgttagtcacctaatgaaatctgtgaatcctctcttgaaaaacacagcaaagtttccttacaatttcaggatgtttattggattttccccccctcctctcacacataccctgcaatgataggggcccctggacttcaagcagactaacaaagcttagaaaataagattcatactccttcttagtattctagatatataacaatttgacttagaagtaacaataacaatagtattagtgatactgctacaataattacaacagtaataataataataataattaaaatttactttctgccaaccttatgccagattctatgctgaacctttaacctgtattactggttatattgttaatgatacctctagatagagtatatgcagcatacttttattctgtactttaggaaatactatatctttagaatacagatttgagtaagagattataagcattttgattctaagactttttggaatactgaacttttagttttctgattccagtagtcagtctgtctgtctctgtctctgtctctgtctctctctctctctctctttctcggcctctctgccattcatcttcttctgaaaattagctatcccacgtaagcctcatatatcccctaattcctatttgtagttgtgagggaggaaaaatattttccttctaagttctctgctgtaagattcttgtaacaaaagacagattaacaaaagttaagtacactaatttatattctaagttttatgtaacatagagggaaatgaagacttgaagaaacaattaaacctggtgtttttacattaggttttatgaagagtggaagggaaaggcaataggacaaaaaggggtatgaactaagagtagtaaactgaggggaccttagcaagacctgtttgtttagattcatctcatgtccttacatcttctgagataaggatgttctttttttctgcatatagtaaacatcctctcacatggatggtcttatgatttgcttcagaggaaatcagaaagtccttcctgcacctgctgttctcaaattccttcagcttaaaattttcagtatgtcaagtgccatattttgggggtagtgtgtcctgatctccatcatagttaagtgtcagcttggacacagtttctcatatttatcttaggaaatcttctttggccactctgcaaagactaaggtgctacttgcatgttctgcaacaactcctattatatatatatcatctcttaaaataaatagtaacatatcttgtatgtaagctttatgtacccttaaattgtaagttttaagaagatacaatcctggctttcctgttcacttatttgacaattatttaattgcatagaatgtagcaggcactcttctagatttggaaacacaccctacaactcttttaaaaaagccaagaaaacagtcttgaacagcaaattacaattaagtggaattaattctatgataggaatgatacagtttgttgcggcaacataaaatgcaggcatataggctgggcacggttgctcacacctgtaatcccagcactttgggaggccgaggtggatggatcacttgaggtcaggagttcaagaccagcctggccaacatggtggaaccccacctctattaaaaatgcaaatattagctgggcatggtggcgtgcacctgtaatcccagctactcaggaggctggggtaggagaattgctcgaacctggaaggcagaggtttgcggtgagtcaagatcgcaccactgctctccagcctgggtgacagagcaagactccgtctcaaaaaaataaaaaataaataacaatgggtatatagaacagaatttaggacaacattgtctcagtaagtgaaacctgaaacctaagtaggaagctagaaagaacaaacagaaacagaatgaagtattcagtgtactggaacattgcattcaagagtgttaatgcttaggattaacttggagaggaagttaatggttcaatcataaagttgtttatgttgaacttgcttaagatacttgggtaacgattgaaggacattttaggaagagcactcaaaatgcagtggattggagaaaaacagaactaaaggcagggagatgatctaagaagcttttgcaaatggttgcatggttgggaggatggagtgacagagagaatgggaaatgacatccaatgggtagaggtttctttttgagataatgaaaatgtgatggttgcacagctatgtgaataaacaggaaacaactgaattgtatattttaaagtggcaaattgtatggttatatgaatatatctcaataaatttttttaaaagagacttttatagtagtctaattgagagtagatggtggcctgtactaaagtggtgttaatagaggcaggagtaaaagtgtgtcaatttaataggcaaaatagggttgagtaggtatttggatattcagagcagtcatttgaaaacaagtataagctaaaaatgagggggtctcagcatatagatgataattgaaaccatgagagtagattagatcatatccagagaaagtatatacggtaagaattgtaggtaacctgggaatccaggcctgagaaatgctaaggaatggggagaaggaaagaagcctacaaaagagatagagaagacttctttatccattattaattacaataatgtccaacaaataataggtgatcaacaaatattggtggaatgaattgaatgaatatacactaaaaattctgcattttatcacagtctcagggcactgttgtcatcgtcagctgtactctgtaataggcactgccttgaacactttgcttacattatcctattcaatcatcacaataattccacaagaaacatagtctctgaaatagtagcttgtttaccatcacatggctggatgaacttatatatctgagtctaaagtttattttttctactaggcctaatattccccgaatctgttctgagaatgttaacagatatttactaacaaaaataacaatagaactatttcagggaaagaacaggattattagaaattgatttttattaataggatgcttgctggcaggggcaatggagcagttttttaaggaaagaagcataacatactagttattcagttagaatagattcttaatatttatgaaaatcttgtgttttgccctgtctcacttggtggtattgtaatcatctgagaatctatcctataagttatgtgatatatgctattttccttatcaatctatttcagttttgatttcctcatcatcctttgcagtctgcttgttgctgtttctcagttttgacatttaatttcttttagttgtgctttacagtttttctgagatgcctcattgagttttctgtataaaatttcatatctttggcttatcttgcaactcttttagtacctaggtgtcattcttcatcattctattatgaattgaattaaagcatatggcattatttcagaagtgactgcctcttgggcatcattgtcagttatattgtcctaaatattgcatttaggtaataaaaaggaaatcttccttgaaggtaaagttaatattaatagaaatctttccatatgttgttaaagactcttgttatgaagtttaatatgccatttatttaggccttatttaaattcagttgtaaattttttccttctggctccttaccttagtgaactgtcatctcttatcatcatactctttgctcgaaaaccttcatgtgttgctttctaccctcaggatgttgcctaaatttcttgaagtggtatttactgatctggcctacatctacctttcccattagtctcttccttcccacatagttgctttgtcggtatactcctaatagtcttttatttctgtttttcattgtttttgttaatattatattcttgtttcccaatctgtgcactaagtccccttggggtgctgtagcaaacccacagagagtcttcagggtatttcaaaatttcaaggtaaacacagtgacgtctatcagacacagcatgaaccactagctccagatatttcagtttttttttttttgagatggagacttgctgtgtcacccaggctgtagcgcagtggcgggatcttggctcactgcagcctccacctcctgagttcaagcgattctcctgcctcagcctcctgagtagctgggattacaggcatgtgccaccacgcctgggtaattattgcatttttagtagagacggtgtttcaccatgttggtcaggctgttcttgaactcctgacctcgtgatccgcctgcctcagccttccaaagtgctgggattacaggcgtgagccactgcgcctggcctggtatttcagttttaacattagattactacattccttttggtggcattatactgtgcgaaactgaatctttgacggtttctgtgataaaaagcaaatcagtgtgaaacaaatgagggtgatggttaccagtctgattccaagatttgagaattttgcagtgcctaacaggtagaaaatcattaggaaataaacacttttggctgaaacgaattatttaataaatggaatttctttcatcctaggggcaccatgataaaatttctaacataggaaaggaggcatgtgctatatgctgtatgactcttttttctttctagtttgtaaccattttggaagatcatacccatccttcaaagaccaattgatactgctacctgtctttggaggcctttcctgatcccctccactgcagttgatctctctcatgggtattttccagtaatatgctgcttttttactattgctgtttaagttaaactaattgaagtatttatttgaagttaccaatagtggccgtggttttcctattcctccagttaggtataattacttaaagtataacaagagccctttccttctttgtataaaggtgatacaaatataataatagaaaccctatactgtactaaactgcgtaggttgttagtcaatttctttttatttcttttttttcttttttctttttttttgagaggagttccactcttattgcccaggctggaatgcaatggcgcaatctcggcccactgcaacctccacctcctgggttcaagcgattctccttacctcagcctcctgagtagctgggattacaggcatgcgccactatgcctggttaattttttgtatttttagagatggagtttttccatgttggtttggctggtcttgaactcccaacctcaggtgatctgcctgcctcggcttcccaaagtgtcgggattacaggcgtgagccactgcacacggccttgtttgtcaatttctaattcttacaacatccttaaaagatcataggttatgttatccacattttatatttgaagaaattgacgtttagcagtgttagtttttctcacacccacatacctcctgacctttagctattctagttccttttcctttaatattgattatagaatcaactttttgatatcctcaaaaatccattgagagtttggttgggattgcattgaacttatgaatcaatttggggagaattaatgtcttaagaatattgagttttcaaatccatgtacataatatagctcttcgtttatataagttgtttttttttcctcagcagtcttttgtagtgttctacatatatgtcttgcacatatttggttaaatgtgttcctacatgtttcaattttggtggtattgtaaatattgttttcttaattttaattttcaactcttctttgaaaatttatagaaatacattagatttttatatattgatcttaaagtctgagaccttgattgacttacttttaattctagagcatttatgtggattccttatgattttacatatattccttaaacatgcacaggttggtatctagccatagcctcaagggttactctgtagatttcaactcattcttctctgaaaatctttttcacaatttctagtctcctggctctccttgaacacatctctttctcctcattttagtgaaaatgccaggctctatttgccttctttctccctctccatggtgtggaacttgcctcctggcagagtacctgcatgatgtcagggcacaccttgtttctttcctatcagagatcacagtcctaccatgcctgttattcaatgtctgaaaattctgtaggtgtttccttttggttttctggtttacagcacaacagtaattctagagcctgctactcactcatggccagagcagaagttaaagtttttaaggtatactgtacatatgtgaaccaagggaaggtaggcagtttattttagctaaaagaaggagcataatcaaaggttataaacaaggttgaatctccatcctggagaatcaaaatctagtagttgtgactttgtattaggaacatcatcatttttatctttttattccctggcagacatgcattaaatgtttgttgattgagtatcaaaatgataggaaatagattagttggatgttggtgaaacattgtgttttagatgcttacagatgtactaaaattttaacagaaatctttgcaaattacttgttaaattttcctaaactgatttttaaaaatctatttcattctcaattataacatctttactgagattattaagtgctttgaagcagttaacgtggcttttttttttaatggctgtaaaaaaactgaatttttaggcttgttaaactctggttttagaatgacttttgagtggaaatcactgatcaaaagcaaagttctcacattttgtcaatatctgaatgtcagaaatagaatgtcaggcagtttcccatgttgaaatattcgatagtaaaaggatagcaaagttgctgaatatttctactgtttatcaatttttgccttgcaggttcaaataatatttatttgtagtggaaatatttcaattcatttaaatcctgattatggagtagttagtaaatcaggtttaagcctgacagtgagttgatatagctcttatttcagactgtagtttgaacatgtagactctctgattataactaggctaaattatataataatgactttattttcactgaacaaagtttgctattattttgatgacaaattatttaagtaatcatagtaaaagttgctattggctctgggttttatttattttgctatatatagtagacatggttgatcatttaatcatgccttatagataaataaaagtaagttatagaataacacagaaattttctgctaaatttatactttcactaaatttaataacaatagaaattctctgttaaatttatactttcactaattgtagaataaagtattttaagttaggcatttatactgagacattttatgatattaactgcttcatgttatttactcattttgataaatggagtgataatatccaaaatggaataaattaagtttaaattattgttattctttaaaggaatgatttagctacagtatgtttgtcccaccttttaattttgaacattttctaacttacagaatagtaaaatgaacttttctatacctttcacattgatccaccaattgttaacatttcaacacatttgtgttctctctttaaataaatgtatgtgtgtgtattttcctcagaaccattctgaagtatttattccttattcaagaaattaagcattgatactgttttctgatgtgtgatcaagattccagatgtcacagttattctggtagtgtccttgatagctgtttaattttattctcagtccaggatccaataagaatcacacattacatgtattagtactatttctttaatatactttcctcccacctttttggttaaggcattttcttcaagagtccaacccagttgattgtaatatgtgccaccttgtggacttaatctcatgattttaggcaataatagtacgtaagtgacactgtgtatttcccattgcatcacatcgtaaggtttatggctttattgataatgctaattgataatggttaagatagcatccctcagattttttgcttagaaccttcttccctttccccattccatgtttgtgttttccttatcctgttcagcaaacctagttcccaacagcatcaactttatattcatttgctctatcctacaatacgcacaaaatagtttcaccaataacataaccaacaataaacctactaaataaagtttgatttatttgttgtttttgttccttataattattccattaagactgtattgtcataagagcatactgaaaaattatttgcattattttttctatgtgcttatgttacaatttgataccttctttgatttttcattcttgttatactcaacttcataatttgtttttcttctaatggaatttgaaattaaaattaaattttattatttgaaaatgcaaaattttaacatgtttcagaagtcaaatttgtatggaatgctatattcagagaactcttctattcctattcctctactcctttcccactcactctcatagaaaagcatttttcatttctagtttattctttctgtgtttctttttataaaattagcaaacacaaaattatatatacattctaatatatgtatatagtatagtatctatactaaaagaatatatatggttgagtgaggtggcttgcacctatagtcccaactactcagaagactgagctgggaggatctgttgaattcaggagttcgaggcaagaatatacacacacacacacacacacacacacacacacacacacacacacattctcttttatgtaataaaaaccataacattaactctaccatcttaaccatttttaaatgtaccaattagtatacgcatgttgttacatagtcaacctctagaaatttttcatcttgcaacactgaaactctgtacccattaaactcttaattctctgacttccctccctgacgtccttggcaaccaacattctacttatgtttctatgattttgactacttcagatacttcctatgaatggaatcatacaatatgtgtcttttttgtgacagaccttatataacttagcaagttcttgatgttcatctatgttgtagcatgtgacaggatttccttcttttgtttctttatcctttaattgttgatagatgtctgggttgcttgtacttcttggctatcatgaatattgctgcagtgaacatggacatgcaaatatatctttgagatcctgctttgaattcttttgactgtatacccagaagtgaggttgcttgattatatgttaatttaatttttaatatttctttcaggaacttccataccattttagtagtggctgtaccatgttacatttccaccaacactgcacaagggttcattcacttctccacattttgccagcattttttgttttctgtgttttcggtagtaaccatcctgatcagtgtgaagtgatatctcattgtggttttgatttccctgatgattactgatgttgaacatcttttcttgtgcttattggccatttatatatcatttttggagaaatgtctattcaagtcctttgcccattttaagatcatgttatttgtatttttattgttcatttagaagtttgttatatattctggatattaacctttcattggatatatggtttggaaataagttgccttttcactctgttgattgcctcctttgccatgcagaagttaagcttgatataatcacatttatctatttttgcttttgttgcctgtgcttttgttccatatttatgaaatcattgctaaatccaatgtcctgaagctgtcccccatatttgaaaataatatatattattaagttttattttttaaacaaagctttttacctttgagacttgatttttttttgaagttaacaaaatatcctggaaattactttgtatagaaggagtgttccacagagcttttcctttttttgtgttgttttgctgggatttttgaatggctgtgtggtattccattgtgtggatatatcataatttaatcgactgatcttctacaggtggacttctagtttatttccaacattttgccattacaaataacatctcaatacttatatatgtgttgttttatattgtggatgagtctgtagaagtgggattgctggtcattaagctgttactatgtctcattcttacagttctgtctttgttactttttcctctcctcatccttttacctctcaaatatgcatgtatttcttttctattccaaatatttgagaacagattttatcaaaatctattttgatatcttttgactttgtatgtagattatttgtaggttattttgctacctgtaagtctttgaaactaaacaggtgttacctatagaatcactatagaatattagaaccctcagggatttgagctaattataaaaggtaaaaagttcaaatctgtgaaacatatgcatcttacaagaaatccattaaagcttataataattacttcaatgaaaaaatgagatatttgtaactagaactgtaacactatttctgaatttttaaaagaatttttttagatatgagcatgttttagcttaatttatatatgaattactacaataagtatgacaatcatagtaacagccacagctaatatatgttgttgactatgtgctgggtaccatgctcagcaatgcaagtacattaatttacatcatttcaattagtcctcaacgaccttatgagatgtatttgtaattatatctccactttaaacatgagtgaaatgagaaatgttaagagatatgctctaacatgctctaactcatgcagctagtaagtggcagaagcaagatttgaacccagagagtcttcaatcaagatggattctgctctttttatgacaatgctagacttcttatattgggacccactattattttcctatatcaggccagcatttgtcttaaggtctgtatgattttagctgctgagtccttaacaactttatgtactttatttctctccccaaagcagtataagatattacatggttgttatattaagtttttttaatcgtaagtgatagcacagaattgaaatcccattcataacagctacagtttctcacaaagcattcttgtcacatcactatctgtggcagaatattaaactatgtgtaccatttttttgccccattaaattatttatgttcctgttttacagtggatgattcaacagccacacaaagcagcaacattttttggatgcattgggatagataaatttggggagatcctgaagagaaaagctgctgaagcccatgtggatgctcattactacgagcagaatgagcagccaacaggaacttgtgctgcatgcatcactggtgacaacaggtcagtgtaattccaagggaaccactatactaattggctattttaacactggtaaaatatgaattccaatgtgaatttggaattttgactttataattccttttaatgtttgataaatgcttattccttatatcagttttcctgtattgtttttaaatttacttttgttaaacatgcagttgaattcatgaggcataatggaataaaagtttgaggttatttagtccagtctctactttttataattagaatcagaaaaggctgatagcttgctcaatgccttgtagcttgctcaacaccttgtagctaatttgttgcaaaacttgaattagaaacaatgttcttttcaccatatcctgaggttggaatacgagagagagagacagagagacagagagagagtgtgtgtgtgtattttatgtatataaaatacaacattacattcaggctcgtaagacttagtcatctaaatggtcatctaaaccatttctggcaaatagtaattcattcatattgaataaactcagtcgtgggtagtataccactaacaaaacaaccaagtatatttctatacacccttacttattagaaaagtattcttaatatgaacttgaaatatctctctcaggcccctccatatattggttggttgttcttttgtacccacatggagatactccttcagtgtattcatgcactgctaacgttattaccatatcagcacaggcttttttcccctttgcaagggaaaaacaaaataactgccctagctattatattgttgggataatcaaagatgacctctttttaaatagtgattcactagaaattttgcattacttatagttggaaatatgtagtctgtcctcctccattccctatctcctttcttttcccatcttctcttcctttctttttttcccttttcatcctcctttattttcttccccctctccaccacgaccttgctccatttcttctatttacccactttattgctcactacttgaccttcagcagaggtatattaaggaatggactattctagagactggggatcaataagcacagtatttactaaataaccaaaatacaatattcaaaaattattagggtatgaaaggcattttcagatctttcctttaattttgttttttatatacaggagaactttatggttttaagattacagtaaacattgaaatatgggattcagggattttaaaaaaaaacaactaaaaatgttgaaatatgtttgtttagacctttgcccttagttttcccaagaccagccttaatctgtaggtgcaaagttttcccattagtgagaagtaggtcagattttcttctgatatcacttaggctacagtaaaattactaaattgttttagtatgctaaattgctgtcctaaagaacagttatggttgggtgcagtggctcacgcctgtaatcccagcactttgggaggccgagtcaggtggatcacctgaggtcaggagttcgagaccagcctggccaacatggtgaaactccgtctctactaaaaatgtaaaaattagccaggtgtgcacctgtaatcccagctactcgggagacgaaagtaggagaattgcttgaacctaggaggtggaggttgcagtgagccgagattgtgctattgcgctccagcctgggcaacagagcaagattctgtctcaaaaccaaagagagagagagaacagttatgataatattagatcttctggatgtcaaaaacttaacttttatactaattttatggttatagtgatattgttgagatgatatgggactcaaaaattggggagaaatcttcagtatctaaatcattatctaaattctggaagctaatacagttggatcaattgttttggataggtccagtaacctttgctgccactatcaaaaactcagaaattggccgggtgtggtggtcacaccttgtaatcctaacactttaggagaccgaagtaggctgatcactcgagctcaggagtttaaggccagcctggccaacatggcgaaactccatctctacaaaaaatacaaaaattagctggggatggtggcatgtacctgtggtccccgctgcttgggaggctgaggtggaaggattgcttgagcccaggaggttgaggctgcagtggactggggtcgtgctgcccactgcacttcagtctgggcaaaagagtgagcccctgtctaaaaaacaaaaaacaaaacaaaaaatttcagaaattgaagtgtttgggtaatgcagtatctttcttgatccaggttcttcctcttcaaagtcagaatcaaatacgttgggataataagaatactcatatttttctggtcgggcatggcagctcatgcctgtaatcccagcactttgggaggccgaggcgggtggatcatttgaggccaggagtttgagaccagcctggccaacatggtgaaactccacctctactaaaaatacaaaaaaattagccgagcatcatggcgggcacttgtaatcccagctacttgggagactgaggcaaggaaattgcttgaacccggaggcggaggttgcagtgagccaagacggagccattgctcttctctagcctgggcaacaagaacgaaacttcatctggaaaaaaaaaaaaaagaatacttttatttttcttttggagaaactgtagtttcccatcaaaaagtagttttattatcagaatagagtttagtatctggtaccagaaatgtttgcttttatttggtagccattttgtcaaaattttcctaaagtcataattactaaaatatttttataaattaggtctaaattttcttaagtttgtaatatagttattttgtatatgaatatgttgatgcatattactctttctttccttcatttacttgaacataaacagatgtatcctttagtagtaaattggcagatggatgagtggaaatacgttttggaagagaattgaggtttttttttttaacagtgtaatcgaacatattaccaaagtctgaaatgataagattttttttgtaagctataactgttacaatttaattagaaaaagagaaaaattggcaagtaattttttaaattctggagcagtatgaggaaggaaagtatttttatttataatgtaaataattattgtatttatttttaattaaacaagccaagtgacacttgtagcaggattttatttatttatttatttattttttagagatgtggttttgccttgttgcctaggctggagtgcagtggcatgatcatagctcattgcagcctcaaactcctgggctcaagcaatcctcccacctcagcttcctgagtccctaggactataagtgtgcaccactacccccagctaatttttaaaattattttgtagagatgggatctggctgtgttgcccaggctgacctcaaactcctggcatcaagcaatcctcccaccttggcctctgaaagagctgggatttcagctttgagctactgcacccaacctgcagcaagattttaaatgcagtatcctgcttagatattccatttctaaaattggaccagtcaggggacttttcaactatagaaaacaattctaattgatttcagcccttagaatgtaatggtttacaaattaattcctcttagcgaatatggtctacatttataagtgtcttttacgaaattaattccatatttggcttttaaaggcttcgattaaatagacaattatagtatgttgatatttatttttataaagatatttttctacttaaaaaatgtttttagttgcatagatttctttttatataatgagttagccttatttcttaactgcattttgaactattaaggtgtaaaaagtaggtcctattttactatcaaaaggcaacttaaatgccaatttctttctcaaaataccaggtgttgtttagaacaaaaattatcatagatgcctcagaaagttctcaaaacaaaattattatttatatttatttaaaaatcaataacattagttttgaagaattaattaaaatgtaaattttaaactttgcaaaaaatattggtaattatctattgaaacatatgctaagtttgactataatattacttgcttattctttggttgttttaggtccctcatagctaatcttgctgctgccaattgttataaaaaggaaaaacatcttgatctggagaaaaactggatgttggtagaaaaagcaagagtttgttatatagcagtaagtacttacctaattcaaatctctagtacatatttacatgatggattatagttgttgtctgatatatattttaaaataattatcttttatttaccctgcaaattatttatctctctcaaagcatatgttagattcactattgtgaaaatagaacagaaatcattatctttctatgggtaacataatttgtattatttatcttcaggtctacctatttttggatacattatgcataggtgcttgccaaccaagcgcagaattctatattaaatcagtttccaaatatattttaaaataattctacaaacttacatcttacatttgtaggcaacttgcattgtgcagaaaaatattagtagtataaatattcactgcaaatagtttgagctgaattgcttaaaaaacttaattgctatttattccatagtaattaccatgacacctcttaatttaatatttcagaaacattgatcgtgacaaatctcttaaatctgggaacaagggcagggtgtaatttgaattattaagtcttctgacacaaaaataattggttaagaatttatttctaaaataggatggtactaaaaattctgaattaatcaccccatgattaccttgtttttatttaatatgtgttaaatgtggctttacacaaataagtagatacctatgaaaaaagcatctcgtatgcatgtaatatatggttttggtataacagctgctgccatttcattacctgagctctgtgaaatagctggtaagatgtgtaaaaaattgattaccctactaggaggaacatgtttattgaaaatataattatttctttcagtctaatgttaatgtctcctacagcatgtttgtgtgcactgttctaggctttacaacattgttattgattcctctgtataccaaatcctatccctttataactgtcaaataaatgcttacattgagaagattatataatggaaagttatgctatcttttctgccagtatgtgagaaaaacatttcaagaattaaatattttacccctttattatttccatttcattttatttctcaaattggtctcatgttctttccatttttcaaatcttgatactgtatttcttgtagtgtgattctttagaggggatttatgtactatttcaaaccatcttacacttgaaagtctgattttcaaaaagcaccatgtttagaatttggcataatttatatatacttgttgactatgaaataagacagtgtattctgatgaaaaagtatatttaacttgacaattacagtcttctatgtttcaatatatagttgttcaatcctgaattgtgagccaacttgcaaacaactcatagttgtaatgattatacagtataacatgtctagccaactttgggtgaatggaacttttatgaaagtgtagattcaacttgcagacaactcatagttttagcatttatgcactatattgtatctagccatatttgggtgaatggagttttacagtagtattaaatatttatacttacgtgcaattttgtacagcataaagtgatcagcttttggtgaaattaataaggcaaatgatattatttttgagatttgggtggtgtattcagccagaagaaataacaaaatggatttcagttgttatctgtgatacaagtgttagcttgtagcttctgtttcagcagtttcataaaaagaatgatctcttacattgccaggtaaatctgtactcttctcctagcttggcttattccaaaatagttctgaaaatagtagactcatattggatacctgggacgctgtatattcttagtgaacattcaacaaatatttacttggtgaataactaagagcataattcgtatttattgaaatctgtaaacttccttttgaaatacaatgttatttccacaaagacactgcaggttttgcaaatctgtaattccctttgatttcagagcattccgaaatgatgtgtagtctagtctagttttttcttagcatatggtcaaaccataaattaagtgggctgccccatactttctggttctatgaggtcaacagtctcattacattatcatcataaactaatgaggtttaagaaattaaagttctgggggctctttaattctaaaatgtttttgatctaaggaagcaacgcagtttatctattcaacaaatatccgtaactaaaacatctgtctgcatcacataagctaaaccagatctacatactcagctctgcttcttcacactattctccaaactagcagtgtttcatgaatattaagaaaattccaaaccttcttcttcattttcttcaccatataatttactgagtaagttcacactggaaaccttcctgactgaaaagctaaaattgaatatggatacaccagcatcctcttttggtttaaatacagtgccaagatcttttaaaatttattttttacctttcataataaatgtctcattttatgccacgtaaactcagtttttccatgtttaaaccagcttctcagattctttgttagcaggtaattagggactactggctatggtgactaggtaattatgtttttgaaaacataagtctcaggttctcttcaccttagaatcagattgggatatatctgttttttctcacttaagaaataatatttcctggcatagtggtttatgcctgtagtcccagtgctttgggaggccaaagccagtggattgcttttggtcaggagatcgagtccagcttgggcaacaagtaggtctctaaggacttgctttatgaatctgggtgctcctgtattgggtgctttatgaatctgggtgctcctgtattgggtgcatatatatttaggatagttagctcttcttgttgcattgatccctttaccattatgtaatggccttctttatctcttttgatctttgttggtttaaagtctgttttatcagagactaggattgcaacccctgctttttttttttgttttccatttgcttggtagatcttcctccatccctttattttgagcctatgtgtgtctctgcatgtgagatgggtctcctgaatacagtacactgatggatcttgactctatccaatttgccagtctgtgtcttttaattggggcgtttagcccatttacatttaaggttaatattgttatgtgtgaagttgatcctgtcattatgatgttagctggttattttgctcgttagttgatgcagtttcttcctagccttgatggtctttacaatgtagcatgtttttgcagtggctggtacccgttgttctttccatgtttagtgcttccttcaggagctcttgtaaggcaggcctggtggtgacaaaatctctcagcatttgcttgtctgtaaaggattttatttctccttcacttatgaagcttagtttggctcgatatgaatttctgggttgaaaattctattctttaagaatgttgaatattggcccccactctcttttggcttgtagagtgtctgcagagagatctgctgttattctgatgggcttccctttgtgagtaacccaacctttctctctggctgcccttaacattttttccttcatttcaactttggtgaatctgacaattatgtgtcttggtgttgctcttctcgaggagtatctttgtggtgttctctgtatttcccaaatttgaatgttggcctgccttgctaggttggggacattctcctgaataatatcctgcagagtgttttccaacttggttccattctccctgtcactttcagatataccaatcagatgtagatttggtcttttcacatagtcccatatttcttggaggctttgtgcgtttctttttactctttttttttctctaaactactcttcttgcttcatttcattcatttgatcttcaatcactgataccctttcttccacttgatcgaatcagctactgaagcttgtgcatgtgtcacgtagttctcgtgccatggttttcagctccatcaggtcatttaaggtcttatccatgctgtttattctagttagcctgtcgtctaatcttttttgaaggtttttagcttcttttagatgggttcgaacatcctcctttagctcggagaagtttgttattacctatcttttgaagccttcttctctcaactcgtcaaagtcattctccatccagctgtgttctattgctggcgaggagctgtgttcctttggaggagaagagacgctctgatttttagaattgtcagcttttctcctctggtttctccccatctttgtggttttatctactttggtctttgatgatggtgacctacagatagggttttggtgtggatgtcctttctgtttgttacttttccttctaatagtcaggatcctcagctgcaggtctgttggagtttgctggaggtccactccagaccctgtttgcctggctatcaccagcagaggctgccaaatattgcagaacagcaaatgttgctgcctgatccgtcctctggaagctttgtctcagaggggcgcccagttgtatgaggtgtctgttggcccctactgggaggtatctcccagttaggttactcagggatcagggacccacttgaggaggcagtctgtccattctcagatctcaaactttgtgctgggagaaccactactctctccaaagctgtcagacagggacatttaaatctatagaagtttctattgccttttattcagctatgccctgcccccagagatggagtctacagaggcaggcaggcctccttgagctgctgtgggctctacctagttcgagcttcctggccgctttgtttacctactcaagcctcagcaatggcgggcacccctcccccagcctcactgcttccctgcagttgatctgatagcggactgctgtgctagcagtgagcaaggttccatgggcatgggaccctccgagccatgcgtgggatataatctcctggtgtgccgtttgctaaggccattggaaaagcgcagtattagggtgagagtgtcctgattttccaggtaccgtctgtcatggcttcccttggctaggaaatggaattccccaaccccttgcgcttcccaggtgaagcgatgccccgccctgctttggctcacactctgtgggctgcatccactgtccgacaagccccagtgagatgaacctggtacctcagttggaaatgcagaaatcacccgtcttctgcatcactcacgctgggagctgtagaatggagctgttcctattcctttttttgttttgttttgttttgttttgagatggagtcttgctgtgtcatccaggctggagtgcagtggcacaatctctgcccactgcaacctccgcctcctgggttcacaccattctccttgccttagcctcccaagtagctgggactgcacgtgcctgccaccatgcccggctaattttttgtatttttagtagagacggggtttcaccatgttagccaggatggtctcgatctcctgacctcatgatccacacgctttggcctcccaaagttctgggattacaggcatgagccaccacacccagcctaattgttttttttttttttaatcagctttgttaatatatgtctcacaacttacaatacatacattttacttctacatatatattataaacatcgtaaccttgctgctatttttgtttaaattgtcaaatatatattttaaaagacttaataagaaaaaattcatatttttactcaggtatttatcatttctagttctctttattccttttggttagaattagatttccatctggtatcattttccttctgcctagagggcattctttaacatctcttgtatttggatctgtcagtaataaattctttcagcttttgtatgtttgaaaacatctttatttcaccttcatttttgaaagacatttgtgccagatatatagttctagtttgacagtttttcagtacatgaaaaatgttaccccattgccatcttacttgcatagttcttgataagaaatctgacattcttttgttcttcaatgtttcacaacccccattccccaaattttgctgcttttaagatttttcatatgagaccaggtgcggtggctcacacctgtaatcccagtgctttgggaggtcaagatgggaggatggcttttgaggcatggagatcaagattagcctaggcaacatagtgagaccccatccttacaaaaaatacacacagagaaaattactcattttgatcagtttagttatgatgggccttagtgtattcttcttcatgtttcttgtgcttgggttttgtttaacttcttagagctatcggtttttagtttttattatgtttggaatatttgcagccattatacatcttcaaattggttttctgacccttttatgccacttgaagttgtctcatagctcactgacactctttttttattttgtttctttctctatgttttattttggatacctcctttgctgtgccttccatttcactaatattttcttctgtaatacctgaactgttattaatctcatcaaataaataaagctaaatatttcttactactgggggaagacttttcttagtactccatggcacagagcactaaggggtccctaatctctggtactgcaactatatcagttcctgttaggaaccaggccacacagcaggaggtgagtagcaggccaccaagcattaccacctgagctccacctcctgtcacatcagcggaggattctttttttttttttttcaaatgtgaaaaatctaattttattcagtttagattaatgtatagctatacactctggactcttaatgaaacctttcccattctttttttttagattttattattatactttaagttttagggtacacgtgcacaacatgcaggtttgttacatatgtatacatgtgccatgttggtgtgctgcacccagcagaggattcttataggggtgcaaatcctattttgaactgcacaagcgagggatctaggttgtatacgtcttatgagaatctaactaatgcctgatgatctgaggtgcaacagtttcatcctgaaaccacgcctcctacccgtccgtggaaaaattgtcttccacaaaactagtccctggtgccaaaaacgttggagactttgatgaaaaaaatgatgagtttttctgctctaggtctttgaaacagccactatttccaaatgtgtatgtgcctcaggtactgttccttctatttttttttcctcttaatacttttggatgtttctttcccaggtactgaccttaagaaaagaccctctacagaattccaggtttctctgtaaatctttctgttctctgatattgtggtctttcaactcttaactgctctgaaattcccagactctcagttgtatttcctcaactcactggcatctactacagttctccttataccatattctggaaactcttgcaataaactgctgtagtcatatggctgacctccattgtttcccatctctcagagatacgtattttttattcttgatgtccagtgtattaaaaaccattgtttctagttttgctattgttgtttcatgatagggagtaaatctagtttctgttcctctactgtcttctgctttgcattgtttttgaaaggaagcctgctgccattcctatcattgttccctcttacctaatatgtcttttaacctcctttatctgcttttaagatgtttatcactgattttaaacaattttattatgatgtaccttggcatagttttatattttgtgtggttggggttttttatagtttcattcactttggaaattatttaacaataagttttctctttccacctccatctacctttgggactccgattaaaataataataataataataataagaagaagaagaagaagaagaagaagaagaagaagaagaagccacttgtagttgacccatgtctcagtgattctgttttcaatatttttgtttttctatctgttcttcattttgaataattactctctcccctattttgtcttttcttttttatttttatttttattttttgagatggagtcttgctctgtcacccaggctggagtgcagtggtgcaatcttggctcactgcaacccccgcctcctgggttcaagtgattctcctgcctcagcctcctgagtagctgggactacaggcacgcctcaccacacccggctaatttttgtatttttagtagaggtgggttttcaccatattgtttcggctggtcctgaactcctgacctcatgatctgcttgcctcggcctcccaaagtgctgggattacaggcgtgggccactgtgcctggcctctttcttttttttttttttttcagacaagttctcgttccgtcgcccaagctggagtgcagtggcacaatattgggtcaatgcaacccccacctcagcctcccaagtaactggaactgcaggagtgcaccaccatgcctggctagtttttgtattttctctagagacaggttttgctgtgttgctcaggctggtctcaaactcctgaactcaacttatctgcctgtctcgacctcccaaattgctgggattgcaggcatgagccgccatgtccagcattgaataatttctattactctgaagtttactaattatttcatctacaatgtttaatctgccattaatctcatccagttgacattttatctctgacattatagttttcatctcttgaactttgatttggacctcttttactcatgccatatctctacatagtatgcttatgttgtcatgtgctttcggaatgttgttataacaattgttttaatattcatgtctactaattctgtcacttttttttaatctgattaccttggtattggtttttcctgattacctgggtattcattgtttcctcatacatgtgtactgaagactccaaaggaatcccttgcatatctcgagttctcactttccacctctttcttctccaagcagctctgtcctctccagtactctgccccagcatgtggtagccagcttggcctccctgaatggaaactacttgactctatttaggttcttccttcccgctctgcagcctgggaactctattcaaggtgtaagtttgagtaattgtagcgcttaccttattctgccccttctttgattattatccaatgcctgaaaattgtgttttcatgtattttgttcattgttagttgtttaagatgggaatataaatctgctccctggtccttcatagtggctggaagtgcaaatctctaggttgattttggtttttccctttttcaggtaactcgctttttttttcaagaatgcctaatttttttatttgaatttgagtctcagtctgttgcccaggctggagtgcagtgacacaatctcggctcactgcaacctccatctcctgggtttgaacgattctcctgcgtcagtctacccagtagctgggattataggcacctaccaccatgcctggctgagttttgtattttttttttttttttttagttgagatgaggtttcaccattttggctaggctggtcttgaactcctgacctcaagtgatccacccgccttggactcccaatgtgctggtattacaggcatgagccactgcccccagcctgaatttgaatttgataataactatgatttatctctatgcgaattctgtattgagttttcctcgaacaatgtattcattttaaactgtagatttcattcccagttaactttcttgtccccaaatattgtttctcctttacttgacctattggagtgtcagaaaatgatcataaccatcactgataaatgtgttatggggaatattagagtaaaagcagaaattccaagttgtggtgagaaagtacagtagaaccttgaacaatgtgagggttctgggcactgaccccttcgaaaatccacatacaatgtttacctcctcaaaaacttaactactaatagtagttaattggaagccttactgataacgtaaatagttgattaacacgtattttgtatatgtattatattctgtattcttacaataaattaagctaaagaaaaaatgctataatatcatatggaatgaaaatatattattattcattaagtggaaatggatcatcataaaggtctttatcttagtcatcttcatgttgagtgggctgaggaggggaagaagaggaggagtggttggccttcatgtctcagaggttggcagaggcagaagaaaatctatgtataggttgacctgcacagttcaaattcatattgttatagtatcagttgtaatcttaaattcatcttcaggttgatttagtgtcaaaattccctcaaatattattctagattctataaaatgttctagataccattttatcgcttaaaaataaatgtgaaagctctcagctaagatatagttgttcatctatgtgtaattactagttttgtaattttttgtaatttcttagtcacctctgcatagtgtttggattacattgtgagtacagtaggattttgtttagaaatctatgcgttatttcaaataacatctctttatgataggaaaaaaggttccaagtttgaaataacactgtgaagaactaatcaccatgcaagtttaggcttattatggggaaatttttaaactttaggtattaaaaagatttttaagaaatagattttaacaaactttcagtaccttgtgacttaccctgcgtaaacaaggtcagccaaatttgtaccctgtttcatggattagaaattaaacactataagtgaaagaataataagtcatatcttgtcaataattttgtgagagtatgagacttgtggtgagttttcctttagcactcatgcctattttcttttttaaattattttttcagttcctatgtcttattacaggtcttctcttttcctctcttcatttatttataactctgtcttgaccacttatatctgttttcggtctagaattttactactttggagaatgtggtttttgtgagggtagagttttcaaatgtcactaatgtttgcttctggaataagggaagtatgattataggtcagtagaagaaacatggtatgaagaaatgtacagccttggtggtaagcaatagaattcatacttacaaagaaacagaagtatatgtatattaaaggcaagtaagaatcactaccaaatgtttacattttacatctcctgctttgtttgccctataggtttttcatacctatgccatgagtaacaatttttcttagtaaaactttcatttatactcagttacaattaaatatctttatcagtaatctaaaagcaataaagcccttaaaatgaggtagtgtgataaattataagaaatctcatctaagaaatcatatgtttgaaattttacgtgtcagtaatgtggtttgtgtccattgaattaacaagttagaatgaatttataattaaataaataatttctatttttttaggatttggttatcttttggcagtatttaccaaaagacatggttacactaaaacgtgactagaaatttaaaaagattgctcaaaatttcatgctcagaatttagaacgtgccatctagtattctttgctctgtcatgaaaagatttgagaaagtttcagtgaaagtgaattaagttgttttgtaatggtaacctaatggaaattgaagtaatttttttttaaaaaaggtaagtattatttaggccaggcacagtggctcaagcctgaaattccagcccttcgggaggctgaagtgggtggatcacctaagatcaagagtttgagaccagcctggccaaaatttttggtagagaccagaccatctctactaaaaatacaaaaattagccaatcatggtggtgcattccttagtcccagctgctggggaggctgaggtaggagaatcgctcaaacccaggaggcagaggttgcggtgagccaagatcgcgccactacactccagcctggctgacagagtgagactctgtctgaaaacaaacaaacaaacaaacaaaaacttacttaaagtgatagctttaaaccttattcgaccatggaacaagcctttgtaacataatctatactgttacaataagtacactttggcagagtaagtgaactaatgatttttttttataatttaagctagtctgtgaatgacagttgattaaataatgtcacagctctttatatatagcattaaatagagttcaaagtatttttggaatttattaatttataatattcttctgtgattattaaagaggtgggatagctaaactttttctcaccttttatcattgttccaagtgcagttttgaactcgtatgtgttagaactcccattatattggtcaaatcgatgatcaccatatgactttattcctgcatttttgcctcaaatttttaactatcctattctggactgcttcattaacttcattagggattaactatgaatgtttaagcctttattttacaatgtccttgcaggtgtccttaactgtttcatttataaacacagagaataaaatgaaaaaaaaatctgtagagttgtttgttctatttggagcttttcatgttggtgtaaaattcctgacacttaacacatatgaatctttttcattcatgtttaataattttatttgagagtcacttcaagtaaagcccaaactgtgttaacatttgagttaagcaaagacatctttgcttaacaataaagcaaatatcacaataaagcaagtcacatgaatattttggtttctgaattcatataaaagttatgtttacactatatggtactctcaagtgtgtggtagcattacatctttaaaaataaacatactttaattaaaaatactttgttgctaaaaaatgctagtgatcatctgagcctttagcgagtaataatctttttgctgttggagggtcttgcaccagtgttgatggctgctgactgctcagagtggtggcttctgaaggttggggtagctgtgacgatttcttaaaataagacagcaatgaagtttgccacatcaattgactcttctttcataaaagatttctctgtagcatacaatgttgtttgatagcatttacctacagtagaacttctttgaaattggagtcagccctctctaactctgttgttgctttaacagttatgtttatgcagtattctgaatttttcgttgtcatttcaacagcattcatagcgtgttcaccaggagtagattccatgtcaagaaaccactctctgtgttcatctataagaagcaatttctcatccattcaagttttatcatgtgattgcagcaattcagtcctatcttcaggcttcacttctaatactagttctcttgctatttccatcacatgtgcattgacttcttccactgaagtcttgaagccctcaaagtcatccatgagggttggaatccacttattccaaactcctattaatgttaatattttgaccacctcacatgaatcgtgaatgttcttttttttttaaacagggttttactcctgtcactcaggcagggaagtgcagtaacaatcactgcacattgcagtctcaatctcccaggcaagctcaagcaatcctcccacctcatcatttattttatttttgtagagacgaggtctcaccatattggccaggctggtctcgaactgctgggcttaagtgatcctcccactgcggcctcccaaagcgctgggattgcaggtgtgagccaccatgcccagcccatgaatgttcttaatgacaactggaatgatgaattattttcaggaggttttcaatttactctgcccaaacccatcagatgagtcactatggcagctatagccttatgaaatatattacttaaataagatttgaaagtcaaaattactcattgatccatgggctgcagaatgaatgttgttttagcagccgtgaaaacaacattcatcttcttatacgtctccatcagagcccttgggttaccagatgcattgttaatgagcagtaatattttaaagggaatctttttttctgagcagtagatctcaacagtgggcttaaaatattcagtataccagctgggcacagtggcttatgcctgtaatcccagcactttaggaggccaaggcgggaggatcacctgaggtcaggaattcgagaccagcctggtcgacatggtgaaaccacatctctactaataatacaaaaatgagctgggcatggtggtgcacacctgtaatcccagctactcaggaggctgaagcaggagaattgcttgaaccctggaggcggaggttgcggtgagccaagattgcgccattgcactccagcctgggtgacaagagtgaaactgtccccaaaaaaaaaaaaattcagcataccatactcaaacaggtatgtgttcatccaggctttgttatttcatttatagaacacaggcagagcagatttaacataactcttaagggctctaggatttttagaatggtaaatgagcattgacttcaactgaaagtcaccagctgcattagcccctaaaaaaaaaagagtcgtcctatcctttgaagcttcgaagccaagcatttacttctttttagctgtaaaagtcttcaatagcatcttctgccagtagaagactcttttgtctatgttgaaaacctgttgttcagtgcagccaccttcatcaatgatgttggcaagatctgggtaactcttcagcacctgctattttaccttgcacttttatgatatggagattgcttctttctttcaacctcacaaattagcctctcttagcttcagacttttcttgcacagcatcctcacctctcagctttaacagaattgaaaagagttaaggttgtgctcgggattaagctttgacctaagagaatgctatgctggtttgatgttctatacagaccagtaaaactttctccatgtcagcaataagcttatttcactctcttattcatgcgttcactggagtagcacttttaattttcttcaagaactttttctttgcattgagaacttgcctgtttgttgtgagaggtcaaactttcagcctgtctcacctttcgatatgccttcctcactaaactcaatcatttctagcttttgacttaaagtgagagacatgcaactcctcctttcacttgaacacttagagaccactgtaggattattaattggcctaatgtcactattgttgtgtctcaagaaatagggaggccttaggagaggtagagagatggggtaatggccagctggtagagcagtgaaaacacagcatttatcagttaagttcaccatcttctatgggtgtggtttgtggcatcccaaaacaattacaataataatatcatagatcagtgatcactataaaagatataaaagtttgaaatattgaaagaattaccaaaatatgacagagatccaagcgagcacattctgttggaaaataatgacaccatactcaaggcaggcttgccataaaccttcgatttgtaaaaaaaaataataaaaaggtatctgtgaagtgcaataaaataaggtatgcttataccaaaacagacttaattatgctatttcttaccattagtgttagagttcagtttctaatgtttttcattttccatatgttattgatgttcagtgagttacacaaattatttactgttgttacttccaccttagtagggagaatctttgatttttgctggataaattttcaaacaagagtgtgattataggctggacgtggtggctcacgcctgtaatcccagcattttgggaggccgaggtgggcagatcacttgaggtcaggagttggagaccagcctggccaacatggtgaaaccccctctctactaaaaatacaaaaattagccgggcgtggtggcgcatgcctgtaatcccagcacttgagaagctgaggcaggagaatggcttgaacctgggaggcagaggttgcactcctgcctaggtgacagagtgagactccatctcaaaaaaaaagaaaagaaagaaaagtgtgattacagagatcctatttgtgtttatttttaatttctctagaatttgttttcttcaataaataaaattctaataccagttttttttgagtaacactgtgatttttatacagaaagactttctccaaattggagaatgtactcttttattcctgtaatttttcttaactcttatttttggcagctaccaaaagtaaaactctctaccaagacagagaagaaatctttgggaatattaagtaatgttatttttcattacacggactaacctttttactaagaagaattgggatagtattggttatgggagcttaggagccctaaagataaagattggaagattttgtgttgtggacttgtggcactgtaacaaagtctgggaattttatgtgagattggaaaccacactatgtgctaattgcctcagaatggtaagaaaataagcatatgtatagcatttagttgttaagacagtaggcacttatgcagagccccaaatgaattaacaaatcatctactgaaatattttcacttctgtttactttatgtattttagaccaatcagcagttgcttgagaaaatgaaatgtttactaaatctctttaataaacatgtttaagagaggaaaaacttataaacattcagatggcagtgtacatttttaagtgctagttgtcatatctttgaaattgtatgtaaactggacataaacaatcaagtgtctacagaatggtatctgtcttccaatatatttactgaagatattatagaatctttatagtttaatatgatttaccccacatgttctgttgttgctatcttttcagataaagttgaatttaatctttcttatcagcttttattgaggtatttatgaaccattgagttcacccacttaaaaaatatcattcagtggctgttagtgtatttacagagttctgctaccatcactgtaatctaatgttagaacattcacatcaccacagaaggaaatgttatacccatcagtagtaatgctccataccccctggatttaatcttatatccacatctctcataatagtttcagtggtatctagttattatgactacaaatgatgcaattgttcctgattacacaaataatgtatttatgtctttattgttggcatgtaatggaagacataataagtctgctttgatctcttgctcttacctatttctctattgcaagtgttataaagagtcttttaagcttttgctcatatatataaatatatatatacatacatttatatatacacacacatacatatatacacacacacacacacacacacacacacacacatatatgtaatgctaccgtgtttgagggtcatgagggtcagttttttgaaataccagtttttttctgatttaggtggatgacatggtacgtgaagcttaaaaaaaaatttggtaaattggtatgaaaaaatgagaggacaacgtttttcctttctggtacttagcaggaaggcaagttcttgtatgaacccatatttcctgttacccattttcagaccaatattggtttctcatctatataatagggatcttttgactctaacctcttaaatctatcatgtgttttctttcttcaccttggaaatagcttcttgaagccccagacttctagagcacattcatattaactaacattgtcctggtttactagttagggatattagtaaatcctaaatagttgaagacgttctgaaagatatattgctgctttttaaaaatttatttatcttgttctctatacggatttctggcacaaggttggtttttgtttttgtttttgtttctgttttttttttgtcaattgtggtaagtccatggatgcttttctctataactttcccattttcccttatcacaccgtcactgcaaacatctaatttctgtccagtctctcaactcttttcagctctgctgtcctaactaatcattttttgtattcatctttcaaagtatttgtttctgtcttcattctataagtaacaagattatttaaggttattttgtattacagaaatagtaaaaatcaaataaaatatcaaatgtagaatagtccaccaaaaatattttatttcatcttttccagagaggtacacatataataaagtaaatgagcattatatattttattattaatcctcaataatatatttttcacaggtatgttgcttcttgtaagtttaccttttttaatgtgaaaactacaataaactaaattaaattttaaaaatattttacttactaaagtcaactgatgttttcctggtagattgataggcttcttgtggtagcttttaatcatttgcaagttttgagcccatttctaaaacttttctcattgtaaatatgtatttcctttcttatattaactgagaatttgtttttataaaaataaagtggggaatcagactcaaggtgaaatgttgtagacttagtgccagcaataagcagaattatttaaaatcattcaaatatctttaattcccttgttgtctttttcaaaaactgtacattttaactacattaatataacggaagactttttaaggcttagttttcctttatagatattccctaatttcatttttatttcagtctgtcagggttgtgaatgtgatgttttaaggtacactgtagtgttttcacatcctcagatgaactgaattgggacaatactttgtaggaagttttttaatatagtatgtagacacattggtaaaaatcagtatgtccactggcttattagtttcacagatgcttccataattcttagtgtactcttgggtattttaaattatcatttcctgacagcaatcctgaaacatgccagtcttttaaagccttatttctgagaactaaagcaaggcatcagcgaaccatatctgacatgccatgttaatttccataactatcatttctgggaggtggtaggatttctaaggcatggagaatctcagtaaatctactttaaaaaaaaaaaaagcaaaatatctgttttattactgggtttccattcacgagccctgactgcttcattcccacttaaataatttcaaaaatagtgataagcatattttttctcttatagattattaaatatttactcacgtgcacaatatatcaaaacatattttgaattctatattcttagtgttgggtgttcatgttgtgaatgaaaacctcattctgttatctcatagcatatttatatatacaaataatttttgccttaagtaggaaagaaacagctaaaagatacataggttattttgctttttaaaattttagcaaactattctgtgaatcttttgtgtgtttggggctgtttgtagaggaaaatttcatcaagcaacattttgggaacattggccttttgtactctttcctaaataaacagaaacttgtactccccaaaataaaatgtttctttgtatattgttacctgcaagttattgataatggaaggaacaccttttcaatccttagtcccctttcccccaacacagcttttagattgtcgataaacttcccagctcagtaattaactgagctcagtcattgcaccctgtatcatgtgatttttttttccagtggaatacattattagagcacttacacagccagtctagctgcagcagcccaggcggcaacagcagtgccatttttcacaaagaaaatgttgaacaggagccaaatgtttggtggcagtctgttgctaggaaatcaaggtcctgaggcgattaatgacaaagcaagcaataacaagaaggcagaattacagatttaaaagagaaaaaagtggttggtgttataattacccaaagaaatccgcactcattaaattggctgtttttatgattgactttaattggaggttagctcagatatttagctcctttcccacccctttaaacacacacaggcacataatctgtagaactgcagacttgtttttctaagcattgagaggagcttgccctgtaatttgatccccactgacagatgcattttctatgctgccattttgaattaacctattgtagaacaattttcttcagccctgttgaataaaacatccagtctgattacctccgatggatttgatagagtaaaagaatgtacttctcattgaagtagattgtttgcatggactctactgattgtgaactctgccagtaagcacaatcatttgtaataaattttcaaagaaatttgtgaggaaaaggtaatgagagtcacccttttatagtttaatgtttggcacctccatcaaaataatataattcttataagacagtgttatttttccagtaagcttttcacgtggttttagaaaaaatttctgaatcttcatttggactattcatatatttaggaatagagtcttgtatttacactctaaaatgaccattcttcctccccaacaacagtattttagtgcaagactcaatatgcaaagcactctattgcaaaaatatttttggtatgtacaatatttaaagtgattttaagattggcctatttcagtctttgaagtatttcccccccccaaaaatcccttatttaaattttttagggtgtgataaagcatattactagaaaagcatcaatcggtctttcaggtacaataccagaggaaccatcacagtttatttacctttcagaagctttaaaaataaagttacatgatgcctctgctctccagatttctaatcaaaccctggaacaaaagagccaagcacattctatctgacaatgcacacactgctaatcagatgccaatgccaagctgtctgctttgttaaatacttagcttcctagaggcaggaagacagctgctataagtatgatgaaattttgtagttcaatctatttttgctacccttgggctaccaagatactgttaatttagaccaccccaattggtacattttagggagttttttaaagagtttgtaattaaaatgataaaacatcgttattacattgaagaccttctgtaagttttacatttggcagatacctactgagataaccccagcatgtaatttacaatgatgtaatggttgtaattgcattttagaaaaaaagaactataggaggcaagtgcttccattagaagagtttttaaatctgcttctgtttcatttaaatctacttctatccccaaattacttacttataattgactagagcagctataaaccttaagatgctatctgaatatttttaaaaagttatcaccccagacactgccaccagggggaggaagctaaaatcttaaagttcttaactgatgatgatactgccagtaggtagattatattgcttagccctacatagttaactacttcctccagataataccgccttttgggacatgattctcacaacctgtaatatgtgatacctgtagacttagcacactattaattgtaaataaaatggaaactttcgtactctggtggttggggtcaggaaggggaaagaggaagtacaaataagcaacctggacatttttattgtttttctcttatctgttagtctacttgaagagctatccttgaaagtgagtgctttagatctatgaaactgggcagctatcatagcacatctattaagatctaataatcacataattaatgtagcaaaatgaatagactgtaaggtagttttctattttttgttactacactgtggttttgtttttaataaatagttttggctttattttaaacaattaaaaattcaaaatatttttatgaccaaagcttgtaggttctatccctggaaaatattttataaatgcagaaaatagttgcttaggattggaatccaactctgtttaccatgaacaacttaaaagttgatctcataatcttgcatgttgtggaataataccacgaaaaagttaattaaagaatttagatgtttgttctcctgtctagaactcaataacttttaagtagtaactctccctacagtttaactgttaaacagtaactcttctgacagttttaggttttattctgtgaagactcatgatttttaatttttgcatcttaatttttcagttatttcaggtattgaaattacaaacgacgggaaagaaaagtggttgactaaaaaggggatacaaaaggcaatttttagggcgatgtactgttctgtatggtactgtggtggtggatacatgatactatgcatttgttaaagcccaaagaactgtacatcacaaagggttaattttaatgtatgcaggttttttaaatgttagggatttcaggatagaatgcaagctgtaacaaatgaatctaattgtattacaaatgtatggcataacttcactgaatgggtgggggaaaaggagctgacctaagtaactttggaaaatggtgttttgattggacaatgtaaagctaaagactaaggaacactatagaaacactctattctagttggtaaatttgtttctcataacggtatgggtgaacagttctgaacctctttacatgtatcctggggttgaacaaataagtaaatggatgatgaatggtggaagctaggtttctcactgtcaggaagggatgttacagataaataaacaagaggggagagccagaatgaaacctgtggtactggattagagttggagatataagtatttactcatgtttagcttaatatatgcagatggatagatgcagaaataattatagatgcatgtgtatatgtggattagtatacatgcatatgtttcctagctgtgtttactgagaaggcctagaagcagtgatatcccagtagccacaaacacatctaacgctcacatcctggtttgtaaatcctattctccaataaaaggatccaggactccttttaaatatgactgattctggggctggtgatgggaaaatacaacataagcatggaatatcttgtagtgccagaaggcaagagatttcttaaaaataataaagattaagcatgccaaaagggacacatgagccaatgtgaaagaactccgagtggccgtagctggaataattagagcaacaaaataaaacatgtagcattggattaaggataaattattgagtaaatatacatgagttcacagtgttatgtataaattgtataaataagtaaatggaggagaagagataaatctccctgacagaagaattccaaataacatattgccccctccagaagggggatcctacttcccttctccttgagagtatgagctggattgagtgagtcatatccaaaaattgagtttggaagacagcgaaatactgacttgactatttccattggagaaagctggtaaacaactatgttaactaagtgatcaaggttaacatcacaaatgggaagtcatgctgatgtgaagaggtggaaacttcatctctctgatattctttccctaaacctgtagcctcaatctaatcattaggaaaacatcagacaaatcccaactgatggacattctaccacataagttgagcattcctgaaaactgtcaaggttgtgaacaatgaagaaagactatgaacatctcactgacaagaagagactacagagtcatgacaactaaatgttacatagtttcctggatcaggtccagaatagaaataggatattagtgtaaaaactggtgaaatctaaataaagtcttgactttagtcaataatccaccaacattggtttcttggtttggccaaatgtaccacagtaatgtaagatgctaagatagtgacattagaacaaattggatgaggggtacataggaagtctgtatattaaacttgcaatttttctgtatatctaagttcccaaatataaaataaatttatttgaggttgatcaatgggctgactatattgacaagatactgataggttacatgttgaagaaaacatacaatataaaatagagaaaaagtcagttccatcccttcccactccccctttacctacctgctccccagtactcatcattgtgatttagtcagaacagggtttagtgccagaggtcagggtgactgagggtggaggagttgtgagcaatgggttcatggctgtcacaataatgctgtggcaattctatggtttcccagctgggagttaggagtggggagggggctgcagcctgatgacagccagctgaaggaagagctacctctcccttccctagctgctcatcacctgaacccaagaccacgccaaacaagatatggatgtagatgctcttgctgagtctgttccgcaagagggaaagaaagggtagctgctccaaacacgccgtcctcatatacaagggtgaggggaacagaagcatgtggctgctaccagcaaaggaaaagtaggagagcaatagaaaggggaggaaatgggaagagcagaaaatcaatattatttaaaaagtgacctaagacttaaaattgaattagtatttgtacagaaagatgcaggtggaataactcactctggcctgtgatcaaaattatatggagaaatcatggtgggccccttcctctgtccccagtggtggcaccagttgctgagtgtgattagttagaatggattccagtctagtcgttcaggcagaggaagtagttgcagtgggcaggcaagaggggctcagttgctgcagcactggctcttgctggctgggtggttcttctggaggtccgtacctcagttttggcctggagcaccaggtgcactctggggcttattaggaatcttcttagctctcgccgtgtaaacttcattcacgttcattgcagtctttactgatgtctccatagtcaactgtcgtcgtctgcatagtcctgtgcttcgtggaattctggggctttcttgctggccaggtctgccttgttacccacaagtacagtgacaatgttggggctggcctgcctctctagctccttcacccatttcttggctggtgcaaatgtatcttttttggtgatttcatagtacatgggggctgggctatgataccgctcctgtccagcgctgccccagatctcaaacttgactattgtgtcgtctaagcagacagtctgtgtaaggaaggctgctctgattatgctctcctggtactcttgaaattgtcccttgacaaagtggaggacaaggctggatttggccaccatagactcattgttcccagtggctggtccaccaggtcgtgtgctgtgccttgccgacccgccactacccgtccagctgttgtgataccagagagcatggggacgggagccattgctatgcaaagaggcacttagttgggaagggggtctccaaaatgacgcaagggcagtagtattacttggggctggggctcacacaggctccgcttctctccccccacccctggtggtatctccatataaaaattttacttaaacgcagagaccatatatgtacttaaacacttgtctaaagaaataaaatatggccgggcatggtggctcatgcctgtaatcccagcacagaggccgaggcaggaggatcacctgaggtcaggagttcatgaccagcctgaccaacatggagaaaccctgcctctactaaaaatacaaaattagccgggcatggcagcacatgcctgtaatcccagctactcaggaggctgaggcaggagaattgcttgaacctgggaggtggaggttgcggtgagccaagatccccgccactgcactccagcctgggcaacaagagcaaaactccgtctcaaaaaaaaaaaaaaaaaaaaaaaaaaaaaaaaattcccctgcctctctccaccccagagggtaaccattatcctaaattttattattattattcacatgcttttctttataggatagccatacatgtatcactaactgttctaccatatctcataacctcttatatagtttcccttttttgtcatatttgctgtgttctggataatttcttcagatctatcttccgatattggtaattgtatcttcagcagtgtctcatattctgttttacctgacattgaattttatgtaataatcattacttccattttcatttcttcccctgaaatcagtttactttatcattttgataaactcatttcattctcatatatacaatcctcttgtttatttaaatatattaaacttattttctattttgtgcctagcctaatatttaaagcttatgcagttctgattttgctgtctgttgtttctgctggctgttactcaaactgccttattttcctgtgtgttagcttgtattcattatttgtggtgatttctgagactgagatgaagatacgtttccaaagagagtatttacatttgaatctgccaaaagcctggggatactgtcaacctgggaacacattcaaataaatgttgggcttaaagttttgtgggctgcataggtaacatgagttccagatccataaaccttcatgagggtgggcttgtggttaaattttcagggaagatgtatttacctgcacccagcatcaagtttgaaagaggttaatttccttgtttattccttctgtagggtagacatcattctattcaactcttacactaaacatgtatgtagctctttaggatcccaactttatgtggagagtctaattagacttcgtatcgttaatgtaccctagaatttatcccctaaaccttgggttcagtagtgtcctggtaaatattttaaagctggctgtccagggcaaaaaaaaaaaaatcctaatttctcacatttttctatttcacactatggctgatttcacgataccagcctgaagtcattgaacgtggagttgggaaaagatatgtacagttagctttctcaactccagtgtatcactgccagttctgtacatggctgtgaaaactgaagctcaatgcacagggcttggcatatccctcagaatgaaagaatctgagtgtttgcctacccctctggatttccatttttactttgttttaaccttttgagtattctgtgtcaactcagcaatatacttcaaaaaaagattcttttgttttctttttattttaacccagcatttgttgttgtttttagcaaaagtcctgtgttagggtacctatttagtcagaaatagaagtctctgtgcttgtttgtaagtataatgtattatttttctttttggggaaatatagaaagaaatagaagtctctgttcttgtttgtaaatttaatgtatttttcttttttgagaaatagagaaaagtacagagaatattaaaacacccataatcctatcatatatgttcattttatgtgcatgtatgtctctatacatttttatataatttgcattatatctactatttcagtatatgatttttgttaatatataatgaatgtttgctcatgccgttaactattcctttaaaacagcccccattatatatgagactaaacataaaatgctgcacacataggagttagtataattcagaaatttagtctgtattgcatttggaaataattttgtgaaggttattcatgcagcattattaataattgcaaaatattggaaaccatataaatgaccagttctagaagattggttgaatatactctggaacatacaatagactactatgtttataaaagctatctgtttttataaatatatggagtaatttccaggaaatattacatgaaacaaaaagcagaaacaaatacccatagtgctacttgtcatacaagaaaaagggagaattaaagaatgtgtatgttcaggaaggataaagcagaaaacagtaaaattagttacaagaggtagaagggagagtgaggtggaagggatgtgggagggagtgagacttggatattggggtatactttcttggcatagtttcaacttttgaaagcatgttaatgtccaacatattcaaacagttaaataaaaatgatatcactgggacagggacctaaaattgtaaacaaacaagtgaacttaattcatttttttttcttatttttttattattatactttaagttctgggatacatgtgcagaatgtacaggtttgttacataggtatacatgtgccatggtggtttgctgcacccatcaactatcacctacattaggtatttcacctaatgctatccctcccctaaccccccaagcctcaacaggcccctgtgtgttatgttcccttccgtgtgtccatgtgttctcattgataaagttaattttaaagtaaaatgaatactatatccataccgaaaggggataaagaagaaagaaatgaaggaagaagggaggacagatttatgaacaccagattcaactatatgtccttagcttggggtgggtgggagagaaatgaagaattgcaaacaaatcctgaactcacttttgtaggtttattttattttattttatttttttgaggtggagtctggctctgtcgcccaggttggagtgcagtggcgtgatctccgctcactgcaagctcgacctcctgggttcacgccattctcctgcctcagcttcccgagtagctgggactataggtgcccaccaccacgcctggctaattttttgtatttttagtagagacggggtttcaccgtgttagccaggatggtctcgatctcttgaccttgtgatccacctgccttggcttcccaaagtgctgggattacaggtgtgagccaccgtgcccggcctataggtttattttaatggtatgggcaaactaaatcagagactattttgagcaaatgagtgagcctggtttctcactatggaagaagggacaaacatatagacaggaggaagacaggtaagaattctgtgtagaggaattggattggaggtgtctgtgtacatatggacatttctgtgtgtgtatgtatctgttgatgtgtgtgcatgtatttttgtatatgtatatgtatgtgtgtgtgtgtgtgtgtgtgtgtgtgtgaagagacattcatatatttcttagctctattgctgaaagagcaaaggagcgaagtcacaatagtagtgacacacctagcgttatttcccactgttagtttcctaaggctgctgtaataaattaccgtaaacttaacagaaatttattctttcatagttcaggcggccagagctccaaaccgaaggtgtttgtggggttggttccttcttggggaggcagagggagaacctatccatacctctctcctagcttctggtggttgtgcataatccttggagcttgatggtttgtgacattataacttcaattcctgccttcattgtcatatgacattcaccctatgtttacctgtccaaattttactctttttatcagagtaatccactcattagggccgactctaattcactgtgactttatcttaacttccaaagaccccgtttctaaataagctcacattcacagggttagtacctgattatgactttttgaggagcacagttcagtccctaatgcctactaaaactaaagctcttcactcaaatgactggcttcagtctggggcagggtaggtacaagatgaacctagaacatgttgtaatgccaaaaagtaaggaaatgctaaaaagtaagataagttgtttgttaagtatacagaatctagcttgaagagttccccactggtcaaatctagggcaatttgagcatcaaataattaaatacagtaatgaattataagctgttggaaataaagaactttataagaccattccaatcactaatgggtggatggatagaaaatgaagatattttacttacagtggcatgctgaaagttgaccagcaaatgtggaggttgtgctagagttgggaaaaaacaaaacaaggaaacctcattttgcagtcatcatgttaaagattagatcaggcaaaaatcatcaatggttgtaacatctaagaggacagacatgttgatgaagaacagaatatttacatggtcttgaaatgttgtatgggagaagagaaaaacagcaacaatgcagtggagaaatcagacaacacattgacagggtgatcacaagtatcacctccagtgagagtcaaatgaacattgtttgcctccttatgtgtttatctgtccctgagaagtacacaacatcatctatgcagtttctggcccagaatgcatctcaactcaatcacaagagaatattatgcatacatacagaaaaagaaagaatacaactgaacatagatgataaagaaaatgaggtaaaaatgtgacaacagatgaaaatggataaaggtattttctgtgtttttatttttggaactttttgtacattgaaatgattgccaatggaaaagtttagataaattgtcctaaagttacagagaacttgcagggaaaaacatcttaaagtagactaatagtggagagtcataaaagacacttggcaaatcttcttagttgaatattattcaaactattcagtcagggaactgattttgtgctaattatgaaatgcattattgcattgactttatgtctcttacaacattaaattatgttacctaggatcaatttgagattcaacacatgatagtagtttaatacagtgaagtcataacttgcaacaaactatcccaattttaagaattaattctgagcaatttttatatgcatgaaaaagatggttagaattatttgcagacacttgcatattctttagtcaagtggtcttattaccataattcatatctgttgtgggagtagggaagaaagagatttaaaaaatatctatcagttctttcaatcaagttaggtataatattaatagactttgagctaagaaagttttcatgaccagaagaggagcaggaactgtctaacatagaaaatgtttatggtataccataatcagttatacaaatataaaaggaaaaaatgtttgactagtgatactctcaaacttggatatccagaagagtgattctgtcagtacactaaaagcaaattcatctatcaggagctttcatgttttcattcaacaaatatttatccagtgcctattatgtaccagatagtgttatactgtgaatcgggagcatatgttaaaatagacaatatagtagacattattctctaaaattattaacaatagtagctaatactcatatgatacttactctgggccacataccattctaagatctttacatatagtaattcctttacctcaaacaaccttattagattggtactattattacctctattttattgatgaagaaacagaggcacggaggtgttaactttctccaggtttcacagctaaaagtagcagacccaggattttgaatccatcagactggcttgtgtccaagctttttttaattaattttttttattttgacataatttgtagattcacatgcagttgtaatataatacagagagatctcatgtactttttactcagtttctcgaggtaacttcttacaaaactatagaaccatatcataaccatcatattgacactgatatagtcaaggctccaaatatatctgtcaccacaatgatccttcatgttgcccacccacttccctctgttcacctattgaaagacatcttggttgtttccagtttggagctattacagataaagctgctgtgaatatttgcacataagtttttgtatgaacaccaatttttggctgggcgtaatggctcacacctgtaatcccagcattttaggaggccgagatgagagaattgcttgaggccagaagttcatgaccagcctggtcaacgtagcaagaccccatctcattttataaaaataaaaaattattttttaaaaggaacatcaattttcattactttagactgcctctaagcttttaattcttacattctaccacctctcaatatatagtagggaataaatagtagagaatgacttgatggttaagttgacattcagaagaggcctgaaggaagtgaagaaaaaagccatacagctgtttggggaaagcacatttcaagcagagggaacaagcacagaggccttgagaaggaaatatgcctagagtgtttgagacagagcaaggcggctggaaggagatgagttctacaaggcagctatgagccaggtctataagatgtggctgctatatagaaaatagatggtggttgggcaagtgttgaagcatggggaactattaagaggctgcccatcggagcttgcagtgagccgagatcccgccactgcactccagcctgggcgacagagcgagactccgtctcaaaaaaaaaaaaaaaaaaaaaaaaagaggctgcccatgtgagagatgatggtagcttagacttatggtggaagtgttaaagatggttcagattctagatatgttttgaagaagagctcacaaaaatttttctgatgggctgacagttggatatgagaaaaggaaaggaggcaagaatgattccatttaccaggttccaagagaatgattacagaaaccaatagattgccttatttatttatagtaggaaatgtagttatcacatcggcccaaatgtttgtgtctgcttaatccgcatatctgtttctttaggcaaacttgcattggaatgtaatggcgactgcagaatcaggataaggggacttgaataaatcagtctttaaatgcatctgaggccgggcatggtggctcatgcctgtaatcccaacactttgggaggccgaggtgggcagatcacttgaggtcaggagtttgagaccagcatgcccaacatggtgaaatcttatctccactaaaactacgaaaattagccaggtgtggtagctggcacctgtaatctcagttgctcgggaggctgaggcacgataattgcttgaacctgggaggcggaggttgcagtgagcctagattgtgccactgtgctccagcctgggcaacagagcaagactctgtctccaatcaatcaatcaatcaatcagtaagatacatttcactccagcctggacaacagagcaagactctatctcagtcaatcaataagatacatttatctctttagtagggacctgaaaaaattaaattccatagacaaaaggctttctgagctcttctttaataagtagtgttggcagatgcagtggctcatgcttataattccagcactttaggaggccaaggcgggaggatccctgaggccaagaatttaagacgagcctggtcaacataacaagtccctgtctctaccaaaataataataataatatttagacatggtggcttgtgcctgaggtcccagctactcgagacgctgaggtgggaggatcccttgagcccaggaggtcaagcctgcagtgatccatggttgcaccactgcactccagcctgagcaacagaatttttatttttatttaaaataaaagtagcacaaacatttgcttttgtttctctttcataatgcaccaacactaccctaacccccaacataatccttttgtagatttgttaatatattcagacaggccatattccatatctgatcctacttagtggtttgatggttggctaaaaggcagtattaatatctgttatttccatgctattgagggatatctcacattgatcatccttgtattggcaatagaaataaatggtgatagtatttttttcatttagataaatttagcactgctcttagtattattgaaacttagtttaggaatgtatcatttatctataatcatttattgctgaagtgaacccttctttaaattttcctcttccaaatattgatgtagttctttctttcttcatcagttccatgcatacaattcaattttcttcatgacacgggatcatcatctataacgtctgttacttataggactattctatgagtctcttcaagtgtatacatgtatttgcttttattttaagttactcaaattgttatatattttgagtacttatatatacattttaataattttactagccctggagctggtggtgtgtcatcttcaacttcctttttaaattccttctaatttcttagggtgggaaaaatctaattcagtagattgaatttttagaaaagagtagataaactgatgtctaaatatttaggtatttgtctattctggaacctttttgcttcatgatttttcttttttactttgcattcctgagatttcctttcatgaactggaaggctttactttactaagtgactcagcagtagctctatgtatcttttagttggaaatgcctttggctctatgcatgcacacactgcccattaattagcaaaccaacatagaatcatctgttgatgacaaaattaccaaaatggatcatccataagtgtttatactgcaaacagtgtatcagaaatgtcataatctcattcattaagaaatttacatacacaccagattttagagtgctcattcatgatgaatgtctacttccacactgtttgtttggaaacattcaatagccagtcttgaatttaaaaaatttaattgaatgcttaaagaattacaagtgttcctttccttggctctaatgctaaccaaagtgcttttctaaactgctaagaatggactgaagattctgctgagggctgtagatacttatctgcctaattgagccatcatttgttgacatgaagaaaaccacgtgacctactttaatgcatttctcagtagcagcaggaggctagaatgtagttcatccaacagtaaaactagcagcagtattattagacatgtgaaaatagcattggttatgggattagttttgtaaagtaaggatagtaatataaaggtatatagtcataatataaacagtatagagtgatttttttattttcaaaattatttgaatccaataatcatttaagtcagtcattcagtaactatttaccaatgtttacagttgccagctatattaaaggaattgttgacttgtcaaagttgattcatatgagagtaacagtgttaaaatctgaaactggtatggattgctaaaacgaaatactttgagtacacagggaattactatgatcaaaactatgctggatacattaatttgaccatgtgtctttaaattggaggtgaggaagattagttacagatacattaattagaaaggtgttatattagtctaggttgaggctgatataagtaagaaagtaggaaaggatgcaaaagcccttggaaatgaatatttgtgtgtggtgaagtaaaatgaggtagaggttacccttttacatgacttgagagaatcatggctcatttagtaaatccagagggagaaatgattttctatatatataatgagtttggaatacaggaagaatgccaaaaataacatcttaaggaattcttcctaaatagtgaagaaagaaattagtatcaacagaagagacagaaaaggatggttatgaaagataggaggtcatcgctgtctaaaatgactgatggattttgattacaccactggtgatagaaaaaaaattattagagaaaagtgtagtctgagaactatttgatcttagtctgtaatgaatgaaatataaaatttgagactatttggaaactgtttaacaagtttacacccccttccagcaaatacaaaattacaacaaatttaaagatgttaattggtttttatttgcaattctaaaatcggacaacaacctcattctattaaatagaatgaatattccagtaagctgagcagaggaagttgactttatagacagaaaagggctgaggaaagcaaaaacagaaaacaaaatgtggattggtatttccaaaattacttttcttataaaggttaaagcagaggggacttccttataccagctaaaactggtctgtttggggatctggctattatctgtttctcctgatttcttggaaagtaagataaacaactatgttttagcttagtgatgtggaacttcagcttgagtgactccattttggtttggtctggtgggcctagtgcaggagcttagtccaaactaatgggatcctatacattttgtttaacactgccaacatcctggtgcacgatcatcagatttctcattgaacagggaatggatgactttgaatgttggagagcacctgtggtgagttgtttatatataatctgtaaactagttatgcacagtagcactatatatgggtctatgttggactagaggataaaaaataacttggccttcacctcagagagtttaagaatcactatgccaccagaaagatggtagtagtaggcacattacatcgagtgaagactgttgggtgagagggaaggtttgcttaaagatataagagatttgagtttgtatattgtctaaggaagatatgatagaacagaagactgataatgcagtgtggaagagtgataactgctagatggaattgagatcaaaggtttatagatgaagactttatccttggaaaaatacatttacatttatttaatgtttagtttttaaattagatattatgtaacttgagcctcacagtaatccaatgaattaggtgacatatggttggtataattcatccgcctttacatttaagaaaattgagacacaaaaaatgttgtgtgttatccacagtcatgtggttagtaaatggggagatattttcatgcccagttctatgctataactactattatgtctgaaaataaaggcagaaaaaaatacttgaagaaaaaatggcaaaaaaccgcccaaatttattgaaaaacatttgtttatacatctaggaagctctttgaacaccaagtacaataaatgcaaagagatgcacacctggcctcataatagcaaaatcttgactatttgacaaggacaaaaggaaaatcttaaactcagcaaatcacaacaggggaacacaaaattaacagcttacttctcaccggtaccaatgaagccagaaggtaatgagataacatatttaaagtgctgaaagaaaaaaatcatcagcaaataaccttatgtccagcaaaaatatgtcaaaaataaaatgaaatattttcctagataagcaagtctaagagtgttcattgctggaacatctgccttaccaagaaatactaaagaaaattctttaagctgaaattaaatgacaacagatagcaatttaaatctatacacaaaaaacaaagagcatcaataaaggtaattatgtaagtaattacaaaagacagtataatgacatatttcttcactattctctcaactcatttaaaagcaaatgcatacagcaatttgtgtataattgtatttaggccctatgacttattagaatgtaatgtatatgatgataacagcagaaaggaggtgcatggcaacaaagctctattggagtgagtaagaaaaggacaccagatggtaaactaaattcacaagatgaaatgaagaaaaccagaatggtaaataagaagattaatataataaactctttaaatgcttgtagtcctagctacttgggaggctgaggcaggagaatcgcttgaacctgggaggcggaggttgcagtgagccaagatcatgccactacgctccagcctggaaatcataaggaatagaaaatatatttactattcattaagtggaattgaatcatcataaaggtcttcatcctcttagtcttcatttactgtctccaaaaaaaaaaaaaagtttccatgactcttcagtagattatcataaattaagatgtatattgtaacccttagggcaactgatgagaaaataacaaaaaattctagttaaaaattattaaaatgcccctataatatgcttaactgatttttgacaaaggtataaagccaactaattggtgaaaagatagccttttcaaaatgttgctgtggcaacatgacgtcaaaagtgaaaagtggccaaaagaccaaaaagtgaaccttgacctgatacaaaaatcgagtaaatggatcacagccttaaatgtaaaacgatgaaacttttatgaaaaacataggagacaatctcagaatctaggggtaatcaaatttctactgaaaattttagtagccacagcaaataagcaataaatagaaagaaatgtcattaaggttggaaagaagtgaaactactcttatttgtagatgacattttgcatatagaaaatcttaaggaatccactaagaaaaataaaggaggacaggtagtgataaatgcaaaaacagaaagtaatgaaatagaaaacaagaaaatagaattaaatctaaagcctttttaaataaaattaacaaaataatcaaagtggtcataacactaagcaagtgaaaaaagaaaagatagaagcaatattataagtgaaaaacaatgtttaatcataaacaattctaagaaatttggaccaataaaagtttgacaaaaatctgaagttctctaatttgtttatatatttttggtatttatgtatttattgtcataggtttcttagttagattcatggccaaaagtaccatccaaaaaactatttccaaatgtatatttttagcacatacctcttttctgatctccaaacttaatgaccaactggttatttagattattatatgcaaatagacttcttaatatacagtgtcaatcctgtttctcttatgtttaatacatctctgtatatggtaccactgcagggtttgactcatgtgccctagccaaaccctaggagtcatccttgattttttcttttccttcaataagtccctatctttatatctggaacccatttactcttcttttatcagcaattaccattctattacagaccattagtatttttctcctgccctactgctatagtctcctgactgatctccttctactttttaaccctttcaaaccattctccacagaatagctggagtggccttttaaaaatgcaaaccagcataaaacattttgatgtttaaatccctctcatggctgccaatgattgctcatagaataaactccaaactttctgccatggtgtataaagccctacatgtcttacatggctttcctcctacctgtctaatatcatcttattctagttctttctcattgattattcctttaacaaccaagcccttttccttcaaaagtccttcactcttactcctccttcctggaatgctcttcactgttttctaagggctgactcatgtataaccttcaacattcaactcaaatgccatcctcttagagagtcattttctggttagctatctaaagtagctttccctgttcctccatgagctgttgtcataatatccctccaacccccaacccccaccttatataaccatgcttgtctcctttgttgcagttatctccatttgtaattaacttgtttaaatcctcctagaatgccagctaataagaaggtaaggtccttgcctctctctctctttttttttttttgagacagtctcccctgtcacccaggctggagtgcaatgacgccatctcggctcactgcaacctccacctcccgagttcaagcaattctcctgcctcagcctcccaagtagctgggattacaggtgcctgtcaccacatccggctaattttttttttttttatctttagtagagatggggttttaccgtgttagccagagtggtctcgaactcctgacctcgtgatccctccgcctcagcctcccaaagtactgggattacaggcatgagccactgcccccggccttgcctctcttaataaccatattacctctggcaaccagcatagtgcctggtatttattgtgctcagtatgcatctgttgaatattattattttgtatactctatagtgatgagcatgttgtaagcaacccgatatgtataaattcattgatggtgttctctctctaaattttctttattgttttcatggtgggttcatttcctcctttaccccctctttttaggttgtataatcattagttttattttcatctctgattttatatggacatgtttcaatgcatacagacagttaatattcttttcctcctaattatctattatatatatcatcttcagtatcatcaccattcaaaaaactcttttatatgttctagataatgtggcctattttttacgttagactacctgataaggtgtcaactgaattggctgcctttatctacattctgaaccaaaatttaattctagagtttgtagtcagcgtttttccaaatgtgtaaaactgtaatccttcataaaatgtcatatgtaaaagagtaagcaattctgtgtgtactaaaaggtgagaaagttattactttagctttcactgggaagacttaaagtttatcaaaaaggattatagaaagaacagatttatagcaactgtctgatatatgaccagaacccttatgttccactgaaagagacttgccctaggctttctagagcataatgcccttagcaagtagctttcaacatctttttcaggaagcaatattttccttcagtaaaagggtcactgtactgtttttctttttccttccctgtcttatcttttgagttcaggaagtactttaaatttacaggcagctttgaagacatgaagcaagttcagccccagaagtatttcctgttatggcattaatctaattccatgaaagtagaactgatttttcatctgtaaagtagataaagtgcctagagcagccgaccattattctgggttatcatgataaagaggcttagttttgacacaaaagagtttatcagcctacccagtggaagatttcatcctttttgttgaaagatatattaatggattataatctgtcttggcttccaaaagaaagttcacctttatattgaaaatgattagttaaatcagcaaatattttcctgaatatacattttataatatacgataaatcaagcaaacattctagggatatcacatataattaaatatctaatgttaaatcattttatgttattttaatgtttaaattattgtctcaatttgaaataatcacagattttccttataaaccaacttggtttaattttaacatatagactaacataatttctagtaggcatatatgcttcattttagaagcccctgttattaggttatataatttctccttacaacttataatgtagaaatagttttcttataataaggtatttctcttaatagttaataattaaacttagttgattattttaagtatatagtacatacaaataatatataattcaaaagctataatatatttttcctatccctatttcctggttcctctctaagctaaggcatttagactaatcctagtggcttagtattgtttaaataattttttatttgaaaattgattccatattggacatatttacaatatttccttgaataataatagcttaccacatagtaatacattacatatttagttctctcagtagccttctgagttaaattctgttatccatttgaaaaatgcaggaactcaaggttagagaggttaaataattggctaaaattcacctggctgataagtgacagatttgggctggaactcaggtcctctaataccagagcctatattcatagcccatactgtaggattatagaaataaggttattcccagttgtgccttttatacttgaaaagaacaaaagattccactgaatgcttattttacaattaataaattaagttaggctttatcataccctaatgagatatcttattatttgtttaaaataaatgatctaccattatgttcataaataaaaataaagatattgttttattatagatgttaatgttttaaaacttagatcatctaaacatgaaaaatctctggcctagtcaaaggcacactgagaactaaacttgggattggaaaatttggagttttcaaatggccctaccaattcagcgcataattgtatatgcttatcatttttccaaagagggttgaatagtattcttccattgtatatcttagggaggcattataaaggtaatatgacatcagatgttaaacttacttatttaaccagcattcattgaggctgcctactatacgtatcctgtgaagcaatgtgaccaatacaaagatgaagaaaacatgggtgctgtctttagtgaactacccatcttctaggaagaataagatctattgtaatataaacaagagtgatgagtccttagtatatgtgaaggtctcctcagctaagttccaaaaagtaacaagctaactgtaatttcaccaccttagtattttatgaacaccaccttagtttttatgaactcaggaccttacctccactttatgaaaacacatatacacaaagcaaggagttttaataagcacttgaaaagatgctaatcttagccatcagacagtggcataaccatgtgagctttatcttaacacccactaggatgtctataatcaagaagacataataccaagtgttgacaaggatgtggagaacttggaaccctcatgcaccactggtggaaatattggcagttcctcaaaaggctaaacacagagttaccatatgacccagcaattccacttttagatatataccaaagaaaaatgaaaacctgtgtttacacaaaaatgtgtatatgaatgtttatggcagcattaattataatagtcaaaaggtagaaatgactgaaatgttcatcaactgctgaatggataaataaaattagattgttattttacatgagacacaaaaatgaactcaaaacagattaaagatttaaacataaaacctgagaccttaaaactcagaagaaaacatattagaaaagctccgtgacactggtcttgcaatgactttttatgtatgacactaaaagcacaggcagcaaaagcaaaattaaacaaaattgtatctatatcaaaccaaaaagtttctgcacagcaaaggagacaacaaaagaaaaggcaactcacagaatgggagaaaatatttgtaaaccccatatatgataaaaggttaattatccaaaatatgtaaggaactcatacaactcaatagcagaaaacccgattaaaaaatgagcccaggacctgaatagacattttccatagaagacatacaaatgacccaggtatatgaaaacatgtgcagtgtccctaatcatcaaagaaatacaaatcaaaagaccacagtgaagctgggttcagtggtggtggtgcgtacctatagtgccagctacttaggagactgagataggaggatcagttgagcccaggggttcaaggccagcctaggcaacataggaagaccctatctctttaaaaaaagaaaaaaaaaattactcccccacccccactttcctctccctcacaatgagatactaccttaaatttgtgactgttatcaaaaagtcaaaatcatgtggaaaaaagggatcccttgttagcgggaatgtaaattggcacagagattatgaaaaacaatacgaaagttcctttaaaaacagaactactatataatccaacaatctcatttttggatataaatctaaaggagatcggccgggcatggtggctcatgcccgtaatcccagcactgtggaaggccgaagtgggcggatcacttgaggacaggagttggagactggcctggccaacatgatgaaaccccatctgtactaaaaatataaaaattagctgggcgtggtagcacatgcctgtaatcccagctacttgggaagctgcggcaggagaatcgctcaaacccaggaggtggaggttgcagcgagctgagaacatgccactgcactccagcctgggcgacagagtgagactctatctctaaagaaataaataaataattaaataaacggaaatgaaatcagtatgttgaagagatatttgtactcccgtgttcagctgcattattcacaatagtcaaaatagggaaataccctaggagtctgtcaacagatgaatggataaagaaagtatatgtatatataaacagtggagtactgttcaaccttaaaaaagaaggaaatcctgccatttgcaacaacataggtgaacctgcaggacattatgctaagtgaaataggccagacacaaaaatatagatactgtgtgatctcatttatatatgaaatcttaaaaagtcaacctcatagaaacagggtagaaagtgtggttgggggagggaagaagggtagtggaatgatggggagattttggtcgtggggtgtaaacttttagttataggatgaatacgttctggagacctaatgtaaaacatggtaactatagtttataattatgtattgtatacttgaaatttgttaagaaagtagctcttaagtcttctaccacacacaaaaaaagataaatttgtaagttcatggatatgttaattggcttgatagtggtgtcatttcacaacatacacatatatcaaaacatcatattttatactgtgaataaatgtaatttttgtcagttataactcaagaaaattgaaagaaaaatgtattatatccacacagtgaaatattatttagtaataagcaggatgaagtactttcatccatgctgcaacatagataaacctttaaaacattgtgctaagtgaaagaagccatttataaaaggctgtctattgtatgatctcattcatgaaaagtcttaaataggtaaatcaataaagacagaaggtatattggtggttgtcttaggctgaaagtgttgtgggacaatgctacactcctaatagatacaggatttctttgggagttagacaactaatctaaaattgactgtggtgatggttacacatctccgtcaatatactaaaaatcacgaattgtatgctttaaatgcaatttatatgtgaattagatctcaataaagcttttattttaaaaaatagatggtattaacaaaacttttagactactgtgaccacttggcacacctaacaacaaagcatccaaggagattaatatttaaacgtacattataatatgaaaggcatgaatttagatgggggcatgtaacctcttgaagaaatatataatgtaaaagtgttattattgctattttatttcttattttaatcaaacactgtgatagtattattcattccactgtaacccctattggataaatacattatagtatttagaataaaactcatgtgttagtaagccagtgagaaagaatcataccagagctttatagatcaccagttctatctcctgtccctccatttcaggtatatgcaactggcctacctgttcagagtattaactctatggtgcttcatcagtcagaccatccactatgcccaaatgagtaatatgtccaaactgtatttgcaaaatgcatttcttcacagaaattaatatcctgtgcaaatgctggctaattgattattactctttcataaaggcttaattaggtaggaaacccagtacctgcagcgagagaggaagaaaagtctttcctagggctagatcctgacccaaggttttggattttaatggggcagagttgtctgttttctattaaacacatacttgggagtaagtagacttgcccatctcctgttttatactgatcttttcacgaatgtgaacctttttcttgaaagagtaaatatctttaaatttttctgtagccttccctgttacaagttaaatgttcctacttctctagagtatttcgaagtgtttatttaaataagtaaacatggatagacactattttgtagcaaggggttgggggagtatactctaaggcagcttctctctgacagcttatctttcttataagtatagtgtaaacatataatttataatgtgggaaaagagggtttgatcttttaataaagccatttctttttatttcagagttaaggagtttaaattctttttctttagcatctagcagtgagttcaggggtgatggtcattaatatcttgatccattacttttcctaaaagataagattttttttcccataatggttcatttgtctgactgctttatttcccaccagaaatcacaaaatccatttttcctgtgacagtataataattttcacaacatctgattttagtggcacatacatgcagaagattaaaggtgtaggttagaaaagaagcagtaagaaggcattgagaataaaaacatggtagaatttatttctttaatgtcataataactaatttagaaaaacaaatataaacaatgggttgtaaatagtttattcaatattttaataaagaattaattcattacatgcacacttatttttacatacttgcccagatttcttaccaaaaaaaattttctcgccctattctcaaacaaaatttatagacattatatacagcctctgttgaaaagaccttctgttaaaatcagctgcccttagcttgacatatcttgagttcttagtgattaacatgttaataacaagtgtgaatgtcattaatgttcctataattaatttcagtattaacaccttatgtttcttattattcattcctcaaatgaaggatttttccatttataactaagtggcaattattatatcatttttatataatggagcaataaattgtatctgatgttattaatagtaattcctacattccttataacatacttttatactcattcctttatatattcctttactgttatataatactttttaagtgcctttaagtgaagagaagtggttgaaatgtaaaagaagctacttggaatgtctgtaataacaaatgtgttagtatatttacacctgcttgaaggaaagagtaaagtatttcctgaaaaccccacaattatataggtagttcaacctctgatctgcactgaggcatttaacctctcttaaccttggcttccttatttaaaggaagtggctgttgagccttacctaaatcataaagtgagtgcaagtaattgtttactgagaaatctaagaaaggctaatggaaaacatcaagtatgaatgaaacagttataactgttttcccctttgaaaagaattgctgttccacattgaatttctgtcatgaatctaactctttttaaatgagctatttaaatttaaatacataaatggatgttatattttgattttaattacttcagtagtaattcagaattaattgaagctacagcttaaacatattttattacatttaaatagttgggaaaaaataaacagttggttagctaaaacccaataaataaattgggaatagattctgctagttgaatgctgaaatgaatagtatatactttaaagggctttaattttttctttcatactgatttaagactgataatttatctctttacttattctaattatttgaccctttttgttggaggagagggggcaatcttgtcactaattgtgtaacccttgtttaatttactctttcaggaacccttccaaccttccccctctccaccttaatacactgatgttcattttggatttccaagagggagatatgatatgcaactttaaaaaacctattttccagtcaagccatttttcaaagagagcttattaacctctcctatggatcaaattgtgaaatactaaactaggttgcctgtggaagtatagtgagagacgacgataggaaagaagataggatggggtcagaagaaccttacattccatgcttaggagtataaactgtatacgataagcagctgggaaccataaaatccttttaagaagtattgtgatataagactaatttgaaagaatagtgagaaggtggataattgtacatttgattttattcctttatgctaataattcccatgtacatacagtgaatgaaatataggagacaaacatcttcaactattctcatttcttattggttttagagcttggaaatatgttaaaaagacatgtaaactagttccatcaattgtatttcctcctatttagatagtacagtgattttgagcaaactgttaacattgattttaaaatccaaaatatattattagtctataaatcactgcatggttctcattcattgattttcacttaggaggctttggggggttgttttgtttttataatgctttacccaaagcattttaaatcttctactctccagtaatagtttttgtcaaatatattttgatatctgctgtactatttgctatatttacttaaacatctctccactacgtagagcaggtactataggaggaaaaacttttcctctaccctcttatgttcagtagttggtgcttgcaaattaaactgacaaaaaattaggaggataaaaggattattttgtatgcacgtgagaagcctcacagaaaagaattgaaaaccccaaaaaaccaatgagaccaaggggcttacatatcattttaagaaagagtgataaagtatggagaagagactagacaaaatgggggtttagacttctggtggggtgagggtgggcattaatgataggtgactaaggaatgagtggtaaataagggttgtttagtaaggtttattaggcagagtcaagtgagaagagtctgcttcttctcttcctggtactggagaggaggacgccattacaaatatgaatttcctttacaaaagggaaatttatgccctatttttaggaagtaaaggggagggcagagagctcctcctatgtttgctgttttaattgcctgtagttcaaaataatccttatgctgaagtggcatatttgagggtgtcatactctgatccccttcactatagactactctctaataccagggtactgagttaagataattctgaaggcttcgctaataatctactactctttgtcaatttcctatcttagttttctcatctgtaaaatggagatcatgatagcacttacctcaaaaaatgataagaagtcaattaaaaaagcaccaaaaaatgcttaataaagtggtctgacacatagtaaattctcaatgaataatgtatatactgttaaggagtcatttccctctaagagtacaaagtacaaaagaaaaagttggagcttaagatttaggtttggctgggtgtggtgtatcacgcctgtaatcccagcattttgggaggctgaggggggtggatcacctgaggtcaggagttcgagaccagtctggccaatgtggtgaaaccgcatctctactaaaaatacaaaaaatggcagacgtggtgatgcatgcctgtaatctcagctatttggaaggttgaggcaggagaattgcttgaaccctggaggcagaggctgcagtgagtcgagatcacgccactgcactccagcctaggcaacagagtgagactctgtctcaaaaaaataaataagagttaggtttaatcccagctacttgggagggtgaagtgggagggtctcttgagcccaggagttcaagtccagccggggcaacctagtgaacacttccctccactccatctcttaaaaaggatgggagtgttcccagtgctgattatgccacctattagccgtatgaccttggacaactgtaagcctcaactttcccatctatgcaataagaatcatttttacctcattagattgttatgaggattaaatgaagcagcatgtatatatgtgtatatatatacgcatatatacatatagtatcttgtatataataagtatttattacatgcaatttcatcttttatgtagactttctagactctaaccttgccccaggaagataagtgacttttacattaagccatgttctctttttcctttatgacactcctcaatgcttaatgaagaactctggctacacaaaaaactaaagtaaaatgttgacagactgcttttttctacatctgggcttctttaattgaaagctgacatttaggccaagaattgttaggaattcctatttaggtttataccagttctcgcttatatacaagatgtatacttgtgtatacatgttatttacacacatacaataatatatactggctttctttttttccctctcatcccataacagatagtatactgccttttttaaaaaaaaaaatgcccacttttcaaattaaaaagcagaggcacacattctttccaaatgtattagtataatttgaaataatgagattgtattaataggattcagccacagaaacagacccattagggaagatagagtgagaataagatttatttgttggttgatcgattttgaggaattggcctatgtcattgtggagactggctaagtagtccaaaaccatagggcaggcaaccaggaaggggagaaagccttgaacttcttaggcatgggcagaagctgtcattcataggtggaatttattctctctgtcaaggaaacttaagccatgcttttctttttaaattttattattattatactttaagttttagggtacatgtgcacaacgtgcaggcttttactttcaactgattgaatcaggcccctccagattatccaggatactccagtaatagaagtcaactgactgggagttttaattacatctgaaaaatacctgtatagcaacacctagattggaatttgattgaataactagagtctgtagcctagtcaagttgtcacctcaaaaaaaccatcttgggataaagttttttgaaaaaagaaatagaaagttcagggcattttggtcattatttttgtgtattgtgcctattatatctttttattttaaatttttgagaatctgtttagtgcctagtattttgccaagattataaaggaaacaaaggtatcttaatgtttttttcaaatcttaacatcttaaagttgtttcaagcattttccctgaattcattgattaagtattgttagaagaagtggaacatggatgatgcatatgctttagattgaggcaggagtatgtgtggtgactaagagagtaagaaatgatgatctcgagaatactagactgtgagctttctaaaagctggtatcgtgtgttatttatccttgtattgccatggcctggcacagtaattgaaaaagttcaacaatggtttgttgtttaggttgattaaggaatgagcaaaaacgtaacttaaaagctatctgtattgaagtgtgatctgttatatgtattcagatctgattatacttggagtcgaaatcactgtatctaaattaatattaagactcagggccaggcacattgtctcacatctgtaatcccagcacttcaggaggctgaggtgggaggtcagttgaggccaggagtttgagaccagcctgggcaacatagcgaaaaactctgtctccacaaaaaattaaaaaaataaaaattagccggacatggtggcatgtgcctgtagtcctagctacttgggaagctcaggtggaggatcacttgaatctagaggtggaagctgcagtgatctgtgatcgtatctctgcacttcagcctgtgtgacagagtgagactttttctcaaataaaagaatcaatacagcaatacagccccaatttctaaattggagaaagtcattttctatttcgtctctctctgttcctccactagattgtaaactctttgagagtaagaattatgcagttttgtctgctcttcaatgttttattgccttgcattaaaaagataataaatactgcttgatgaattaattaaaaacagcatacagaagagatccaaatttaattttgtaataaatcacctctgagaataataagaaaaccagaatatttgaaatacatcatttaattgaataaggaacagtaaactgatttttaatgttcctgtttttatgtatttgaagttaatgtttagttattttgttttaaaatctttataaaaattctctgctttatcttccagtgaacaagacatattaatagcttttctgtagagcaaggcatattaatagcttttctgttgaatatgaaagaaagcagctgtagttttatcctactgagtacaaatatttgttggggaattaaagatttattagataaatggcttaaagattaattaattaactatactatctttttactttcctatcttatctgtaggccattggtctgttaatatatataaattgctctgtttcctgctatctttccatttcttaattaaatattagaaaaatgcccaaggaaaaacaatacaactgagcttcctttctggttttcatgcttttaaaatttataaaaattgtggctctgctgcctttttttttttttttttttttttttgtagttagatgaatttggcctgagattctatgaaaaaaataaaacaatagtttttatttcatgatttttttttcaagttgttctgattttataatatctagtcaagtgatgacatgcagagattttgctgtgaggagagggagagagcaaaaagtattctgccctgattgctttttagtgattttattactagaaagataaacattgccttgttattttagccagtaaaattgtctgcaaagtaggtaacaaaatgcaaagcagtgtatttacttttccactttttcccaaaggtatgataaaagcagggttccagtggaacaatttgctgagttctttcctagggagcactggtagcccgtattaaatgattatattttggaaaatgctaatgatgaaagatgagaataatttatattctttgaaatgtgactaaaaagttggaaatgaaacctatctttctgaagtgacatccacatttgtggttcattttcatcacacctgattcacttctgccagcaattcagaaagaaaggtggaggtgggaaagcatatatgtagctaagctactaaagtgactatttgagtatttcattccatctgtcaaaagattcagtgggataaagaatttggcataaatggatgtaattcattctctttttacaaagaagtaaatgatagaacaaaatcatcctaaaatgaaggaacaaaataccagaaagtgaaagaaaacaaaatttgtattttttgatagaatagtagcagaactcaatgtaaaaataatgattacattaataattatttgctcactttttcctgtatttggtattttgggaaagtgggcttgaaaaacagtggatacattgatgaaacatttcaattttcacttgcctgttgtgtttgctcatgttagacaaactataacttctcggtgtatagatatgatgtacacaaaattacacagaaattaagccatgtataataatgcatgactagaagaaagatatatctcccttgaacaaataacagttattttagtaaatttgtaacagagaaaataggcttgattaacaaaaatatgaaagatcttttaaataaatgaattttgaattttcagagtagcccagaattttatctaaactcggattatttcattagctagaacatgaaaataggcatttattctactcacctacagcttctgtagtactaaatttatggaatgaggctttgtggtgctgccttcagagctcaatgatttgctttttctgaattttggaagtctgtctctaattgattgacacatatgaatgtagtgggaagaaatgagattaagcatacaagctttctttttcatttaaacatcattgaagccatgaatttgtaaattgatataaaaacacaatcctttggatctgtattaggaaatttataaatgggagctttattttgctccagaaatgtgataattagaaatatattcaggtgattttttccctttggtttttgttgttttttaatttatttttctttcttatttttaccaaaggttcaagtcatctgtaatattcaggtgtttttaagaatttctcatggcaagttaattgtgggtgaacatttccctattggactaccagatgtactttgtggttataacttgcatagctccaggatttttcgtgaacaagtaataaaacacatttctggtttgctttctgccatagagtattaagagtttaacactttttaaatgttactttaatctctgaaattttcaacaatgattagtggcagtatactcaaaaaaggaaatgtgtaggctttactataataaaaataagaacaacttatataagctccacactttatagatttgtatggatatacaatcaaatgtactaatttttaaattatcctcattttgcagtaattttacattttgctcatttgtgcaaaccgtggtgatagtaaaatatttaacagaaattcaagcacattcttttaactctttctgaaaaatctcacaaatgagatttttttaaaacagttaagaatttactaaatttaaaatgtatatatacctgatgccatccagatgttttattgaatttctaaaataaaagtccacctaatgaatggctaatttactcaacacgtaagacaaagatgtatttctgtgttactaagaacatgcatcctatctccttgacaatggctctaattacctcagcttggactgatcaatatttgatctttttcccaccatgcaaacatgttactttgactttgtctcttcctcttcttttcagataatttgcagccatgtgagaatggttcattttgtttgttctccctggcttgaggccaggggtctcttattagtataatgcagttcattgatgtgaatttgttgatctcctgggtaggttttcacaaatttaaggcaattaaaagcttttatatggcatttcacttgaagttattagtggcctttcagtgattttgcttttaaaaattacttcatcattttatgattatttcctttccttctcttttctctactctccccatgctataaaattctatagtaaaggattgaaacaactatttcattgatttcattaaaagtaataatttataaacttataattcaatagcttaatattttaattaccacaatttttaaaggactaatgaaatttttggttttgtgttttcaaaagctgctttgttttaagcatataaatattcatgatagaagccataatttggagaataataagaattgaatctaaaaattattagtaattgctaaaaaattcaaaaagcacatagtgtaaactttgtgtatatgagacagaactttttctaaattgcagtttcattaacatcttaaagttttctcgtagctaacagatgtccatgatatttttgcttccttaacttttacagtcaatggaccattctccagcaggtcataagtaagaatgttaaataacggccactaaatcttaaggaatgtgacaacattgattagattaaaatcctttgacttcattgacatatcttttttctttccccatttaaaaaattgtttcagttgttttcctactgtttgttggtggcatactttgttacagtacttgatccagtttgtttcattggtgtgcttggtaaatttgaagaaatgatcactggagaggatttgaaataactagcaaaagttttgaagtattgcagtgagtatatggaatgtgttactcatttatgcaaaaaatattggtgtttttatactttttattttaaaaaatatataacaataatagcaaatatttagtaagaatgtaactttatgccatactaaggcaagaatagtatattgaataagaggatataccctgaaggcagggtataaatccaagttgcgctgcttactagttcacttcttaagcagttaacttctgaatctctctttatgtgcaaaatggtataggagaggaaaaaaaatatctttccctcctgatatgtacatgactggggcctctataacaaaaacagattaacaagagaaaagtatactataatttaagtgtaagttttacatgacatgggagccttcataaggaaatgaagacccaaagaaacagctaaatctgagtgttttttatattaggttcaatggtgaaatgatagggtatgaagtaaatgtagtaaactgggtgaaacttggcaaggcctttttgtttggattcccctctgtctctttgtctttggagaaaagatgctcctttatagagagggtaccattcacataagggtcttgtgacctacttaagggaaaggtcaaaaaacagttaccaggttttatgatctgtttctagagaaaagggcaggggacagtcagagagaccttcctgcttctgccattttctcacattccttcaccttaaaattttcaatatatcaaggtgctatattttggggtagtatatcctgaaccgtgcctataggaatgatgataataatatctactttataaggataaaatgagacaatatgtataaattgtatggaacagtgcatgaaccacaataaacactcacaaaatgtttgctataaagatattttcgaccttccatggtggttcatgcctataatcccaacactttacgaggctgaggtgggaggatcacttggagccaggagttcaagaccagcttgggcaacatagcaagaccccatctcttaaaaaaaataaaaaataaaaattacccatgcctatagtcctaattacttgggaggccaaggcaggaggatcacaattgatcctcaggaagatcatgcttgtctgtaaaggattttatatccccttgacttatgaagcttagtttggctggatatgaaattctgggttgaaaattcttttctttttttttgagacagagtctcactccgtcaccaggctgaagtgcagtggcatgatctcggctcagtgcaacctctgcttccctggttcaagcaattctcctgcctcagctgccctagtagctgggactacaggtgtgcgccaccacgcccagctaatttttgtatttttattagagacagggtttcaccatgttggccaggatggtcttgatctcttgacctcgtgatcctcccgccctcggcctcccaaagtgctaggattacaggcgtgaaaattcttttctttaagaatattgaatattggctcccactctcttctggcttatagggtttctgcagagagatctgctgttagtcccatgggcttcactttgtgggtaacccaacctttctctttggctgcgcttaacattttttccttcatttcaacctttgtgaatctgacgattacattgtgtctgggggttgttcttctcgatatgtatgcacccaatacaggagcacccagattcataaagcaagttcttagagacctacaaagagtcttagcctcccacacaataatagtgggagactttaacaccccactgttaatattagacagatcaacgagacagaaaattaacaaggatattcaggacttgaactcagctctggaccaagcagatctaatagacatctacagaactctccaccccaaatcaacagaatatacattcttctccgcaccacatcgcccttactctaaaattgaccacataattggaagtaaaacactcctcagcacaagcaaaataatagaaatcataaaaaacactttctcagaccacagtgcgatcaaattagaactcaggattaagaaagtcactcaaggctgggcgcggtggttcacgcctgtaatcccagcactttgagaggccgaggcgggcggatcacaaggtcaggagatcgagaccatcctggctaacatggtgaaactctactaaaaatagaaaaattagccgggcgtgatggcgggtgcctgtagtcccagctactcgggaggctgaggcaggagaatggcgtgaacccgggaggcggagcttgcagtgagccgagatcgcgccactgcactccagcttgggcgacagagcgagactccatctcaaaaaaaaaaaaaaaaaaaaaaaacctcactgaaaaccacccaaccactgctcctgaatgaatattaggtaaataatgaaattaagacagaaataaagcagttctttggaaccattgagaacaaagacacaatataccagaatctcttggacacagctaaagcagtgtttagaaggaaatttatagcactaaatgccctcaggagaaaactggaaagatctaaaatggacacactaacatcacgatgaaaagatctagagaagcaagagcaaacaaattcaaaagctagcagaagacaagaaataactaagatcagagcagaagtgaaggagatagagacacgaaaaacccttccaaaaatcagtgaatccaggagctggttttttgaaaagattaacaaaatagatagactgctagacagactacttaagaagaaaagagaaaagaatcaaatagacacaataaaaaatgataaaggggatatcactactgatcccacagaagtacaaactaccatcagagaatactatagacacctctacgcaaataaactagaaaatctagaagaaatggatacattgctggtcagataccccctcccaagactaaaccaggaggaagtgaatccctgaatagaccaataacaagttctgaaattgaggcagtaattaatagcctaccaaccaaaaaaagcccaggaccagatggattcacaactgaattctatcagaggtacaaagaggagctgttggtgggagtgtaaattagttcaatcattgtggaagacagtgtggcgattcctcaaggaactagaaccagaaataccatttggcccagcaatcccattactgggtatatacccaaaggattataaatcatggtgctatgaagacacatgcacacatgtttattacagcactgttcacaatagcaaagacttggaaccaacccaaatgcccatcagtgatagacgggataaagaaaatgtggcacataaccaccatggaatactatgcagccataaaaaaggatgagttcatgtcctttgcagggacatggataaatctggaaaccatcattctcagtaaactaacacaagaacagaaaaccaaacactgcatgttctcactcataagtgggggttgaacaatgagaacacatgaacacagggaggggagcatcacatactggggcctgtcagggggtaggggactaggtgagagatagcattaggagaaatacctaatgtagatgacgggttgatgggtacagcaaaccaccatggcatgtgtatacctatgtaacaaacctgcgtgttctgcacatgtatcccagaacttaaagtacaattaaaaaataataataaaattttaaaaagaaaaagattgggtatttcacatcttcttgaatgtaaaactgggggaaaataatcttttttaatgtgcattaaaactttttttttttttttttttttttttttggggggagaaggtctcactctgttgccctggctggagtgcagcggtatgatcaccgctcactgtggcctcagcctcacaggcccaagtgatcctctcacttcaggctccaagtatctggactcaaaggcgtgcaccaccactcccaggttttgtttttttttttttttttttgcagagacagggggttttctatgttactcaggctgttttctaactcccagcctcaagcaatcctcttgcctcaggttgccaacgtgttgggattacaggcatgagccactgtgcctgacccagtgaaacattttagtgcagaatagttgtgaatttttgaaatagataaccaagaaaatttaacttcagatatcacctagttgtaagttatctctccgttttgtcattcaggaatgggttttctgagactttctaaagaaatatatattatcgttcagtttggctttggaaattttattattgccctatatttctagtaaagtaatgtagatctagtttgatacaaaccattctatacactacaccggtactatcagctttcacttttcacagctcccaaaacaaataaataaaagaaaatagctttcttttctatgccgtttctttctgaaatagtactaatctgccttacctttaatactatcccatagacccacctagtagctcttcccttacgagagagttcttttgatcagataaggtttaatatggaaaataaaaagaaataatcatttaaaacttgaccaaaatattttaaaaacatacacatatatactctaccttaacatatggtgaaaagcaatttttcctaaaatatattctatgaaaaaaaaattttggccaggcacggtgacttatgcctataatcccagcactttggaggctgaggcgggtggatcacctgatgtcaggagcttgagaccagcctggccaacatggcaaaaccccgtctctactaaaaatacaaaaaattagctgggcacggtggtgggtgcctgtaatcctagctacttgggaggctgaggcagggagaatcgcttgaacccaggaggcagaggttgcagtgagctgagatcacaccattgcactccagcctgggcaacagaacgagacctcatctcaaaaaaaaaaaaaatttatttccaatcagttggaaaatgtaagaatatgcaaaaatttaacagatttctttaatgtgggtttttcctagaacacctttttacatttcagaggacattagagttcagcaggacacagtttggtaaatattagtataaaaagttaggctcagccgggtgcggtggctcatgtctgtaatcccagcactttgggaggctgaggtgggcagatcacgaggtcaagagatcgagaccatcctggccaacatggtgaaacctcgtctctactaaaaatacaaaaattacctgggcgtggtagcacacgcctgtagtcccacctgctcgggaggctgaggcaggaaaatcgcttgaaccagggaggcagagattgcagtaagcctagatggtgccactgcactccagcctggcaatagagcaagactccatctcaaaaaaaaaaaaaaagaaaaaaaagaaaggagaaaaaagaaaaaaatcaggctctctgtagtcaaaagtcaaacatttttactgctaaaataaggcattattttttttccttgcttaattgccatgccaacttttattggttctttcctgtctcccaatgagttaaaaaagaaaaaagtatccaaatgtgttcccaccccaacccaagcctgtgatcacttctttgtttttttgcttccctgtaagggtatttctccctataattatactcacactttaagaagtaggagccattatactttattttcaaatttcaaattagaaagtgatttgggtttggaagcttgtttctgtctctggctatccaactgtttctcggctccaagatgtgaaactgtttcttcaccctaacggcaaaagggcacctgctattgagcgtgctttgagcgttattctcccaatagtaccctagataggtaagacatttttgaaatcaaaaataaacaaaaacttcttgttgtgatttctctgtataccaaaacatcctcttgacataaactgtgttatcctaatgacacagacaaacacaaattatcttcatttgggttgcagagttgggggtcatttcttgtgcttatgagcctgctattctgcaactgtgagatttcagacatgttcaatttgtggattttattttttattacacacacatgtgtagtattattgcttgtaataccttgtatgaatataaaaagattgtcatttttcaggtgtatattaacttcattaattttttacaattcaaatgatggagagattcctattgaaggatacttagctttttctaataattcagttatgattttatattcaatgtaaatgattttgtctctctggggccagattatcctatttaccttgaccccctaccatgacaatttaaatactgcatttaactgtagtatatgtaagattgtccttaacaaatatgagacttgaaaggttgtttttgtttgtgtcctctcctctgaagttttccttttaggatgacagcatacgatagatgtgttctagtaaagtgcttcttttattcatgaattacaaatagcttaagaaaatgtttaaagtaaagctataatgattagtcctggtagtctccattttattcagaatgtctctgtcagaaattatgtcatcactatggactgttagccaggaagttctgtctagcagatgaatgaatagggagtactgagttttctaataaaagacactgttgtaatattgaaatactgctaatggaggttgccagttttctgttcttaaatttacaggacatcttctgtgattaaagtaaggaatacttagagcaagtccttagagtaaaccaactataaacttaagaaaccggaaatagaattttttttttttaaacaatgccatttaagtccctaacttgtcttggttcagctgctagacatttgttcctttgtctcaaaaacgttagcagaaagcaataaatatagttcttgctttactcagctaacatctgattttatctgcacattgcttccatcttaaaactttcttaccttactagtctgaatggcttgtgtagcctaatactgttataattgtcagaacaaagggtttgattattttggcaaggaaaaaagcctggtaatagtatttgcatttcaattaattgtttcattctgatttgaaatgtgacttatgttagatacatctctgatccttccctatctcagtactaatactaatatgttgtatttccactacaatagcattacatcttacaaacatttatttcctttataactgacgtagagctttccacatagtagatatttaatataattgatggtttggaattcatacattttgtaggctaagtataactctcctactgtttcacctacttcctaagctagatttatctttacaggtactagactttatagaactaatggtaaattcagtatgcatatcttctgtagtaaacatagaaaaacatttttgtaatagtgctccccaaattttagtttcttgactagtaatgaaatatcttatctgtactagagttttgttatacaataatgacagcattttcatgtgctatgttatggccagttaactaaaaataagtggatatttaaaatggaaaatgaaattatcctgttgcctgaaatatcttgactcaggttctattacaggttgcatatggtatctgttagagctttgaatctatgttggttgttgagttattatgtgcattaactattgcattcaaaagttctttaaaagcatatgtctgttttaaatcttatacaaattccttgcaggttttgagagcagtctttttgtatgtctttcttgtttgttgttttgtttttataccagagcaccatgtcctaagcagcagtaaatttaaaacattgcttaggatagttttataatatcattaatagatttttatattagatagtttctctgaattattgacctattatagggaacatggaaaaatttagaaaaattagaagttatacggagtattaagaaaaaaactttatattttggtactcccaggaaaactaaaacctctttctaagagtatattttaggaaattttctaaaattttgtaaatcaacctacagagaaaaaaagtatagaaagtattttgaaatatttgtgtgtatatgtgtgtgtgtgtacacaagccacattttctcctagaactcactactgaaatttctgaaagtgattcaataagatatatatttcatatctggtttttaaaatccatagaatttttgtgttttgaccatcaggtagagtcttacagtttagtcacagtggaatcatcagcttcaaaatgaaagaacaagatagtctcttggcattcaaaaatttagcatactttaactcatatttgctgtgatgttaggtagtgaattattcttgttaactatctagcgtccaatgtgacatgtgtttgttgttacctacaacttatcaaataaacagttaccctctggaatgataagaacttgggctttttatgaaaaataccctctaaatgaggacagaaatctatattaaggataggctattgattaaatttagagatacacataaagatgactctcatataaaatttagaataaacatgaaagttttagcatgtccagactttagggatttaggctttatgaaggtctcaagcctgtctcctggaattccaacattgtgatgactcaaattttatcagtaaatatggaaaaataagctaaagttcttgagaaattgctatctaataagtgattattttattttttttctagttttaaaataaaaaatctttactatttattagattcaccagtgttttatactgggggtccccaacctttttggcaccaaggactgtttcgtggaagatcattttccacagggcagggtgggggaggggtggtttcaggattattcaagtgcattgcatttgtcgtgcactttatttctgttattattacagtataatatataatgaaataattatacaactcaccataatgtagaatcagtgggagctctgaacttgttttcctgcaactagacagtcccatctgggggtgatgggagtcagtgacagatcatcaggcactagattctcataaggagcacataagctagatccctcacatgcacaattcacaatagggttcgcactctaatgagaatctaatgccgccagttatctgacaggaggtggaggtcagacagtaatttgagcaatgaggagtggctgtaaatacagatgaagcttcacttgcacatctggcactcacctcctgctgtgtggcccagttcctaacaggccatggatttgtatccgtccatgtctgaggggttggggacccttgttttatacaattctaattgtgtcattgaatttcttttttcttttttctcattgttaggaggctaaaaacaaacttgtcttgtgcagattcgtcgtctttaccaccaaatttttgtcatggtatcttgtcttttttttacgtctttctaaactgccttaatccttgtaagggaataggtaaggtgtaaatataattaataaggtgcaaggaaatgttattagaaagaaattagattgttatttgaaaacatacagagcctaaatgtaagagaaatgtcctaagcaaaacttattaacaggaaatttactgaattggaaagtactcttgattttatgactaatatgaattgaggtattcttatagacactcagagattcctgtacacatgttacttgtgtttttccaaaactatatacgtatagtctttttacaaataaacagtggccaccaagaaaaattacagcagtacacataagacataccgtatacatgatactcaactttgtctatatcctttgtgttcaagtttctagaaattttcatctttgtaaggatatcatgtgagtgtgctcaaggtttgttctaagaatctagctgagcacagtggctcatgcctgtaatcacaataccttgagagtctgaggcaaaaggaacatttgagcccaggagttcaagaccagcctgggcaacatagggagacccccatctctattaatttaaaaaaaaaaattacctggacatggtggcatgcatctttggtcccagctacttgggaggctgaagcaagaggatcaagaggatcacttgagcctggaaggtcgaggttgcagggagccacagtcatgactctgcactccagccttggtgatacagcgagaccatgtctttaaaaaaataaaataagaatctatacacaattcatggaatgatgttgttttatagttttactgtatatttgtttctgtcataacttccaatatcccaaaaactttttaattatttttattcaagacatacatacagaagcaggccaggcacagtggctgatgcctgtaatcccaacatttttggaagccacgatgggtgggttacttgagctcaacagtttgatgctacagtgagctatgatcatgccactgcactgcagcctgggcaactatttaagaaaaaaagagagagagagagaagcagaaattcaaaggacactttttgaaatgcacttaatgtaaaggctgctttgcatggttaatttattcctattaaaggaatactacattcctgccacttttctaggtggtgaatttatagcagcgaccaggtaaatattgctgtcctcagggtgcttacctttcagtgggtaatgctttaaacaaaatatctagtatattagatggtaataagaaccttggagaaaaataaaacagaaaagagtgttcaggtctagcatgaaaggttacactttcaaatctgatcattagggaaagtctcacccaagacagtgatgtttaaaaatatttcaagaagcaagttgtgcacatattagggagaaaaacaatcagtgaataaatagcaagtataaagtctctatgccaggagcatagcatgtttaaggaatagccaggagattaatatggctagagtaaaatgagcaatgggaaaagtaagtaggagatataattacactgggaaagagtctaggggcatattaaataagactttataggtcattataaagactttgttgtttttgttttgttttgactctgaatgagatcaaaagcctttagagggttttgtgcagacgagaaacataacatgacttatattttagtagggttattctcactgttatatggacaaaactgaatggggcaaagatagaaatagggagatcactttggaggtcattgcaataatccagtgggagatatgatgacttggactagagaattagcaatggaggtgttaagatacaatcaggctctggatatagtgtgtaggtagatttaatagaaattgctgttgaattgaagaatagtttacgagagaaatgagtcaagggtggaagcttcattaactaagagagggtaaatggggataatttggtctagttttgtataaattatggggaaagtcttggtctcatagtttagcattccatagtacgttctccatagtgtataagtgataggttttactaatttaataatttttttgtctcaaacttgtgacttagactttgataaacttctgtttatgatagatggatttttaattgattttattgtttgtattttataatggattttaaggcatattagtgaaaacacaacttaaaatttattttcttaccttactaacattccaaaaaaggaacatatactgtataatgtttttttgtctcactaatatattcgtatccctcttcccccttcttggcaaacttgtctgaaagtatactgttgcatgttatgtcatggatgtaccggagcatgtgtgtaaaatacatgtcataaatggaagcagctggtttcctatgcagttaagagaagaaatgcatacagctgagctcttcaaacttcagaactcattggattcagtttctatcctgtgtaagcatgctatgatttcaaatagtacaaatgtataacaagttaccttaatagcttaaaaaattattttgtttcgatagttgaactactaaatctgttttattctctttccctctgccttcagtccctacttacctatcctacctcttgaaaagaacattacacctatagtcttagttttaaattcgaatctgaaaaggccttggcaagagttgggaaaaagttatcatctcaaagggaaaagctgaattcatacacaggaactgcaggattactctggcgttttactagtcccttgcagcactcgcaagtcccataaatacctaatggaaaaacagcagaaaatgagatctgcagcagccttttgagatcaaatttatgttgctgaacatttttttgaggttgagtgtaaaggtcaaaagaaagtgggtagattaaagttgctgatttttgcaaacttaaggccatttttaaaggtttctctttctgtagcaagaaaatttcaagataaatggctttgcttcattagctgaaatgtcatgtcttcctttaatatctgttacctgagacatttagtgatttagtggtatttatatacaacaaataaaaatctcaatccactttaacaaatctagataaatttatgaaattgcagatctttccaagaacagcatgatgataaattaatgtatatatacatgtttgtattgccatgtatatatgtatcttaaatgacatattttagatgtttttgtatgatacagaaggaaaagataataatcaaagttttgtatttttaaagtataggttattgatccagcagtgtaattataaccatctttttttaaaattatttcttatattaaactattacaatgaagataaatgacctcaaagaaaagatcgtgcatgtaatagcattaaaacaaaattcatggatgcttttaatggtctcttaccttttgaacaacattttaacacgttgttactggtgcaagcctatatctaagaaactgtgagttactagggtactgcagacttgatgcaatgaagaacaataaactgccatttctggacatctctatcctgagttgatagtacagaaagccaccacatatgttaacgtgaagttatagattatttatatctccagggcttgcttcgtgtctttgatttcgtagttcagattgcccagttattagtacttagaattcaaaagaataagataaaaaatttttacttaatacattcatttctgcatcacaataaagagttttcatggaaattatccagataatttcatagtagaataatatatgaaatgaaatcttttcttttttatggtagttgataattaatagtaaatctattcagtttatctctaagaagtcagattatgggagacttgtctctatttttctctatttaattttcccaaaaaaattcataaggaaaatattaattttcatttaaatctctatattaaacattaagtgatctttttatgccttggaatcacaatgaatataaatgttatttttattgtagttgattttgcagtttcaattcatttctattaaatattttaataaacatttttatgaaactaggtagaggtcacaaatctcattagtcactgacagccaattctcaaacccaggtcttttcctgtataccacatttcctcattagttctcactacactgtatggctatttccgcctcttaactttttatattttattacactcttaaagtacaactgtacttctcttctcaagtgcccttttctattcagtaagggtcccaggtgagcaatgattctgactggggaagagggagaagatggtgttgtagcaagtagtattaaaaggcccttaggaaggtagatagatgtataattttgtctctttcttctcactgttttcgtaaagacaaaggctatgccttaacttttttgccattcttatttttgagactacccattagggattgtttttgatgttgttgagatgaagtatttggtgaagccaaaacctccttgacttttatagttttaataagtttgtgctctccaaaccttcataaagtaatgtctagtgatcctttcagatatggcatgctgtcatgtcagctttaaataattgttaatggcatgatttttaacattttacctagttagaatcagtaaaatttattatatatactctttgctgatcagtagagcctcttatgaaggagtcagtatgatgtgctggatagagcattagatggcaaattgggcctcagatattattaggcatagttttgccactaatttgtataatgtgcaagtttaataacctttctgggcctacagttctcctcttctgaaatggaaagatgaataggttatctctaaagtctatccagatctaaagatctattttattatagaaaacttttaatcatacacacaaagatagaataaaaataaatggcattatgaatccctgtgtattcattacctgtcctcatatgttatcaatagtaaccccttagtatcttctaatacctagttcatattaaaatttcaattaaagtatctagtccatattaaaatatcatctcagtaataatagtttctagttgctttgttttgttcaaattataatctagacaaggggtgtgtgtgtatgtgcatgtgtgggtgtgtgtgtgtgagagagagagatctagttgtgtttttaagacttatggtcaaaaatacatatcataaaatttcccactttaggctgtacatggtggctcacacctgtaatcccagcactctgggagaccaaggcaggaggattgcttgagcccaggaatttgagaacagcctgagcaatgttgcaaaaccccatccctacaaaaaattatgaaaattagccgggcatgatagtgcgcacttgtagtctgagctactcgggaggctaaggtgagaaaatcacctgagcccaggagtttgatgctgcggtgaactgtgattgcaccactgcactccagcctgggtgatagagtgagcccttgtctcaaaagaaaaatattttttaaccttttaatttattttttagagatagggtctcactgtgtcacccagaactggagtgtagtagtgcatagcatagctcactgtaaccttgaactcctggggctcgagtgatcctcctacttcagcctccagagtagctaggactacaggcacacaccacctcacccagctcattttaaaaattttttgtagagctggggttttgccatgttgcccaggctgttctcaaactcctggcctcaagtgatcctcctatcttggcctcccaaaatgctgggattataggcataagccaccgtgcccagtctatcttaaccatttttaagtgtaaagtacagtaatgttaattgtatgcacattgtgtgcaatagatttcttgtacaaacaccttgcaaaacggaaactctgtagccattgaacagtaattcccctttgcccccttcatacagccccaggcaaccaccattccactctgattccgtgaatttgactattttagatatttcatgtaagtaggatcatggtttatggctggctttttatggctggcttatttcacttcccttaccatgatgtcctcaaggttcatccatcttgtagcatatgacaggatttccttctctcttttttttaggccaagtaatattccattttgtatatataccaccttttttttttttttttttgagatggagtcttgctgtgtcacccaggctggaatgcaatggcgcaatctgagctcactgcaacctctgcctcctggatttgagcaattctcctgcctcagcctccggagtagctgggactacaggtgcgcgcaaccacacctgactaatttttatatctttagtggagacagggtttcaccacattggccaggctggtctcgaactcctgacctcaggtgatccgccttccttggcctcccaaagttctaggattacaggtgtgagccaccgcgcccagccacattttctttatacattcatctgctgatggacatttagattgcttccacttctttgctattttgaataattctgcgatgaatatgggtgtgcaaatatctcatcaacatcttgttttcagatcttttggatatatttccagaagtgagattgctggcatttttaattttttgaggatacttcatagtgttttcatagtggctttgtcatctaacattgtcagcaatagtgcacaagcgtttcaatttctccacattctgtatcttctttgaaaaatatctattcaagccctttgacaatttttcatttggattctttcgggggtgaggtgttgtggagttccttatatattctgaatattgatcccttattggatatatggtttgtaactattttctctcacttcataagttgcctttttactctgttgtttcctttgctgtgcaatagtttgtaagtttggtagtcccatttgtcttatttttccttttgttgcccatgcttttggtgtcttatctaagaaattattaccaaattcattgctgtgaaacttttttctccagtgttttcttcttggagttgtgtagttttaggttttaaatttaattgtttaattcattttgagtttatttttatatacacaataaggtaagggtctaactttattcttttgcatgtggatatcctgtttttcccaccaccatttctcaaagaaactatcctgtatgcattatcagtactatactttttctttttttttttttttttgagatagattctcactctgttgcccaggctggagtgcagtggtatgatctctgctcactgcaagctccgcctcccaggttcacgccattctcctgcctcagcctcccaagtagctgggactacaagcacctgccaccacgcctggctaattttttcagtttttagtagagactgggtttcaccatgttagccaggatggtctcgatctcctgacctcgtgatccacctgcctcagcctcccaaagttctgggattacaggcttgagccaccatgcctggcctatcagtactatactgttttgattgctgttgctttgtgtaatatgttttgaaatcaggaactctgaggcctctatctttgtttttctttcttgagattgttatggtatttgggggcctttgcagttttatatgaattttagaatttttttctatatctgcaaaaaaatgtcattgggatttgtataggaattgcatgtgcaaaggaatctgtacattcctttcagtagtatggatattttaacagtattaagttccaatccatgaacacaggacgtcttttcatttattggtgtcttctttaatttctttcatcaatgttttgtggttttcaatgtaaaaatcttgtgcctccttggttactcataagtattttattcatttttaatgctattattaatatatttgttttcttaattttctttttgggttgttcattgttagtattttcaaacacaattaattgttttatgtttattttgtgtcctgcaactttgctgaatttatttattcctcctaataggtttttttgtatgtgcagtctctaggctttttatacatacaagattgtgttatctaaagaaataattctacttctctgtttccaacttgtatgcctcctatttcctctttcctttctttctttctttagctgactgctctggatacaacttccagcactactgtgttgggcctggtggtatgctcctgtagtcctacatacttggaaggctaaggcaggagaatcacgagttcaggagttcaaggttacagtgagctgtggtcataccactgcactccagtctgggtgatagagcaagatcccgtcggtaaaaaaaagtggcaaggggggcatccttgctttattcattgtctttgagggaaagctttctgttttttaccatcgagtattatattacccatcggcttttcatatacagtctttattgggttgaggtgatttcctctgtgccttttttttatttaattataaaaagatgttgaattttgccaaatagtttttctgcatcaatagagatgtcatctagttgtgatgtctgataagattcttctttctgtaagtcattttcctcccctccactccattttttagctttcctttggtttgtcagagaagccaggtcttacatttgtctcatataatgttctacaaggttcagtgcttccttttgtagtgttgttcctctatcacctaatttcctaataagacctagaaatgcattgtcgtctggtagctactagctacatgtggctctttacctgtacatttttaaaaattaaagtttaaaattttcagccattgtagccacttatcaagtgctcatatagccaaataggggtagtggctaccatattggatagtgaaaaggaacatttccatcatcgcagaaagtggtctcatataaagaactgatatgacagtgttttttccatactctattttgtctttttccacatgccagctatctcaacaccatttggggctatttttagatgtcataattttagccaatactaatgggtatttattgatatctcattgtggctattttttcatcaatagttttttgtttgttttggggggcagattttgtttgtttgttttcatttttttgagatagggtctcactctgccacccaggctggaagacagtgatgtgatcatggctcaccgcaaccttgaactactgggctcaggtgattctcccacttcaacctcctgagtagctgggactgcaggtgtgcaccaccatgcctaatataaatatatatatatacacacacatacatatacacacagacacacacacacacacacacacacatatagagagagagccactgtgcctggcctaaatagttttattttgaaataattttagatttatagaaatgttctaagatagtaaaaataagttccatgtactcttcacctagcttctcctaatattaacaccttaaataactgtaggatcttcatcaaagctaaattaacattggtacaataccattaactaaactacaggtttattttcccagtttcttaagtaatgtcctttttctgttccaggatctgttggaggatactacttgacatttcattgtcatgttgctctgtcttgccttctcttttgtggccttgacacttatgaagagtagaggtcagatagtttgtaggatatctttcaatttgagtttatctgttgtttccttgtaattagactgaaattatggggttttgagaataccaccactgaggtgattttgctttcccaatgtatcacatcaaggtgtacgtagtatcaatctgttactgttagtgtgaaccttgaacatcaagttaaggtggtgtccattgggtttctccattgtctatttgttcctttccatatacagttcattagaaatgaatcactaaatccaccccacacttgggggtgggggggtaaatacaaaatgaatagtgtttagaaacctcatagaggaaggatatagccaccacagtaattaataaatattagtggagagatattatgaaattatgcaaatattctagttttttaaagttttacccactgatttatagcatttattagtggatattgcctataccaattacaactatggtgttctaatggtgattttctatttccctcatttattctatatttaataattcaaattctttaaggaagatttgtctctttgcttccatttttaatattctttaatttttttttcgagatgggttctcactctatatctcaggttggagtgcagtggtgtgatcgtgactcactgctgcctcaaccttctgggctcaagtgatctacctgagtagctaggactataggcatgtgccaccacgcccaattaactaattctttttttaagaggcagggcctcactgtgttaccgagcctagtctcaaatgcctgaactcaagtgatcttccctcctcagcctcccaaagtgctgagatcacatgtgtgacccaccacacctactctgtattcgttttttacaaattcagtagtcttttcttttctttctttcttttcttttcctttattttctttctttctttttctctccccctttcctctcctttccttcccttcccttccctttctttcctttctttcctttctctcctttctccctcccctcccctcattctctctgtgtcatccaggctggagtgcagtggcgagatcatggctcgctgaaacctcagcatcctgggcttaattgatctcccaccttaggctcccatgtgtgtgggggtgtgtgtgtgtgtttgcatgtgtatgtagatggaatttcactgtgttgcccaggctggtcttgaaccttctaggctcaagcaatcctcacaactcgcccttccaaagtgctggaattacaggcctgagccactacacctggtttgtttccatttttcataaattctgcctggtgcggaggctcacgcctgtaatcccagcactttgggaggctgaggtaggcagatcatgaggtcaggagatcgagaccattctgaccaacatggtgaaaccccgtctctactaaaaatacaaaattaactgggcgtggtggcacgcacctgtaatcccagctacttgggaggctgaagcaggagaatcgcttgaacccgggaggcagaggtttcagtgagccgagttcacgccactgcactccagcttgacaacagagcaagactccatctcaaaaaaacaaaaaacaaagcaaacaaaaaaaaacaaaacaaaaaacccttaattgtcatttatatcaatagggctcatggatatttatttagttctttgggttataatctaaaactgtgtcacttttactactcaaattcgagatttaactattgagagctttgtcacattggcttctgtatcattgtgacagacctgtcatctttttattactttcttactttctggcactacaagatcatctagactttctgtaccccagcttgtttctccaaggatcactggttcactttatcaaagagaaggaccaggcatggtgactcaattctctaatcctaacactttgggatgctgagacagaaggatcacatgaggccaggagtttgagaccagcctggacaatgtagtaagacccccatctcttaaaaaaaaaaattagccaggcatagtgacatgtgcctgagacctagctacttgggaggtttaggcaggagaattgcatgagcccaggaggttgagcctgtgtgagccatgatcatgacactgcactccagcctaggtgacagagcaaggccctgtctctaaacagagaaagagagagaaagagagagcgaagagagaaagagagaaataaaagaagaaaagagagagagggagaaagagaaagaaaagaaagaagagaagagagaaaaaggagggagagggagggagggagggaaggtaggtgggaaggtgtttcaaaaccagcatctgagcactgttttctcgtaagctactggcagtaattgcttctaggttctctcagcagatagaattaggaaatatgcttatgtctgctaactcatgtatacatagacacacattgtatttaatcctgttacctatgtgtgtttataatatatataaaatcgtgagtttataatggtatctcttactctaattcagtaccacagagttcatgctagcatttccctttgacttattttaacttccttctctgatagtgagaaagctggctctgattatttgacatgtatttacttatttatgcaaacctagtatacatataaagtcgtttaaaaattgctggctgggtacagtggctcatgcctgtaatctcagcactttgggaggctgaggcgggcagatcacctgaagtcgggagttcgagagcagccttaccaacatggagaaactgcgtctctaacaaaaatacaaaattagccgggcgtagtgacacatgctgtaatcccagctactcgggaggctgaggcaagagaattgcttgaacctgggaggcagaggttgcagtgagtcaagatcgtgccactgcactccagcctgcgtaacaagagcaaaactccatctcaaaaaaaaaaaaaattgctgaatcatacctctgtgataaaccaatttaccagaatacaatgcttatatatagttctttttgtctttagcactatagtatgtaaaggaaatactgttggctacagttatttagggtcttttcattcccaccactttcagtaagtttatttcatacatatttaatacatttagactaatttatcacagtttgcattccatcttgggttcccttaacatcctaattgatatttttaaattagtatttgctgaaagaaacctaaaatattgctcctttacggtagttggtcccttccacctgccaaccatgggaaaagttaatctgtttttcatctctgtagtttggcattttctagaatgtcacatacatgaaattataaaatatgtagactagtggttctggcttttttttacttagcaaaattcatttaagattcattcttattgtgtgaatcaagtttgtgtttagtatgtaaaatatatagtttaaaccagatattttggggctgatttctgttattgtatggtatgctttctgtactatgaggattttttaatttgtttctatcttttgccatatcctcccactttggtttgtgtgtatgtttcttccaataatttgtgagacttgtatttttattcaagtgaccacatttagatctgtaacttcatgtaacatgattaagatttttttatttaaaaaaaggtcttttgagacatggtctcactttgttgcctaggctggagtacagtggcatgatctcagcttactgcagctgcaacttcccaggcacaagcgatcctcccacctcagcctcccgagtagctgggtttacgggtgcatgccaccaggactggctgttgttttacaatatgtttttagagatagggtttttccatgttgcccaggctggtctcaaactcctaggctcacgtgatctacctgccttagcctcccaaagtactgagattacagtagtgcaccactgcacctagccaagattttttaaaagataataagtattctttttcggggaattcttcattctcttttcctagaagatttttctttcccttagtgtttttaagaatacttagacctcaattacatgatttatcagcttttcaggatctccttgacccctggctataaaagatgaggaaatctttcttaccctcatagtctcacaccttccctctcccaattactctattttgtatatttgttcccgagatttataacatttatattgttctgtaaccaaacatattctcctccctcctgcaaatttttgatcttattcataacagttaaaaggcaataaacagaatcaatgtttatagctaagcctttcataatagtcattttatctcttggtttgctgaggtttgttctggtggtttcttcagaaagtcacatagaaactatatttcccaaattattttatgttctaaattttgtctcttcatttatacttacatggtagtttgaccagatacaaaattaactaggctatctttccttgaggaggtaatagacattgctcttttattatagggttttttggtttgtttgctttaatgagatagggtctcactttgttgtctatgctgatctccaactcctggcttcaaccaattctactgcctcagcctcccaaagcactgggattataggcattagccactatacccagcctatcttagaactgtatttatttatttctagagacagtgtttcattatcactcccaggctagagtgcagtggagccatcacagctcattgcagcctcaacctcctaggattaaatgatcctcctgcctcagcctcctgagtgtcagggactccaggcatgtgccaccacacctagctaatttttaaaaaaaattttcatagagatgagtgtcagtctgttgcccaggcttgtcttgaagtcctggccccaagcagtcctcccaccttggcctcccataatgctgggattaaagacatgagtgaccacacccagcaattctttaaatgatactttgaagaacctgagcacgcacatatatttcttccctctttgttagtaactctcagttccttatctagctttatttttctgtcacctggtgtatatattccttggattatttgtttgctgtcatctccatctatagaatgcaactatcaatagtaaagggatttggtctgatttgttctctgttgaattccaaatagcttgttagtgtttaatacttagcatatagctaatacacatttattgaattaataaggtcagaattcatgattctgccccattctccatccttataagtactttgatgggtttgattgcttacaaaaggattcgtttcacattttgaattcccgtgcctttactcagatatgtcttggtcttcactactgtgtgtcagtgttgtgctctttccaactatatttttctgtgctatttctagaaagttcttccacatgtatctttttttaaaaaatatttttttgagacagggtcttactctgtctcccaggctggagtgcagtggcatgatctctgcccactgcgacctctgcctcctggtctcaagtgatcctcccacctcaacttcccaagtagctggaaccacaggcacgtaccaccacacctatctagtttttgtattttttgtaaagacgtggtttcaccagttgcccaggctggtctcaacacccgggactaagcagagctcacctcggcctccaaaagtgctaggattacaggcatgacccatcgtgcccagcctcacatatctttatattaggattgcagcttctgttttctactattcccactggcctggtttatcattctctatctcttttagccactttgttttttgttggtttttttttttttttcattttttttctccctacccctctcttttagccactttgaattggtttgttttagtgtctctttgccatacagcagagaattttcttttgcttcctgaggcaatctgaatatactttcatgtcaataagctgctgatatatttggcctcaaacctgtcatgttattctataattactaaatatatatgtatactgtttttctgtgtgatttattatctctgctgtttttaaattttttattctggcattttggaaaggtttatatttcttttctagccattagcttttcttttaagtgtgctttttatggtggccttaatccccatttttcttataacattctactctccaatcagttttaaatgatatcctttgattctcacctattatctatacaacagtgattttattctgcatttttctctcacttctttgttttaaaattgtattacttctactttgtcagaatatgcagtgcttacaaactatgttctttccatcctttttaatttataattataattatcttattaaatgtaatgaggtttaccaacaacagtcctgtgtttgagttttcccccaatcatgcttggatgaagcttatcttctaatacatttctcaggaaaggcgtatgtgtacagtatcctctgtgttcttttttttctattactttatactttttcctacacaaagacagcttggctgcatataaaatccttgactttatttcttggaaataatgttctagttttgtcttgctttgtgttttgctcttgaagtctaaggcagcctaattttctttctttctttctttctttttttttttttttaaagagacagagtctcactctgtcacccaggctggagtgcagtgtggtatgatcatactttactacagccttgatctcctcagctcaaacaatcatccaaccacagcctcctgagtagctgggactacaggcatgtgccaccatacctggctaatttgttgttttttgttgtttatttgtttggttggttggttggttttgtttttgtttgttttttgtagagacagggatcctgctatgttgcccaggctgttctcaaactccaagcctcaaatgatcctcccacctcagcctcccaaagttttaggattataggcatgagccaccacacccagtccctagcctaattttcttattcttatttttctaatttcttactcttaattttatctttttgcctgtaggcctgaaaatactgtttcatcattaaggtctaataattttaccaggatgtgtcttagacctttcttgtttggggtcagtttttccaggtatgcaataataagctggaaatatagtttctagcttatagagtaatatggtagctcatgccttgcacatgcttttacaccagcagcacatcttttaaatgtgtagatttaaattttcatctatttctggaaagttttcttagactatattttaaatatactattccattgcgttattttttcctcaaggattctgtgtttatgttggatcttcttttcctgtcttccatttcatctactttctctctttgttatgtctttcttctctcattttcattcttttggttgtttgccttcattttttcagtgtacctttttagattttcactttattaatgtattcagcatggtgcactttgtaatttatttctgggattgttttttccttttattgcatttcttccctgattactttgtcctagtaatgttgaagacatggtcatatattgttttatttgtacttcttgtggcttattgagagaatacgaagataaatttggtttcagattattgccattatcctgaaatagattttgaactgtttttctgtgctactactttgttactctaatttaggaatgccatttatattatcttagattcacttttcctcttgttctgtccttttctcaccaatttattttattacctttgttagttcctatttcattttgcttgctttacacagtcctgacctccattttatttactatatttttatcagtgtttttttctccatttctttgatggttgcatttttctttcacactctcttgagcccagccagtttgtgtttcaccatctgttaatatgtttaattataacttctctatactttagtgtctctgcttaatagggataattgcttcatgaattttgtccatgcatttgcttataattgatgtgtgttccattactatatatttctgttaaatgtcttgtatgtgtcatttactttgctactttttttttcttctgtcctcatacaaattctgttctggttcctttttcatttctcatcttcgaatatggtattttcctacattagctattttacatgaggtttaattaaggaaggggttacacatgtatttcatactatgaagaattgtccatatgatgcacatatgccagttcaattaatggtcttaactcaggacaatacaaatagtacctattgtttcctaccactattcctaagcaccttatatcagattttcttttccttaacccttggagacatctagggaagattcatcgtagtttttagtcactttcagctgttaaggaaattgccctgcttttggttatttaaacaaattttaagtctgttgttaaaaatgtcagtcttaaactgtgtttgtattagtcctttcttgcactactatgaagaaatacctgagactgggtaatttataaagaaaagaagtttagttggtttatggttctgcaggctctacaggaaatgtggctggggaggcctcaggaaactttcaatcatggcagaaggggaagcaggcacatcttacatggctggagcagaaggaagtgagacaagggggagacgctacacactgttaaacaactatagctcattgaaaactcatgcactatcacaagaacagcaaggggaaaaatccaccctcatgatccaatcatctcccaccaggcctctcttgcaacattggggattacaatttgacatgcagcttgggtggggacacagaactaaaccatatcattctgcccctggcttctcccaaatctcatgtctttcctacagtgcaaaatagaatcatcccttcccaacagtcccccaagacttaactcatctcagcattaactcaaaagtccacaatctgaagtctaatcagagacaaggcaatctcttccacctctgagcctgtaaaatacagttagttacttccatgatacaatggagatacaggcattgggtaaatccctgttccaaaagggataaatcagccaaaagagaggggctacaggccccatgcaagtccgaaacccagcagggcagtcattaaatctttaaactccagaataatctttgactctatgtctcacattcaagccacactgatgcaacgagtaggctcccaagggcttgggcagttctgcgtctgttgctctgcagggctcagctcccatgtcagctctcaagggctggcgttgaatgcctgcagcttttccaggtgcatgatgcaagctgtcggtggacctaccattttgaggtctggaggacagtggccctcttctcaccattccaataggcagtttcccagtggggactctgtatgaggactccaaccccacatttctcctttgcattgccctagtagaggttctccatgagggttcacccctgcagcaaacttctgcctggacatcaggtgtttccatacgtcctccgaaatctaggcagaggctcccaagcctcatctcttgccctctgcatacccacaggctaaacactaggtagaagctgccaaggcttacagcttgcaccctctggagcagtggcctgagatgtatctggggctcttttttccatggctgggacgcagggagcagtatcaaggttgcacagggcagctggtccctgagcctggcctaggaaagcactcttcgcttttatgactctgggctggtgatgggaggggctgctgcaaatgtctctgaaataccttagcagcattttccccactgtctcggctattaacatttggctcatttttacttatgcaaatttctacagccaacttaaattcctgcccagaaaatttctcttttctaccacacggtcaggctgtacattttccaaactttccaaattctgtttcccttttaaatataagttccagtttcagatcatctctttgctcacatatatgagcatatgctgttagaagcagacaggatacatcttgaatgttttgctgcttagatatttcttctcccagataccataaatcatctctctcaagttcaaagttccacatttccctaaagaaggagcacaatgctgctagtctctttgctaaagcatagcaagagtgaccttcactccatttgccaagaagttcctcatctccatctgagacctcctcagtctggacttgactgtccatagcactatcagcatttaggttacaaccatttaacaagtctctaggaagttccaaacttacccgtatcttactatattcttatgagccctccaaactgtttcaacctctgtgtgttacactgttccaacgttgcttccacattttcagtcatctttatagccatgccccagtcgtaggtaccatttttccgtattagtttgttctcgtactgctataaagaactacctgagactgggtaccttagaaagaaaagaggtttaattggctcatagttccgcaggctctacaggacatatggcttgggaggcctcaggaaacttacaatcatggcagaaggggaagcaggcacatcttaaatggctggagcagaaggaagagagacaagagggaggtgctacacactgtttaacatccagatctcattgagaactcgctcattatcacaagaacagcaagagggatatctgccccactaggcccctcttctaacactggggattaaaataaacacgtgattcggatgggaacacaaatctaaacctatcagtgtttacattttttatttttattatttttattacaaagctcagctttccaatatactctgcttataaactgaaatttttaatattatttaaaatgtcaattctccctacagtgagccatagaatcaatgcctttccaaccaaaaaacaagatttttgtgaaactttaccatacatttctatggaaaagcaaaacggcaagaatattcaaactactcctgaagagggacaacaaagtgggatgtagcctaccatatatctgaacattctgtgatttttgtaatatagcagttcgctattaggacagtggtagaccagtgtaatgggacagagaggacagagacagatgccttcatttccataaggaaatggttgattattcaataaatggtgctgcgataattattttttcataacaaaaaagtgaaatcaaatttctgttttatactatacacaaaaatcaatttcaggtgaattatagatctaaatatgaaggtaaaatgacagagcttttggaaggtaacttttgagaatatctgtatgatctcggggtgtggaaaaatttcttaagcaggacacaaaagcataaaggcaaagactaataagttgtaccacattaaaattaagagcctttgtttatcaataggtacctttaaaagattaaaaggcaagccactgagtaggagaagacatgtgtgacacaaataacccagaaagaattaatatccataatatattttcaaaattttagtaatcaatatggaaaagacaacacagaagaaaaatagtcaaaagataccaacaggaaatttaccttagaagaaaatcacatgtgtattgaaggaatgaaaaattgttctacctcatcattaattagggaaatgcattagccgggcatggtggcacatgcctgtattcccagcaattcaggaggctgagacgggagtattgcttgagcccaggatgtcaaggttgcagtgtggtatgatcttaccactgcactccagcctgggtgacagagtgagaccctgtctcaaaataaataaataaataaataaataaataaataaataaataaataatcctttgaaaaataagggaaattcaaatgtaatccacaatgaggtatcattttataccagttgataaaaattttaaagtctaaaaatttcaaatgctgcataaaattagaattactgactcttacacacttgaagatacaaattccctactatccccagaaaatgttattgcttttagacactaattatatccaatatctagaacttagtctaataaactatgaacaaggcctctaccaagaacacttaaaacataattgtgagaacttaaaatgtaaatggaggtgtgttttaaagatgtttatttattagaagactcaatactgtaaagatgcaatatttgtccattttagtctgtaatttcaatgcaattctgattaaaatcctaacaagtaggggtgtatatgagtgtaaattgacaaactcatttttatatgtttttggaaagtcaaaggataataatagccaagaccatcttcaagacaaataagatgggagaatttactggtgatatggttaggctttttctcccatatccccaaatctcatcttgaattgtaatccctataatccccacgtgtcaaaggagagacctggtgggaggtgattggatcatgggggcggtatccttcaggctggtctcatgatagtaagtgagttctcatgagatctgatgatattataagtgtagttgtcttttccacacttgcacgctctctctctctctcgcctgccaccatgtaagacgtgtgtcttccccttctgccataattgtaagtttcctgaggtcactctagccatgtggaactgtgaatcaattaactcttttttctttagaaaatacccagtcttgggcagtactttataaccgtgtgagaacagactaatacaactggatattgagtcatcttataaagttaaaataataagacattgtgacattggtgcagtgataaataatggaacagaataggaaacccaaaaacacaccaacaggtatagttttccattttgattgttcctttcattagatgtttaaaactttataatgaatatgtacttttagtcaaaatttatttacttgagaagcaaagtgatgtatggattatggcctctgaggctataatgtgagtttgacccaaataatgatccaaatgtgagttccagtcccagttttgtcctatactactagctgtttgagcgtattcaactggtctgtggttcttagtttttttatctttaacacaagataataaaattacctctcagaattatggtgagaatttgacataacaagtataatcctgctggcacatgctgttcccttgatgaggggaatttgttattatgtttcttaggaacacaaaacttctgtttattcttggtaagaattcatgtttcccagatctatgtgtactatttgttatatttaaggttatcaaattgtatccttggtaatggttgccactggatcttttttggaatatgtacaactccttattcaaagtggctttctaatcatgattagttttttgtagttttggaagagccatattactgccctgcattcataaagcagtcttgtaaacactgattatgatagtgttttgaaaaattaaaagcctccaaaatcactaatttttaaaaaataatgcagttaaatatagaaaaggattagccatagatattttgtagttaaccctattatcattaacctaagtgaatagaacctaatttttgtacttgctaataattgctattaagaattttgttaatcgtgtgtggattggtgcttgagttcagaatgaatgattgataggggacaactctaagaaatacagcacttacattaatgttttattaaacagaaaaagctttaatgttttattaaacagattttaagagttacagtcttaaaatctttattatttattttatgaaatatttcattttgttttttttctgggcactttaaaattgagatgaggatggtagaatttgccagtttattttttggctattttttttttaacccatcttattttgagaacgaatttagtaatatttttctcaacatcctgaaattgtgtaacctgtagaaacttcccactgtctttttaaacttattcttaaataccacatttaatataggataaataagtcacaaagcttgcttatcaaaacagaatattgtattcagctttccatcggagcttttggggaagacatcacagtattgtactgtctcccaagatgcaaagtatcaggctttaaataatgaaaataagggaaatgccaatagaaaattagaaaaaatgttagaacagttaaaaacagcatactgaagcctgcattatttggcttatctaaaaatcatatgttttcaaccaatcagtacttatagtcattctatttaatcttttaagaaggagacataatccaccctcaccaagtgattcagtgtagcatcctaactaataatgacttaatgtgtgtccaaatggcatgtaatgagaagtatgaaacattgtctgtatactttcttgcctaagatacttaactgagtctaatcataaagttcagacatatcttcactgtggaacatttctacaagacaacggcctggactcttcaaaaatgccactgtcatgaaagacagtaaggagaatggaaggagactttcagattaagggagactaaagagacttaagcaaatgtagtattagatccttgactatatattagataatactacatcactgccacattttgtgcttatataggaaaatctccttggtcagtatgtatcataatagggtcataatgtctgcaacttattttccagtggtttgaggggaaaaaagacgtgtgtgtgtgtgtgtgtgtgtgtgtgtgtgtaaagaatatgttctaattgatacatatacgtaaatagcataggagtgttcatttgtactactctcaattttttctataggcttggtttcaagatgaaatttgaaaaaccttaagggaaaatatgtttaaagtatgataataacaaattagcacactagataaactttttatagcttttgtgagtttttttccttcagaaaatcatatttatgtagatagcaggattaaagaaaacttttctaaatttcagatgtcagaaatggagacatctaaattgtttttccatttcatctctaaatgctaatgaaaactggacttttacgacattaaagacatttaattgatctctgtgggatttcatgtttagcttttttcaacagctatatattgaacatttaggtgatgagattgagtagctaatcttagaggcgctctattgagattgtccagattccaaccctgatcccacaacttaccacctttgtgatcttggacaagtaatttgagatatctgtgcctcattctcctcaaatattcaacaggataataataatacataccagtttcttaggattgtagtaatgcttaaatgaattaatatatttggagcacttaggaaagagccaagtacatagtaattttctaaaaattatacctacttattatgtggatctttgctgaggaaatatgagtaagcatacaagactggacaggctttgagtagtgaagatgttttactcacaagcaaggtaattatgccttttatattaaaagaaagttcatatggaacactctgcttatatgcttcatcttcttttcaatcagataataagttctccaatgtagaagggaaatgtcagcctcacacataaaaatatacctgtcagagattatataagtgtcaaaataatactatctagagaaattcaggacatttggataaataaaggaatgtcatgtagtttggatagaacatagagaagtgaggaaaggagacattcccagatagaataacagctcaatgacttgaacaaggatacagatgcatgtagtatacacagtggactagaccatttatgtgtgtatgtacatatgtgaaaaaaagtctttgaaatgtttgcatttcaattaaattctgattttaagaacttattttccccctgtatcctgtgtgtgctagcattctgtttcctaaggcattctttcagacagacatacctagtcctgaaaatgctgctattattgttccagatacaaagcaggatgtcataattttttttttttactattccaactggaataatatggctcaacttaagttctgtacaaaactacttaatgataactcacaaaattaaaccaatttatattttctgcagttaaaatagaatgcacagatttttaaagacctaggacacattattatatctagttcctgaaatcattaaatgtccatggggaagaaaaaaacttgtgtaagtaggaataatataattggatttgcaatgctctcttaagagattctttaaaatcatgtgaaataagtagagtttctatgattttttaaaaatcacaaatagcatatatccgttttatctttaatagtgtttgagcccatcatttgaaagcattggagcatgtaaccaatatttctgaaaatgaaccatggttccagtcataatctatatgctttaaaattccttccctttattctttcttcccaaatccatgacatctgaatttcaataaggaagaaaataagcatgtttttaaaatgttttagaaaagattttcaaaattagattaaaatgtttgaggaaataaaaacttctttatgtattcattgtgatactgatttttatcaatgtctttttgtaaaaatacctatatactaactttgaataggtccaacatatggtaatgtgttatgcaattaatgataatgtagaacgatgttaaacccacagaatattgccaaggatttaccaacaaccaaaaatgtaattatatagaagaaaagtgtagttacaaatgcagtcttttgtctttttacattctctatatgtagagggtaacagaaatactgtatcactttttagtatatgttctcccagaataagttgccacaattagaacagagtttaggagcctatattaagctttactagttatggttatttccatagtgctagtaaataagagaaaaaaactttttgaacccatgtctcattgtaggtctcctaaaggaaagtggcccaaagtccaaatacttcaataccgttcgtctctgcctgataacaaagtgttttgtttttgtttttaccctcggacaagccagtcagctgatctttgtcctaatttgttcctggtagaattgaacaagatgtttgcagaagcttcctctagtttgaaaattgtattgattttttttccccatagtaactcacagatggcttctcaggttggaaataatggtgtccatgtttaggtaccacgtgttagatcagatttgtactcatggatctgtgattattttaactttttcttgttatttataaaaataattatgtacttctctctggggtttaatgtgtctttttattctcaaaaaatgtagtacattgatcagccacctaaaatactagccctatagaattctaatagttaggttttatatacagccatttgtcgattaaatattaaataccggatcagcttaaaatggacacacaaaaaaacactaccacataagctatacagtgccttttttcacagtgtcttataggtggaagatactcagtgagtgtttgttgagtgaataaaggatcttcacttggtgcatcccatttccttacaatttattattttttattttactttactttgagtcaggatctcactaggttgcccaagctggacttgaacttttagatccaagcaatcctcctgcgtcagcctctcaagcagctgggactacagggatatgtcactatgttcggctttaatttttattttattatgaaagttttcaagtagcaaaagcgatgtaatgaaccccatctacccattactgagattcaataattactaagattttgccacacttgctttatctagtctttaaagaaatttctccactgaatgatttactttaaaatacttgacctcctggccttttactctgtattttaaagaaagctgtagtaatttgtgacataaaccaatagagagcagctaaattttgttatatcttcatagcaattgactatattttggtttgtcttaccaataatttgatgaatgacctttcattttcaatttatctttggtaactaagtagataagtgggagtgtaggtttacttatttaaattctttgaatttgtgtgtgtgtgttgctttcccccccgatagaaactataaatggtagtgttattgtggttaggagtatggggctatggagttggggaaaacatgtatgaatctcagttctactactttaccttttgaatgtgggcaagacaagtctcagagttgttttagtttttttaattttaactttgaaataattgtagaaaaatagcaaaactagtttaatgaattcccatatgttaatatttaccacagctattgtatgtatgtatgtagagtttttttcctgagtcgtttgagagtaagttgcaaaaataatgcctctttaacctctaaatacttgaggtgtggttagtaaaaattcacgttttgttacataaccacagtatatttatccaaaacaggaaattaacatggataaagtattactgtcttatctagagatcttattcaaattttttcagttataccactaatacccttcatggcaaaagaaaaattattttattcttaggttgaatccaagatcacatgttacatttagttgtcatctctagaaactgctggtagtcctagctatttgggaggctgaggagggaggatcacttgagcccaagagttcgagtctgacctgggcaacataataagactctgtctcttaaaaaaaagaaagaaaagaaaagagacagaagaagaaaacagaataagctcatggactgttataaaggcaataaatgtgacataaaggatgctaaccaaaacagataaatagtaaaaggttaaataacagaggacttagctatttgcaagtactgacaaattttcatgattgggcaatgaatgatgtgacgttaacacatctgactttatctttcatgactttgatatttttgaaaagtataggctgcttattttgtagaatgtaccttaagttttttttatgtttccttatgattagatttaggttatgccttttcataaaatactatggatatgacctatccttcatgtaccatattaggaggtacatgatacctgttttatcctattgctgatgatgttaccctttgatcataacattatattttcaaatttctctaccataaagttaccattttccttttgtaatggatctcttgtgggaagatactctgagagtacctaactatcctatttctcattacatgttcacatgctagttttgacatccattcttcctagagacagttattactatggagattgccaaataatgatttgtttttcattccatcattttttctgcatttgttagttggctttcagcttcaatttttatatctgtaaaatgaacctaattgatgtaaaattggttaataacacccaaatcatgtagggtataagataatgcattttattttattttattttactttactgagacagagtctcagtctgtcacccaggctggagtgcagtgagtgacatgattatggctcattgcagccttgaactcctgggatcaagtgatcctcccacctcaggcctccctagtagttgagaccacaggtgtgcaccaacacacccagcatgtatgtgtgtgtgtgtgtatatacatatatatgtatatccacacatacatacatacacacatctttacatatatagacctcatctatatatatatatatatctcatctatatagaagagatatatatagagagatatatagatatagagagagatatagatatatagatatagatatagatatagatagacatagatatatatctcatctgtatatatatagatgaggtctccatatgttgcccaggttggtctcgaaatcctgggctcaagtgatccacccacctcagcctcccaaataatacattgatttgggacaattcttagcacataactctttaaaatattagatattataatttttattatgctagtatctacttttcagttgaagaaatagatcattttaaagatctttgaaaggtcataggaaatgttaaaaatatcaggtattttatgtgtacctaccatgaatgttttacctcatctttggtaaggtcagaagtgagatgatgtaacagccatcatatgtatgtgtattttttttattgacctgagacagtttttggttatttaatgcagaaaatatatttgcagtgtacttcatatgatatgcagtactttaaatacttgttgtaatgtggtcatttaataggagagaaacttagagacatggtaaattaagttttgatttagtatactgaatgatgaaatagaattatttatggtcattttaattctttaaaagtttttaaattagtattttaaaataatatatgtacacagtttactgattttgtccttaagggtatactgtggaaaagagcaataccctgccctgtactttgacagcccttttagctatttcttcttttacctacctccatatttttaatcacctcacctatccaggttagatattatgtacttaccaacttcctactatgataagataaatatttgtctctcttatatacatacattctgtcctctcctcctctccagttctccagtagagtttttgataaatcagttttcagcataaataatattatacagatgtatgtattatttatttctgagacaaattatattctatggtgttttacaacttttagtttctcctagagtttagaattcccttatctttttgtttccttaggtttctttatacctgtggtgacttccatacacatatcttccaatagcttctcacatttattttgtgcatagttaaaaatgtgagttttaatttgtaaaggtaattataaatcatgtgctctgaaagctttgtttttcttatttttttctttctctctctttttttgtttttgagatatagtctcactctgttgcccaggctggagtgcagtggcatgatctcagctcactgcaacctctgcctcccgggctcaagcgattctcctgcctcagcctcccaaatagctaggattacaggggtgagccaccacacccggccaagttcttttgatggctcacatccttcattaactttctgagaaaaaatacaagggagataaatattttgagaaccaaagtgtctcaaagtatctctgtttactcactctggattaatatatgggctccatgtggaattctagtgagaaaatttattttctttagactcttgaaaccattgctctattatattctaaacttacatattgtttttgagaggtctggttcttttttttcctaagcctttatatatgatctgccttttctctagaagcatttatgatctgtctctggttttctaaagtttcatgataaataataatgatgtagatctcttcattaattcattatattaatacattattccctataaatttagacaataagtcagttctgtgaatttttaaatgaaattttacttcctgggttgatcctctatttttcattttttctttctttttgatttttttttccttttttttctctttcattgaagttgagctttttgcatactcttctcaagtgtctggtaatgctggtagtgcatttatatttaagagtgatgcactagacaatgtacaaaatgagacctttcaacttccttagggtatttgagtaaaagacagctttttcataggggaagtaatttacatgcaccttctccagggctatttaatttctccaaggaaaaatggattctctaattttctttttgggtgaacttaagcctaagtactggtcaggaaaagggtcagaagggctatttggtatgtaagtgttcacataaccagcccagcctgttcttagttcagcacttcacccatttccctatcttcctttgtgcttggagttcctgagtctgaagcctttccagttctttcctagcctaccttccctccattattctgcagaggtaggaaaaggacacttgtcaggctatatgaggtgggaatggggtctgaaagttctgctgttaattatctccctattttcagctctactagttacctggtaccaccattttctgaattttccaaggtttggagggtgaatcagcttgatttttgttggaatctcctcttagtaggcttttatactttagctttcttccccctgctaatctaattaccttttctccatatactgtctgacctcagaaattgtaatccaggattatcagtatcttctagtttttttactaatatggttagttgtaatttttcattattgtcttgagatgatttttgataggagaatgtgcagaaatgtttatattttggcatcagaaatatcacctttggagggggcgagggggtcttacctaggctggagtgcagtaatgcagtcacagctcacttcagcctctacctcctgggctcaagcaatcctcctgcctcagcctttcaagtaacttggactacaggcatgtgccactgctatggttttgctctgtgtccccacccaaatctcaccttgaattgtaataatctccacatgtcaagggtgggaccaggtggaggtaattgaatcatgggggtggtttcctccatgctgttctcatgataattaatgaatctcacaagatcagatggtttaataagcatctggcatttccgctgcttgcattcattctctctcctgccaccttgtgaagaggtaccttccgccatgattgtaagtttcctgaggcttccagccatgctgaaccatgagttgattaaacttcttttctttataaattacccagtctcaggtattccttcacagcagtgtgagaatggacgaatacagccaccatgccacactatgtttttaatttttttgtagacacagaatcttgctgtgttgcccaggctggtctcaaactccttggctcaagtgatcctcttgcttccacctcccatagtgctaggattataggcgtgaaccaccatgcctagccagaaatactatcttaaaatcaactctgcataattcactgacccatcattaaaatttgtcagtacttaaaaatagctaagtcctctattattttatttaaccttttactgtgtagtttatttgttttggttggtatcatttaagcctcatttattgcctttacagcagtccaaacagaacctattctgttttctttctcctcctctctcattttttttctcttttttaagagacagagtcttacagtgttgcccaggttggactcaaatgcttgggctaaagtgatcctccctgctcagcctcccaagtagcagagactacagggactacgggcgccaccttgcctagctccccctctctcttatcttctttaccctagttaaattatttctgctttgtcccaaaaaataatatttgtacattactctccacatggctttatggtggagtaagggtgatgcttgagtgtaagaagttttacactgggatgtggtacttttccttttttcacttatagttgttttgaagtttgggcattctttttgtcttcaaattgtgctgaaggcatggtgtttttgtagatttatttttctgtccttgttctatattcttttggagagaaacagggcttaggtggcaaccattgcttcagctgtctggaattcctcaatttattttaactttatataccatcttttctcccacctctctcttcattataagcagactcattcattcacagtatgtttagtgagtgctatgtgccaggcatggttctagggatatggtaatgaacaaatgtctttgccctcataaatattatattctggtggtagagacaaagaataaaacaaaaaagtgaatatatactataatgttaggtagtgattaatgctatgttttaaaaaaataaacaagatgagtgcagtggtacactcctgtagtcccagctgcttgggaggcagagacaggatggtcacttgagcccaggagtttgagtagccactgcacgtcagcctgagcaataaaacaagactgtgtctctaaaagtatagatatatcaatcaagaacctggggaagttctagtgctacctacaagagttgaggaagaccttttcttttttttttttcttttttttgagacggagtctcactctgtcacccaggccggagtgcaatggcccgatctcggctcactgcaagctccgcctcccgggttcatgccattctcctgcctcagcctccccagtagctgggactacaggcacctgccaccacgcccggctaattttttgtatttttagtagggatgggatttcaccgtgttagccaggatggtgttgatctcctgacctcatgatccacttgcctcagcctcccaaagtgctggaattacaggcatgagccactgcgcctggccaaggaagacctctttgaaaaagtgttacattagcaaattttgttttgttatagaatagtaagtacatctttttatattagcatttaccttatgtaaatcattaagattttaccactgatcaggtttccatgataaattgtttaattttaaaacttctgtagtagaatgggcatgtggtgttatggaattcataccaaataagaagaattttacagaaagtaaaaccataagctgtctactattcaactcttctcattctgctttagagaactgctattgataaaagattatttgagaaacatataatctatccttttctctaataactctacactttattttttatttttattatactttaagttttagggtacatgtgcacaacgtgcaggttagttacatatgtatacatgtgccatattggtgtgctgcacccattaacttgtcatttaacattaggtttatctcctaatgctatccctctccccttcccccagcccacaacaggccttgtgtgtgttgttccccttcctgtgtccatgtgttctcattgttcaattcccacctatgagtgagaacatgtacactattcacaatagcaaagacttggaaccaacccaaatgtccaacaatgatagactggattaagaaaatgtggcacatatacaccatggaatactatgcagccataaaaaatgatgtgttcatgtcctttgtagggacatggatgaagctggaaaccatcattctcagtaaactatcacaaggacaaaaaactctacattttatgcttggactatcagaaaaactgtttacttgaaaacagtttacagaaaaactctttaccctgacatgtattgatttgttgctttgtgttttttgagacagggtcccactctgtcacccaggctggattgcagtggtatgatcatagctcactgcaacctcaaactctggggctcaagcaatcctcctacctcagcctccctagtagttgggactacaggcgtgtgccatcacacctggctaaattctgagttgttttttatattgaagccttaatctttcattgaggaataccacaataaacagactgagcttgctgttgagaagttgttgaggacaacatagtcttctgtattaatgtttaacatattaaagaccctatgaaaagtttattttagaatcacgtgtttcttataagaaagtgacatttttggccgggcacaatggctcacgcctgtaatcccagcactttgggaggccgaggcgggtggatcacgaggtcaggagatcgagaccatcctggctgaagcggtgaaaccccatctctactaaaaatacaaaaaattagccaggcgtggtggcgggcgcctgtagtcccagctgctcaggaggctgaggcaggagaatggcgtgaacccgggaggcggagcttgcagtgagcagagatcgcgccactgcactccagcctgggcgacagagcgagactccatctcaaaaaaaaaaaagtgacatttttatctcttcaagcatgaaaagtagataactaggcatgtcttactttttgctttcactgtcaagaaattggaaacaaattcagagctaattcaagacgcctctgccatgtatttctttttctccccaatcttatactgttctgttttctctgatcattttttttaggttgtctcactaattatggaacaatggcagggatgtgtatgaaagagtgagcaggtagataagtcaatagatgaatgctgttgcctcctcaaatcattagttgtatgagcttgggtgagttaaacaacctttctgcactgttaatttcatctgcaaaatgagaggattaatagatcaaatatttgtagctgcagaactctgttttcatgggaaataatttggaagcccgaaatagaagccaagtagtagcagaactgttgtgtcaggccagtgccatagtggccgggaaactaagcctcattttttatccagatcatattagaactgcctcttggaacaaagaaacactacctctagtgtttctgcaatacagtgttctgtattacagccttgactactctactttttcccccactccagtcaagttttacattttgtagtaggcctcctttttgccatcttcgtgaagattctgaattttcctggatggataaaaatcataaggataataaatggatatttcagtgtttttttagtcagtggtttgcaaaaccacctggagggcttgggaaaacacaggttgctgtgtcctacccacacaggtttctgattcagtaagtctggggtatgaccaagatattgcattttgagcaactttccgagtgattcagaaattatactttgagaactactatcctatgtgagtattaaaaatgtattttagtcacttttcttattttaaaaattacatcaaatcatataacttcataaagctcagaaaacaatgtctgagtaatatatggtttttgaaaaataacatttaagtgacatattccgatgtcatggagcaagtgagaaactggtttgaaatgtttgctatctagtgtcaagggctatctatccctttttgacttcttgtgctactggtgcaaatggatagatattaatcctgcagcaatcaggatttgcttcagcaataaagaaattattgatgtctgaaagcaatcctttccttttgacatgttggcagcacctaagaagaaaatgtcagggtcaatataagtgcatttactgacagtttggctctttcctatgttacagaaaatgatttcacatttagcttttatcaaaaacagaaacactgaccactctgaaggatataaacaatagctttcagcttagtcattttccacttataaagtgatactttcatagaaataaacaatgcaaacttcagagagccaaaacaattacacagaaaaaaatcattgcatttttgccatttttaactcagatttaaaacaactgtgtctggtagtaactggagaaaaatcactgttttgtgttctgttaagttaaaacagttaaaatcactttatgataaaatatggccaaaaagaagaatcatcttcaattaggtacttcaagatcacttgtattctctgcttctctttcagagcctgatccatgtatttcttaaacttcttcatcatatataaaatttcgtgtttataaaatttccactaaaacctcaattattagtttcatgaatcagaagttacaattagtttcatttctggctcaccaagatttgtcaatttctggataaaagggactccctattcagaatatccctttaaatcttttttaaaagtgcacctttgatgtgtacatgtttttatgttatttatggcttctgaaaatattatgcaaaaaaattgttatggaaacaacccaaatgtccacaagcaggaagatacattgtgatagatccatacaatggaatatcattcgttcataaaaaagaataaagtactgatgcatgatagaatgtgagtgaacctcaatatcaagaaaatggacgaagccagacataaaggatcacatattgtatgattccatttatatgaagtatccataataggtaaatccacagaaacaaaagcagattggtagttgccagggacttgtggggagtgaggaatggggaataactttttaatgggaagatagggtttcttcttggggtgctaaaaatgttgagaagtagatagaggtcatggttgcacaacactgtgaatataattttatgtgaattttacctcaattttttaaagaaatcagttgatttaagacttaactgaattctagaatttttgaaatgaaggtgtttctcaaggtcatccaacccaatctcctgtttttcacaaatgaaaaaactaaaactcatcaagattaaatactatatatcactaagattgcctagtagctagtccaaacccaggccagaatttgagtatctggatttttagcccagtgatttctttttaaactactgcatgctgctttattatcaattgctattttttttaaatttttttctgggaacatactacaagtgttagtttaaaagtaaactaacataaaagtaaatacaaaaagaagcatagcttcctttgtgccacatataagaaatgtagacatagagagtgtttattgcagtaatttgccaaaaagcaagccatagtttaaattagaagaggtttattccctgcagcactttcacaatcacagaaggcacctatattttaaatgtagtctacattggcctggcttatgaactgcaaccttctatgattgcaattcacttttttaaattaaaaaaaatttcaaaataatttttgcataattattagcacattctaccacttgataattttttgtttctttcaatagacgaaagcactcacattgtaaaaaaattatataaatgaccttgtcttgtgatgaagctagaagatctgttttcaacgaaactattctcagaggcatctagggagaaacatttgagtcaggttgggagttagagatagaaagcagcagcaattaaagcaagataatgtattaccccctggaaattgggtgttatactcaaatgtaaaggacttgtattgatttagtgctagcctcagaaaatagtcagatgtcctcattttaagggaaaactttaggaaatgtaattatatcgtttctttctctctaaatctgccttagttttcaatttctttatgtagttcgttactaagaggaagctacactctcattaccacactaaatggattttctattaatatttatctccaatgttatttttatctgggttgttgttttcatttctacttagtatgtattttcttctttccttttagttcagaggtcaacaaagtatggcctatgagccatacgctacaatagcagagttgagtggttgcaacagataccatgtggcctgcaaacctaaaatatttattggggcattttacagaaaacacttgccagtccttgctttagttgaccaagtagaaaaggaagagcagattctacagagtgaataaatatcaccagcaaaggaaaggatatagaaaggtacaggatttatacttaggctagctagaaactccatatggtcaaagtaagagttttgtggatgtgagtcatcagagattatataggaaagatagattactgtcagatttagaggatttttaatgccacttcaggaacttgagctactattgtttaggaaatgagtcatttaaggttttttgaacaaaggagctttgccagagcaggaaagtgttgcagtagggtttacaaagtaatgagagttatcaactaaagttatattaataggaaggatgacatagttccaggagttgctgtataattaaaattgataggaccttagacactgcattttgagacaaagagataatagtttaaagattaaaacttcattgggcagaaaaattattatttatacacatattagggaagtaaagagctaatttttgtggaaggtttaagttgatggagaaggattataacactacataggataagaaacaaaactgattactagttatcagcattactgaagttgttcactcatcccaggcacaggcaattttttactcgccatattttatctccagggcacccagctgccatcatcttgtcagggtccatctctttataaaatcctcttactttgctctccagaatcccaccctgatacacagatttacttacgctacctcatacagaataaagtacttccattttccaagtactctgaaccatgctcaagaagggctttagctctctcaaataaaaagacttatctcaaggtgtttaattcaagtagagccacagttccgaaactgtgcactgacaccccagggtactgcagcagactcacaagagtgctacaggatattttatatcggtttcaaaattaaattttgctacattccttttggatgatgtctttttaaaaaataattactgttgttgttttttttttaatatgtacctcctgaaaaatcaatgcagaatgggaaatgaaggtagcagtatccacttggaatacaaggcttgaagagtgtgcagtattccataagcatacatattcatttagtaaatacagttaacccttgaacagtgccgggggttagaggcactcccctcccccgggtagttgaaaatccatgtataacttttgactccccagaaactttactaagagcctactgttgaccagaagccttacctgtaacattaatcattgatgaacatgtattttgtatattatatgtattatacagtgtatttttgtaacacagtaagctagagaaaagaaaatcataaggaaaatatattcattgatatggtttggctctgcttccccactcaaatctcatctcgaattttaatccccataatctccacatgttaagggagggacctgttaggaggtcattagatcatgggggccatttcccccatgctgttcttgtgatagtgagttctcgtggaacctgttagttttataagtgtttgacagttcctctctcatgtgccctctctcgcctgctgccatgtatgacatgcctgcttccccttctgccatgattgtgtttcctgaggcctccccagccatgcagaactgtgagtcaattaaacctcttttctttataaattagtcagtcttgggcagttctttataggagtgtgaaaacggactaatacatttattgttcattaagtggaggtggatcatcataaacatcttcatcctagtagtcttcacactgagcaggctgaagaggagggtggggaagagctggtcttcctgtctcaggggtagcaggggtggaaatgatgaaggaggtggaaaggatggcagaagaggtaggcatactcagtgtaactttacagaaatacgttgtaatttctgtcttatttttcatttccctaaaaatgttactctaaaaatgtttctatatggcacctatccttccaccttttgcttttggttcagtgcccatatcatagaagggtccatgttgtaaaagaagtcaaaagcagtcttttgaataactggaatcattctgttatatggtctaatatgaatttgtttctggcactacttattctacatcttctttctcatcatctggcactgatttggaagcactcatctccatcaagtcatcttctgttaattcctgtgatatggtgtctgttagctcttgaattactccaagatccgtatcttgaaactcttcaacttccccccacttttttttttttttttttgccatatccacagtctcttttatgatatccttgattgactctgttgtaaatcctatgaagtcatatacaccattggacacagtttttctctagcatcaatttatttttttgggcttgatggctttcatggctacttttgtaacaatggcgttttccatgatttgattctttcagatatccttggtgttctctaagttgaggtctacttccatagcattgacaatcttttctatagattaccatgtgtaatgatctttaaaggtccttatgaccccctaatctagatctgaattagagatattgtgtttgatggcaagtagaccactttgacacctttgttgttgaactcctggtgtgggtgacccggggcattgttcaatatctaaagaaatttaaaagacagttccttactgacaaggtacttctttgtcagcagaagttacttctcctcttatccattttttgaagccaaacctctttctaaaaatgtcaagccatcctttgctgacattaaattctccagctttaaatccttcaccttccttttgctttaagttgtcatataatgacttcaagtcttactagagtatgcctttcttatagcaattctgtactcacattgtattttaaatataagataaaaagatattttacagaaacttcaaggttttcatgcctgctgtcgtagctgcagtgatggctccacaaagtcctcccccaaccacaatggtccttacactggattcatctatcttgaaatggtgggcaaccacagctgcagacctcaatctacggtacatatcaagcaagtcagcttttttttgtaatgatttttctctgcttcttgggagcacttccagcatcactagtgacatttcatatgggtcccatggtgatgttcaagatttacagtattgcactaaacatgatgaaaaataattcaagaaccatgagagatcactttttattgcaatatgcaatttactgtaagatgtagggttcactcagagatgattagcatcagatgtcattttcaatggatacaacacttgagctcactgcaaaagcaacaggtggtagttacaacgttgttacaatagtacagtatttactgcagttcattttatgcagttaggatttaatactgaatttttacatttgtttacatttctcttgactcaaatgctgccgtgtatggtctgtaagtgtttgcctgtgtaagttttgatagattttaactttttataatacatttttatagttttatgatagtgataaaatagtatctacatatactttatgagttcatgacatacttaacaatttttatcaatatttctaggctacacagtttgtctgtagagtatttcaaactatcacaaatttccaaaaaattttctgatatacttcttgaaaaaatttttacacacaagtggatccatgcagttcaaacccaagttgtacaagggtcaactgtattgtagttattttttaatgagattttaaaaacttttttcaatttatatgtatttttcttaactgagtattaaattctgaagctagtacttattaaattgtttggacttaacattaaacaggactgttaggcatttgttagcataccatgaaaaaatgaaaaaaataacaaaaacactaaaaacactgtaaactgggaaagtttcagattctctgaatttgagagagttgttcaactctaaaatgaatgcattcttccataagcatgtgaaaaggcagcagtctttcttttttctctttttttcaaaattgctttctagactgggcacagtggctcacacttgtaatcccagcattttgggaggctgaggtggacagatcgcttgagcccaggagtttgagaccagcctgggcaacatggtaaaaccccatctctacaaaacatccaaaaattaaccaggtgtggtggtgcacacctgtagtctcagcttctgtggaggctgtgaggtgggagaatcgcttgagcccaggaggcagaggttgcagtgagccgagatcgtgccactccactccagcctggtgacagtgaaatcccctctcaaaaaaaaacaaaaaaacaaatttgaaaacacattctagtgacatgggattttgtgtagcatcttaacaaaaatgtaatcacatatttaaaaattttctgtgctttttgctgtatcaaacaaaaaaagtaagaagtgctcttccctttaaggttatggtcaggtcagagtggtaagacaaatacaagttgcttatatcattaagtaaaataaaataattaccctcatttatttcataatatcacatattatgggcattcaaagaagaatgtgtacatctgttagtgggaatgaagaaagaatttgttagattttaaatgggcattgacatgttggtaaattctaacatgtagaggtagtggacatttcagatagaaggaaaaacataaaaactcaagatttattttgggagaagcaaattattctatatgactgaagcaaggacatatgttatgaagtaatgtagattacagctggtttactataagttggagtactatcgtggagcactttgaatgctggggtgtgaggcatttggattcaatttactaggaaaagaagagtgattagggtgattaatctgtcagcaagatataggatgattaaatcaaggagagaaaggaggcagggatagctttttaaaagggaatgatggattttgctttatgtatatgtatttcaaaggaaacaccaaactgttgatctttaaagagcatacttttgttcagcactgtaactaacagttgtaacataaaactcacttttctgatgggaggcagaagactttctaactttcttgttatttctagaggaataatatcaatacaatgtaaatatgtatggaatgcatactataggccaagaactatattaagcatttatttaattctcacaacccttgagagacattattattcccattttacaggtgagaacagtaaagcctagtaaagttaatgttgtccagagtcacatagttaataagtagacagattagcaaaaatttttaaaataagtttactagttggtttaaactaaggagaattgagttaattctccttgggtcttatcaaattatcttcatctgacttaggcatagtttctctctttttttatttttcatatcactcctgatctcttcccaccatgggtactcttaatgtgtttgatatggctcttacatttggatgtgtcctttaagactgtattgtgttattttagatgcatgcatatgtgtttaaattatacataatatataaaagggtaaattatagcttgtctgatttgatatatatgtttctactctattgcttttatatttttattttataagaaacacacatttttattttataagaaacaaggtcttgctattaatatgttaccaagaccagaatgcagtagttattcacaggtgtgatcattgtgcagatagccttgaactcctggcctcaccctatcctcccacttgagcctcctaaatagctggaactacaggtgcatgcagctgggcctggcttagtttactgcttttttaaaaataatttacaaataataattgtacatattcatggaatacattatgatttttttttttttttgagacggagtctcactctgtcgccaggttggagtgcagtggcgcgatctcgcctcactgcaacctccaccccctgggttcaagcgattctcctgcctcagcttcctgagtagctgggactacaggtgtgcaccaccatacctagctaatgtttgtatttttagtagagatggggtttcaccatgttggccgggatgatctcgatctcttgacctcttcatatgcctgcctcagcctcccaaagtgctgggattacaggcgtaagccaccgtgcccggcccataatgatgttttgatacctgtaatgtatagtaatcagacagggataaatagcatatccatcatctcaaacatttatcatttctttgtgttaagaacatttaatatcctccatctacctatttaaactatttaatatatttttgttaactaaatagtcatcctgcagaggtatagaattctataacttactcttatctagttgtaattttggtatcctttaacaaatttttccctatccttcctttccccctactttcccagcctccaatatcctctgttctaccttttacttctataagatcaacttttttttatcttctacttatgagtgaaaacataccatgtttaactttctgttcctaacatttcacttaacataatgtcctccagttttatctatgttgccatgaaccacaggattttatgcttttttatggctgaatggtttttctttgtgtatacattacacattttctttatccattcatttgttgttggacacctaggtttgttccatatcttggctattgtggatagtgctgcaataagcataggggtacacatgtcccttaaatataatgatttccattcctttggataaattcctagtagtaggattgctggatcatgtagtagttctacttgtggtttttaggaaactccaactattctccatagtggctattcccaccaacaatgtattaagagttcccttttctccatcctcaccaacatttttttttctttttgataatagccatcctaactggggtgagatgatacctcattgtggttttgatctgcatttctctgatgattagtgatgttgggcactttttcatatatttgttggccatttgtatctcttttgagaaatgtctgttcagatcatttacctattttttaataagattggttttttgctattgagatgtttgagttccttgtatattcttagtattaatcccctatctgatgttatgaatagtttgcaaatattttttcccattctgtaggttgtcttttcactctattgattgtttcctttgctgtgctaaagattttcagtttgatataatctcatttgtttatttttacttttgttgcttgtgcttttgaagttgtattcataaaatatttttccagatcaatgtcctaaagcatttcacctgtgttttcttctaggagggttatccttttaggtcatatatttagttctttgatcatttttttgagacagggtcttgctgtgtcacccaggctgcagtgcagtggtgcgataatgactcactgcagccttgacctcctaggctaaggcagttctcccgcctcagccagctgagtagctgggactacaagcatatgccaccatgcctggctaatttttatattttttgtagagatagggtttcaccatgttgtcgaggctgatctcaaactcctgggctcaagagatccacctgccttgacctcccaagatgttgggatcacaggtgtgagccaccatgcccagcctctttgatccactttgagttgatttttgcatgcagtgagaggtagaagtgtagtttcattcttctgcatatggctatccagtttgctcaggaccatttattgaacagactattcattccccaatgacaattcttggcacttttgtcaaaaatcattttgctgtagataatgtggataaatttctgggttctctatgcctttccattggtctatatgtctgtttttatgctggtaccatgctgtttgtgttattatagctttgtgatatattttgaggtctgatagtgtggtacctccagctttgttctttttactcaggattgcttcagctattcagggttttctatgtttccatacaaattttagaatttttttccatttctgtgaaaagtgtcattggtagtttgatagggattgcactgaatctatagatgtctttccatttatttgtatgcacttcaatttctttcatcagtgttttgtaatcttccttgtagaggtcttttatcaccttggttcagtttgttcccaagattttattttcttttctagctattgtaaatgaggttgcctttttgaattcttgttcaactactttgttgtttatgtacagaaacactactgatttttgtgtgttgattttatatcctgcaactttatggaattcatttatcagttctaagagttttttggtagagtctttaggctttttaatatgtagaatcattacatatgcaaatagggacaatttaacttccttcttctcaattttgatatggtttatttctttctcttgcctaattgctgtggctagtacttccagtactatgttgaataagagtggtgagagagggcatcattgtctgttccagttcttagaggaaatgctttcaggtttcagtaagatgctagctgtgagtttgtcatgttgaggtaatttcaacatgttattatgttgaggtactttccttctatacctaatttattaagagtttttatgaaggaatattaaattttatcaaaagcattttctgcttttcattgagatgatcatatgatttttgtccttcattctattgataggatataagacattcattcagtgacatatggtggaccatctttgcattcttgggataatcctcacttgctcataatctttttgagacactgttgggttcagtttgctagtattttgttgtggacttttgcatgtatgttcatcagggatattggcctatcattttctttttttgttttgtccttatctgtttttggtatcacggttatgttggcttcatagaatcaattaggaagtatttcctctgcttcatttttggaataatttgggacaaattggttttaattcaacagtgaagccatccagttctggactttttttttttttttttggtgttggaagactttttgttattaaatcaatcttgtttcttgtcattggtctgtttaggctttctatttcttctttcagtcttggtaggttttacgtatccaggaatgtgtccatttcctctaggttttcaaatttgttggcatatagttgttcacggtagtctctagtgatcctttgtatttctgtagtatcttttgtgatgtctccttttttgtttcctattttaattatttagatcttctctcttttttcttattctagctaatggtttgtcaattttgtttagaagccagctttttgttttgttgatcttttgtattttttttgtcttatttttgtttatttctacactgatcattattatttctttccttccattaattttgggtttagtttattcttttctagttctttgaggtttatcatcaagttgtttacttgaaatctttcttgttttttgatataagcatttattcctataaacttgactctgaatactgtttttgctgtgtcccataggttttggtatgttgtgtttctgttttcctttgtgtcaaagaatttttaaattttattcttaatttctttctttatccattggtcattcaggagcatattgtttaattttcatgtaatggtatatttctaaatgattctcttgttatagatatctaagtttacgccattgtgttcagataagtacttgatattttgatcctttaagaatattttgagacttctattgtgtccttacacacgattgatcctgagactgttgaatgggctgatgaaaagaatgtgtattctgccactgttggctgaaatgttctataaatatctgttgtatttagtctatggtgcagtttaactctgatgtttctttgttgactttttgtctacataatctgcccagtgttgagagtgggatgttgaagtccccaactgttatttcactttagatctaataatatttgctttacatatctgggtgcttcagtattgggtgcatatatatttacagttgttatattctcttgttggatcaatccttttataattatatagtagccctctgtcttcttttacagcttttgacttgaagagtgttttacctcgtataattatagctattcctgtttgcttttagtttccatttgcactgaatattttttccatccacttccagtctgtgtgtgtatacaggtgatacaagtttcttgtagatagcatataattgggtcttgtttttttaaaatccattcagctagtatgtatcttttaaatgtggaacttaatctatttacaatcgtgttattattgataggtgaggacttactcctgtcattttattgattgttttctggtggtttgtatatcctttgttcattactttctctcagtgttatttttgcagttgaatggttttctctagtgaaaaggtttgattcctttctccttctcctttgtacagcagctctatcagtgtgttttatagtttcacatattttcatgatggtgattattgtttttcatttccacatgtaagacccccttgagcatttcttgcaaggccagactagtggtgatggattcccttagttttgctagtctgtgaaatattttatttgtcctttatttctgaaggttagctttgctgggcgtattcttgggctaataatttttttcttctagtactttgactatattatcctgtcctctcctggactataggatttctgctgagaaattcactgttagtctaatggggattcccttatatgacttgatgcttttatcttgctgcttttagaattctttctttgtctttgacttttgacaatttaactgtaatgtgccttgcagaggtcctgtttgaggtgaatatatttgagctttctcgacttggatgtctctctgtctttctgttattatttcattaaatatgtttttctcacctttcccttcaccttctggagatatttatttgcttaatggtatcccataaatcctttaggctttttcattctctttttttttttaaagttagtctgcctgtgttatttcaaaagatcattcttcaagttcagaaattcttcttcttggtctagtctgttgtttagctctttattgtattttttatttcattcattaaattcttcagctctaggatttctgcttcattcttttttatgatatctgtctttgttgaatttctctttcaaatcataaactcttctcctgactttgttgagttatctatcggtattctcttgtatcttattggatttctttaagattattattttgatttttttcccacatttcatatatttccttatagtttggagtctgttactagataattattgttttccttttgacattacatgttttcttgctttttttccttcttcttcttttaagacaagttctcattctgttgcccaggctggagtgcagtggcacaatctcggctcactgcagcctctacctcgtatgctcgagtgatcctcccacctcaactccccaagtagctggaactacagacactcaccaatatgccctgctaatttttgtggtttttagtagagacagggtttcaccatgttgcccaggctttttcttgctttttcacggttgatgtgtccctgtgttgatttctatgcatctggtggaaaagtcacctcttttaattttatggaatagatttcataagaaagaatacgaatgagtcttgggttgttggtttggtggggtacattagccttatttctagatacagttttgtagtctctgagtaatttcttcagctgtaatccactctagtggcatttgtgagtttctcagtggcatgggctgagagagtttgtggcaatggtgatgccactttgccaggggtgggctcactagactgtttctcaggtctggggtatgtatgtgcacatagtaggtcagccaacttggttggtgagattggcttactgagactggggccacaaggctgttactctgaccagaaatacaagtataaggttgcttgggcaacctggggacatgcctgccaggagcagctttcaggtcggggacgtgggcttttggccacttggctggcttggagatattccctgtggcacgggggcagtctgcgggactatctctcaggccattattgggggtaaaggactgttgggcaggccaagggcgtgcctatgggggacctgtgtgtctgtttctcaggttctgattgcttgcaggtagccctactctgctggccctgggccatatcaccttctcagaggctcagggaggtctcctgcttagagaagggagcccagcagtttggccagcttaagagcaggcttgctgtgggtaggactggcagactggtttctctgttggtggtatggccatggttcttggttttcttgctgtgcaagaccagaataacagccagtccagggtccagccttcaccagcttggatcatggtgttcagaaacttgtttggagttggcataatgaagatggagccccagttctggagaggtgcagtggccactttccccccagaggagggcatactacacaggtggctattctcaagatgacgccatgttacagcagtttggctcacagtggtgggatggggagtacacaccttgtgctcttaatccaggtcagtgcgtctgcatgaattcctggcagctctccaaaatgggctcagggcttgtgaggactatgggattcttgtgtagtaaggccttcatgtgtttgtggtggcaaagaggctggtagggatcttctgctgacttttttccctgcaatagcaattccctcccgtctccaggcagatctgatctaggtggggaagatgggaccacgagtttgagtgcctctatgctgccttcctagatttccaatcaccacaggtgcatcttcattctatcagtgcaccccactactcttccttcacactccagtcaaatcttagctgtttgtttgttgccttgatcctttttttgtgtgtgggttagacaagcaccaggtatccctactcagccatcttgctgatgttactcctttattgcttttcttttcttttcttttctttttttttttttgagatggagtcgcgccctgttgcccaggctggagtgcaatggtgtgatctcagatcactgcaacctccacctccttggttcaagcgaccaagtagcctcagcctcccaagtagctgggactacaggcacccaccaccacacccaactaatttttgtatttttggtagagacgggagctcaccatgttggccaggctggttttgaactcctgacctcaagtgatccgcctgcctcagcctcccaaagtgctgggattataggctggagccactgtgcccaactcctttattgcttttaatctctgcatagtagtgtgtgtattagtctgttttcatgctgctgataaaggcatacctgagactgggaagaaaaagaggtttaattggacttacaggtccacatggcttgggaggcctcagaatcatggtgggaggcaaaaacagaaacccctgagaaaaccgtcagatctcgtgagatttattcactaccacgagaacagcatgagggaaaccaccctcatgattcaaattatctcccaccagtctctcccacaacacgtgggagcacaattaaagatgagatttgggtgggaacacagagccaaaccatatcagtgtgcattcaccacattctcatcttttcccctagaaatagacttctaggatttctcacactttatgttcaacagagctatataaatatgctcctatgtattcccttaaagcccatcttctttctactatatctttttcctcattttacttccttttttgagggagttatgtgggatagaagaaaaatggacttcttcatttataacatacctgaagttgggagtattttaatccttaaacagattaaaatgagctgggtgtggtggctcacacctgtaaccccagcactttaggaggctgagggaggcgtatggcttgagctcagtagttggaaaccagactgggcaacatgacaaaatcctgtttctactaaaaatacaaaaactagctgggcgtcgtggtgcatgcctgtagtcccagctacttaggaggcagaggtgggaggatcacctgagcccaggaggtcgagggtgcactgagctgtgattgcaccactgcactctagtctaggcaactgggcgagtctctgtctcaaaaaaaaaaaaaaaagagtaaaagatatgcagactatgtgattttctgcttccaaaaggaaccacatagacaggaagaagatccaagtgaattattctcttctatttctttacattgccttctgtcattggtaacataacctttatggcattcacaagtatatttgttctagctttcttcttttagtaattctgttgctgtcgtttgtgtgaaatactgcatattataacattgtaattataaatgatttatacattatcttaatcgttgtcagggccaacgtttttcttacaagcagataggaactatgctttgttgtaactcatatttgatcgactctgagaacaaaatgtattttatactttcttggagtagtcccacaaaacatgtaggacccattaagaggaagaaagcatgctatatggttgttatatttgttatttttgacttgtaatttattcattctctcagccctgttctctgactagtgttactatggcacctaagttatggcatggaaaacaagctaattatgttcttcagaacagacgacagtgatacatcttgagacacaagcatctggtagtcttagccctttcctcatcagtgctagtctaggcttggttgggctctctggttgtccaaatatttttctgttacaacacatccttctttattttatttttcttctataaatagtggtttatgctttctaaagcctctagtctcatatttagtttgttcctttttgagccttctgtctactcaaagaagtaatatagacttactcccagctgtgtatgatctactcttactcctgtttattgagttaagctttttactatttgtaaacatctcttggttgtgtagacacaaatacaccaaaactaaaaatggttaaattggggtgaaaacttacggatatttcttacaatttatttttcaaaattcagtgatgtagttagatggctctcctgataaaaattgtttaagagatatgagtaatcaatacttttttatcagaagtgacatctaaccatattaccaaattttgaaaaacaaagaaaatattagaattatccacaatttttgtacctaaacttaaccagttttacttttgtttattcccttataatcttttttactattgatttaatgtaggttataatcatactgtgtacacactatttgtatgtcttctatttaattgaatatttatgtgccataagcattttctactttactacttagttttcatcatcatcatcatttgtaatatctttaaaatattctctggagtggtgctattcaatagaaatataatttaaaattttccaggacccatatgaaaaatgtaaaaagaaacagcttaataatggattttatttaatctaatatatctaaaatatttattgtttcaacatgtaaaaattatataccgtattagacataaaaattattagattttaaccttcttttcatagtacatctttgaaatgtacctattttacatatataccagtgaattacgtcactaaactttcaatgtcaaaataaaatgtagtcctaccaaaacaataaagctccagcagaaaaatatgaaatgcttcaatttttacatttaaattaatgaaagtaaattaaaaatttagtttcacgatcatactagccacgttacttatgctcatcatgtacatgtagcttcttcatttaaatttaaattacatttaaaattcaagcctctctttgcactagtcacattttaagtgatcagtagtgagctttagagtatatagccaattcttgactgttcctctgtcatttttttacattgatttcaatgaaataagtacactgataagtttatgaatgtatattttcccatgttttggattactttcttaaagtagactctcagaagtagaattactgggtcaaagagtataatcaacccttcttcatcattgttaccatattgtttctttagttactagagaggaatatttctctacatatttatttactatgtatttctctttcaatggaatactttttaatgttatggtttatttatctattggtgtcctaatgtttgtttaatttttagtctacttttaaatttctttgtggactaaagatactaacgctttgtcttgtttttcctcatcttttgtttatttgtttgtttttttccttctgggagtaccaactgaaccctttacttttactatagcaaatatttagataatacttcctctgtaagcttcaaagtttttcccactctagaagtttgatatttacttctcttttatcatagattttctatgtatttttaaaaaatgtttttatcaaactggaatatatgattatgtaattgtgagaaaataaactaaattacaagttcttaaccttcagttgaatccagtgcttacccattatttttagataaagcctcattatatatagttgctgaccaccactgcatagttttacgcatatgtgtagttaatcaggaagtagatggacccaaatagattaaaatctactgtttcaaatatttcaaaataatatcatatattcttccctattatattctgatcagaatattgttctcagtaaaaacaaagtcttttttttttctatatcaccatgtatccacagttgattaattatagtcatggttattttacataggtttatttccttttgaattaatatagacttatacttccaagagttataaataactgaaatttacatagttgtgtatgcacacatacacatacacatacccctattcctcacataattggtaatagaaataatgaaaagaggttgtgttcttaggcaaggacaatttaaaagaaccccaaatgattaccttgaattaaggtaaacactggtaaaaaaaaaaagagcaaaaagggcaattttttcctttagtatattaaacaatgttgtttctaacattccctcacgtttagactactctgaaaaatccttagagtggttgtgtaatgtgtttaagttttttcgatttccaagcattaagtctggctccactaaaacggttgtttggttctattttagtctgtccctatctgtcctactgctaccactttgtgttgttttgttttctgttataatgaatacaacagtcccacttcattctcagttctaattaacgttatccagcctctaagtgttagcatctactttgcttttggttataggatcaacgataaacagctaactgttgtgcagactgaaatccctaattagtaaagcacaagattttattggttatatatttttctaaactatagacttgattttgttgcaaaccttacatgtagaaaaaaaattttgtaatggcactgtttttatttttggtgatactatagtctggaacatgtggcccagcaaaggttataaatctagcaagaaaaattatggatggcatcaattttaacagtctttgcgatctaacagagcataaaccccaaattgtttaaatactaaatatttacttaaagaaaaacaagagatcattcaaaaatagaatttaaatagtgaatttgccttttatttaaaagttgacaagttttgtatatttataaaattaacaaaattgacatcatactatccatatcacaagactcttgtgttgtattttaaaggaaaacacacacacagcatacatacatttggattggggccagatttagactccaggggcacagtgttctgtaccttaaattacaatcagatgtattttagcacagatcaaattttcagtctgaagttggtgagaagcctaattatttgaccaggttactatttatgtagaccattctgtggctggctgtggttaatccacagctggcagaatgctagctatgggaggtttttatttgatgctggaacagtttggggagaaatagagggggaaagctttaaaatcttctcattaaatgaaagactaaaaagcaagacagtacatccatattactatggagacaagatgctgtataaactgttcgttttaattctccaagtgacagaaatagcaaagcagcagcttggatgctcatagtttgcaagtgataggatacttggttaaaaaagaaagataaaaacatttaaaaataataactaagactaagatttgttgcctcttagaacacttgaatattggtaaagaattaatggattcaatttttaaatgatgagaaatattgttattatacaaaaacattttgtatttcactaaacatactaaaacatttagaatttcactagcagtactttaaagtgataagaggcagttgtaggggagaaaaagtaacatattttcctcatccatcgcaagggtcatgactgaaccctctgtaacgaaacagattaacaagagaaaagcataatttatttaacaaagttttacatgacacaggagccttcagaaattaagacccaaagaccagcaaaaactgtatttttatgcgaagtctgatgaaagacatggatagttgtagagaaacattagacaaaaggggtatgatctaatggtaataaacctagggttgaaggatgtggaagccagcaagtcctgtctgttagattattcttggccaccaggtataggacaggacccctttggaaaagggttttatggccagctttcacacagaaaggtgggagaaggtcagagtgaccttgcttctgcgggttttctcaattgctagggggccatattttggggtattgtattctgggccctgacacaattatagtagacgattctctcttaacgtctcagaatatgtataaaggcaataaacccttccttaaaagatggaccccaatacacatggctcctgccactaaattaatttttttagtcttcttattgtagtctatttgaaatttgaaagtaatattttaaaagatttttttttctttttaaacttttcagagtttgcattatggaaatcgttggtccctcagttataagtgaatatctcagtagcatttttgtaacttttaacagaagtttcttttatattttcaaggttatttcttccatttataagccagttcttctccccttctagtttccagtgctcccacttcctctagttctttgctctaattatcctctctcccttgcctcttcattcttctatttctccaatagatccttttctttgaaaagcaaaatctttccaactttccctgcccttaaaagcaaatctcttctttcctcccttccctgcccacccttccccgcaaaaaagcgtttgtgccttttcctcctcttattatctgctcaaattagcaacatatctggagtcatatgaatccaggcttcatcacatgtaagctgtgtgtcctaagaaacatctcttaacttctctatcttgctttatttatcaaaagaaactaatatgtccacctcataggtttgatgtaaggaaaaaacaataactgagttgctgtatagtatagtgcctgggacacaataattactcattacatttcagatggttttattatcattactgatgaagctttgaaaataattattcttaccttactttctcaccattccttttttaacaactacttctaccatcatactaagtgctttctgttaatcatcaaatcttatgacttttactcattcctttctttctctacttccccatagcaccttcttaaaatttcccttgcttagtttctccaccatcacttctcctctcctcatttggcctcctcttgttttctccttttccttttttatttcctctaatttttgttctccattttttccttcgtcgtcttttgttctgtgttctctgccttgggaattacaccacctctttgacctcacctctttcatgacctttcctctaagtccaactttctggtagatacttagagatcccttagaacctcaactgtagtatgaccacaactaaacactctttaccatctaagccagatcttattctggaattttccacttttattaatggtagaaccagattcaaaaatctcaatcatcttttgactcttttcttctttgccttccacatcttaaacaattgccaagtcctgtatgtagtactcctaatatggttttcttttacacagccaaatgtagacatttattaactgttgctgaattgttgctgcccaggttaactttgctttaaattttcccataagcttgttattccttcctttcacggaaatattcattacccatgatccacccctacccctcttgcacattgcccaccaaatagattcctaccctgccatccaaggccctttgtattcttaacttcgccgaccttttcaagtctctattattgccctttgtgtattcctttacttgtttgtgcaccatccaaactaatttcctgtatatacatgtatgtctttgcttatgctttcctctagaaagcatgaatatgttttaataagactttcattaatattaaagctgtacataaatagcattttaaatgcagctttcctgacatgaaattttaaagaaatttaaagaaaattttaaagaaaaattaaatatttttcttttgcattactgcattcttttctcattatttgaaaattctaattcagaatcttcctcaaaaatcaatttagatatttcttaaggtaacaagttatgattgattgattgattgatatagagacaaggtctccgtgtatttcccaggctggagtgcagtggtgtcatctcggctcacttcaacctccaccacctgggctatagcaatcctcccgtctcagtctcatgagtagctgggaccacaggcacacaccaacacacccagctaatttttgaaatttttgtagagacagagttccgccatgttgcccaagctggtttggaactcctagactcaagtgattggcccaccttggcctcccaaagtgctggaattccaggtgtgattcattgtacccagccagaagttatgatcttaattaacagattattttaaagtcacttataagaatacaaactcagccaggctcagtggtgtgcacctgtaatcccagctacttggagggctgaggtaggaggattgctttatcccaggagttcaggaccagcctgggcaatatagtgaaaccttatctcaaaaaatatatattccaaactgtttgtaagaagctaaaaggattcagtttgccttcatagtacaatttccctaattcgaatgtaattattgtcttgaatgagacctttcaaacattttttctttcatgaatttccagaattctttagtattgagcatataaacctagtatgaaataagtaatgctttattctctgaagtaatggcatgtatcaagcatatggtactcatatgatcaaatatccttccagtcaaatgttgctattttctgccttgcatcttataattgtattttatatacttttgtattttgtataggtttcttttattctcactgagagtgactgtggagatggtatttctaattttccctccttttttcttcatccagggcttttttcttacagtttccccagagtcagtattaaaggtggctcaccatgcttctgaaaacaacaggattttcactttgaatctatctgcaccgtttattagccagttctacaaggaatcattgatgaaagttatgccttatgttgatatactttttggaaatgagacagtgagttacctttcctttttcaaaagaacctgggggttttttgtttgtttatttctgatgtgtgtatatatgtttagaaatatataaattaaatcctaaatttttgtgtaaatgtccttgagaattgtgcaacaaaattgcctcaatgtcaactgctctcagtattttcaatatttccttcagtatatactaacttctttcttagtgaagcatttatttatttatttttatatttttatttttttgaggtggagtttccctcttttcatccaggctggagtataatggcatgatcttggctcactacaacctctccttcccgggttcaagcagttctcctgcctcagcctcctaagtagctggggttataggcgcatgccaccatgcccagctaaattttgtgtttttagtagagacagggtttcaccatgttggccaggctggtcacgaactcctgacctcaggtgatctgatcgcctcagcctcccaaagtgctaggattacaggtatgagccactgtgcccggcccaacatttatttttttaaggtgtttgacgtttgatttacttatagtaagagtcatcctttttactgtaatttctgtgagtttttacagatggatacctgtcctgttactatgaccacaatcaggataaaaaagcacattcatcacttttttaagtctcttcagagtctaagtccatttgatatttgtttaataaattatgagtaaattttgatatattacatttatatttctttattaataatatttttaaaatattgtctgttatagttgaaggtgataaaatggaatttcatctcaacaagtacagttttttctttctaccaagaatgtattttcttccattctaaattatggaaatgcttatttacttaaatgcttatttactttgattgcttgtttactgtttatacctcttatttactgtttatacctctttaaaaatccatgaaagaggaaaaaatccttcagtgtgtcttcctatgacttggccatgtcacttgatggtttaatgtatacaatgaaggtattgtattaatcatcccagaagttcattctgattctaattccatagttctaacatagtttgaatatattcatcaattttatatctaataactgccatctgcctagaataacataaaaattgacctggaagtttacgagatcacctgggtaaagattaaaggatgatccatagaaataatatcacagtgtatctgcaaaggtgatggttacattggttataaatggtgacattggaaggaaatgctatattcttgataattcacaaattgagatactggcaagaaatagtggtaatagccaagtgccatataactgctagaagcctaatttgactaagatctaccatttagtttttccttattaacagttttattttgtaaagggtaaaagaagtaaatgggaaaagtgctattcaagccttttgaataacattaaagcattggtctcagtagtcttgagaatcattgggagaagttaacatttggtctcagagttctaaatagtcaagaaagatcagactggcagcacttaaataagttctctagagtttaagagacaaatcttaaaacttttaaaaaagataaatatgattccaaagaggccgggcacggtggctcacgcctgtgatcccagcactttgggaggcagaggcgggtggatcacgaggtcaggagattgagaccatcctggctaacacggtgaaagcccgtctctacttaaaatacaaaaaatgagccaggcgtggtggcgagtgcctgtagtcccagctactcgggaggctgagacaggagaatggcgtgaacccaggaggcggagcttgcagtgagccgagatcgcgccactgcactccagcctggacagagcgagactccgtctcaaaaaacaaacaaacaaaaaaaaaaaaacataaatatgattccaaagaatgaaactttggaagtaaagaaagcttagggagattgaatgccataaaaaatgctatttggactttatagtcacaaatgatcttaattaaggagagaatgtggagggaccttttgaaaaaatatagcagagcacgcagaaaactctttaataagagctcaaatttggaggataacgagatagctgcctctgcctttgccggtgcagtgagagcagcttcaggaatcttatggcctctgaatattttggcatcttcagcctaccaaaactgtgtcaaaaatgcctctcttatttctgcattgtccactggacgttttagtcatattcagacaccagttgtttcctccactcccagacttaccacatctgagagaaacctgacatgtgggcatacttcagcgatccttaatagagtggccctcttgcttccaagtgtcttgaagctgccagccagatctctaacatacgtcagtacaggaaaaggcaagagaaggattgtgaaagctgtcatctataggtttcttcgacttcattgtggcctttggatgagaagggctggttataagaaaaaattatggaaaaaggcacctgcaagaaaaaagcgattgagggaatttgtattcggcaataaaacccagagtaaactcttaagataaaatgacgacgtccttctggaagaggtgaaactggtatgtccatgatccttatcagaagtgtcatgatcgaacaaacctgaaagtatagatcagaagtttcacttgtttctcagttattgaatatgtatctttgtgtacatatctgcaaaaatggataagtaaaaatctcgatgtaaattgtatcaatgaatatgtaaacatacagtgacaacactgaacttataaaagttttaaaacttaaaaaaaaagctcaaatttgtaaaagacatgtaaaaagaaggtggaaaatgtatttagaatcagggaatgatgctaaaagtttggtagagacaaaagagaaaagaaagtcccaaaagtggtttaagtttgcagcagatgctgatgatatcaaaacaatcttcacttaaaaaaaaaaaaaagactccaaagtacaagcaacaaatggaaaaaatagataaattagacatcatcaaaattaacaatttttgggcatcgaaggacactaacaagaatgtgaaaagacaactagtggaatgggagttaatatttgcaaatcatatatctgataaaggattcatattcagaatatttaacacagtaacaactcaacaataagcaaactaacaacataattcaataatgatcaaaggaatttaataaacatttattcgaagaagatatacagatggccagtaaacacatgaaaagatgctcaacataaccattcaagaagtgcaaatcaaaaccaaaattagataccacttcacacccatcagaatgacaattgttttaaaaaatggaaattaacaagtattggtgaagatgtggagaaattggaaacacttgtgtattgctggtgggaatgtaaaatgggaatgtagaagacaatttggtggttcctcaaaatgttaaacatagaattattaccatatgatctagcagttctacttctaggtatattacccaaaataactgaaagcagggactcagataattgtacaccaatgtccatagcagcattattcacaatagctaagatagaagcaaatcaaatattcatcaacagatgaataaacaaaatttcatgtatatatacaatggagtattatttagccttaaataaaattttgatacatgctacaacatgaatgaattttggaaatactatgttaagtaaaataagccagacacatcagacaattattggattttctaagaagaattccacttacaagaagtatctagaataggcaaattcatagagacacatagtaggatagtgattacctgggagtggggtggggaggaatgaggcattattgtgtaataagtacagagcttctgtttgggatgatgaaaaagttctggaaatggatagtggtgatagttgcgccacactgtgaatgtatttagtgccaatgaattgcatacttaaaatggaaaattttatcatatgtatagtttaccacaatttttttgaaaaagttttattctacaaatcagtaaacttaaaagttggatcacagcttagcatagattattaaaggaattatttttccccacctagaagaggaagtggtaaaactgtaagctgctacgtggctgtaagtcatggggcaagaaaatcttttctcttttggtatgattattgttcatttgaattcgcttcaagaggtatttatatagtacctaagtacctattatggcagaccaataagcagtggatacatagtatattttagaacatctgtcattacgtggactatagaataataaagattggctataagacaattagaggtatttggtattttattgaagcagtctcaaaaggtctgttgataaataaattgatttctaggggtacgcctcagtgtttaccctgcctttgcttaagtaaacagtgatttagataaagctatatttgcatataattcaaatgcaaataatacaacaccttaatacatactaggtaagttgaaggtcaaaatcagatttttttaaatgttagtagactctaaatatcagttgagtgatgaaatttaatagggataataaaaattatatcgtatttgattataaaaagcaagtagagtaaaatgctttatccctttaatctcatcatccattgtttttctccttgaatactatagtgataatgttatcttcagttttccaggaaaaaagagacattttacttctaaaatgtgacgaaggataaaatatagttatcagagaatatacgtaggattctttaatatttcccccctcaaaaaaataaagtatactgtgtttagtataaatttttaaaatgtcaaaactcagctaaaatcaaacacacttggcccttattttctacatgtcaccttcctcttgtcagaggattgtacagtagtaatgatgatttaaaacttctgatagcctcaatatttaaaaaaaataataccttgtccacaaagattatttcttcacaggcaatgatcaatgatccctgtgagacaagaaataaataagataaacctgatgattaccccagctaactccttggagataatttccaggcaacagaagaaaggtaactaaggccaagcacagtggctcacgcctgtaataccagcactttgggaggctgaagcgagtggatcctttgaggtcaggagttcaagaccagcctggccaacatggtgaaaccccctctctactaaaaatacaaaaaagcctggcagggtggttgtgcgcctgtaatcccagctactcgggtggctgaggcatgagaattacttgaacctgggaagcagaggttgcagcgagccaaaattgcaccactgcactccagccagtgtgattgagactctgtctcaaaaagaaaaaagaagggtatctcaagtagacccttgcagtctcttttaatgaggagttggagccggaagttcaaggagtctaagacagctagtgtttgtaagttaaaagtaccagagaagaaatagctgaatagagggagaacacaggacatttgcagaatcccaacaagtcttcagctgagtatgaatcagtgcatttttgtgaagaaattaaggaagaccacaaaaagaaccacctaaaaagattgtagaagacaatcctcagtgcacacatgaggacctataaccattcctatcctactagtcagagtggataacctcgtaattcacgaggcttcaagtagagtattaaaaggaattttgtctcattagcaggttaaaatcagctctagactagatgttctggtccctcctgtcaatattattacaatatatttgacaacctttatgaaatggacaaatttgttaaaagacacaaagtactaaatcatactcaagaagaaatagaaaaagtctgtttagattattaaagaaattgaatttgtagttaaaacccttgctacaaagaaacttcaaaggctgaattgcttcagtgtttaattcttttctgtttgtttgtttgtttgttttgagacaaggtctcactctctcacccaggctataatacaatggcacaatcatgtctcactgcaagctcaaactcctgggttcaaatgatcctcctacctcaacctcccgagaagctaggacgacaggtgcaaaccaccacagctggctaatttttaatttttgtagagaggaggtctcgttttgttgcccaggctggtttcaacctcctgcactgaagcgagtccttctacctcagcctcccaaagtgctgggattacaagcatgagccactgcacttggcagtgttgaattttaacacagatttcagaaagatgtagtaccaattgtatacaaactgtcccagaaaattgaagagggagaaatatacctatcttatttcatgaggtcagcattaccttcataccaaaaacaaagtattgcaagaaaactacagaccaatatccctcataaacacagatgtaaaaattcttcaaataattttagcacatcaaaccgaacaatatattaaaagagtaattcatcatgactaggagtgtagaattggtttagcattttgaaatccatcaatgtaattaaatatgttaagactaaaaagaaaaatcacatgattatcctaaaagcttttgaaaaatccagacatctatttctgttaaaagccctcggaggctgggcatggtggctcatgcctgcaatcccaatagggattggtgagggtcaggagtttgagaccagcctggccaacattgcaaaacctcatctctactaataatacacaaaatagcagggcatgttggtgggcacctgtaattccagctacttgggaggctgaggcaggagaatcgcttgaactggggaggcagaggttgcagtgagccaagatcatgccaccacacgccagcctgggcaacagggtgaaactgtgtcaaaaaaaaaaaaaaaacccttggaatagtagaagcatgaaaaaatccagatttagaaagaaggaagtaaaactgtctctattatcaaaagcatgatcatcttcatacaaaatctgatgtcatcttcaaaaagctattagaactggctgggcatagtgcatcacgcctgtaatcccagcactttgggaggccgaggctggtggatcatttgaggtcaagagttctagaccagtgtggccaacatggcaaaaccgcgtctctactaaaaatacaaaaattagctgggcatggtggcacacgcctgtaattccagctacttgggaggctgaggcaggagaacccgggaggctgacctgaggcaggagaacccaggaggcggaggttgcgatgagccgagatcatgccactgcactccagtctgggcgacagagcaagactctgtctcaaaaaaaaaaaaaaaaaaaaagctattagaactaagtgacgtagcaagattgtagcatacagaataaaaaatttaaatctcaaatgtatttttctatattagcaagaaacaaccagaaatttaaaaatacgatttccaataccatcaaaaagtataacaaagtatttactttgggataaaccagaccaaagatgtatacactgaacactacaaaacattgttgaaaaaatttaagaagacccaaatgggagatatatcatgttcatagattagaagactctgtattgttaaatataaattctactcaaaataatctatagtttagtgtaattcagtcagaatttcagaagttttttttaaagtcaagttgattctaatatttatatggaaaagcactggactagagtagccaaaccaacgtggattttaaaaaccaaatcagaagacctttacatgatttgaagacttattacaaagctacagtaatccagacaatgtggcattggtgtaatgatagacaaatagtcaatggaacagaagggaacgtccagaaatagacctaaatttatttttcaacaatgtttcagaggctttttcatggaggaagaaaacagtctttttgacaagtcgttctggagcaattaaatatccatatctaaaaacgcaaacttcaacccacgtaacaaacaactgcacggctattagaatgtctgaaagtgtgaccataccaaatattggtaaggatatatggagcagctagaatgtaaaatggtacaactactttggagaatggtgttcttgtttcttacaaagttaaatatacatcctccaaatgacctagctatcccactcctagatattcacccaggacagatgaaagcatctgtccatgtaaagacatacacaggtgtttatagcagctttatttgtaatggccaaagtctggaaaacaaaccaaacatccacaactagtaactggttaaacaaattgtgatatttccatagaatagaatactactcaactataaaagaattgtactattgataagaaatgaaccaacagcatagaagaattttagaatacctatgctgagtgtaagatactgtaaagtacattctatatgattctatttatattctagaaagtgctaacaaatttatggtgatggcagatccattgttgtctggggacagggttatgctatgaggcagtgatcacaaacgggcatgaggaaacttttaggagtaatagatgtgttcccattgaggttgtggttgcagtactttatacatacgtcaagttttatctaattaaacacttttagtttgtgcagataattgtatgtcagttatacctcagtaaagctattaaaatgaatatatactttgattccatttatatgtttaaaagtaggaaacattattctaaagccattaagttccaaaaatacactgctaaaatgaagaagtgccaatttgttattttttgatcaccatatatgaaacttctgttatttccatggaagatccccttatatttaagtagcaatgtcaagccagaggaagagtgttttgatagtcctgggttctaatcatgacaactaaaaattatcataacctaccattgaataatgctttaaagttaaaaagggtattcacaaaaaccgtcatttaatctacaaggcaattccatgtgtttttctaatgcatgtaaagtttcagcttggctcatggaatatattctcaatttttgttaggtaatgttggtagtagttttaggagtattgatcatgttatctattaagtttcacttcactttaacttgctttgataactcacactcttcattcattcctgttaaaacataatgaatatagtaccaagtgcatgagggaaaactcacagctattgggctgctctctgctataccaccttacttctgttccaacaaagttatttgcttacaaaagttaattatgtttttcctaaacttggtgaaatttgtgttcattatttaattatttaacattatatattctgatgaaatatgaatgcaagtagaatgagaattagtttaatgagttaaggttggttccaaaactaaatacatatgagttatttttaatgttgctattgaattggatgtgggcatgaaaagtataaaagattaaaggcagtaaaaagctgtaaacatctgtattcaggagtgcttcataggtgtttttatgttttctctctgctttaaagaagttgaaactaggccaggaaccatagcgcacacctgtaatcctagcactttgggaggttgaagtgggaggattgcttgagcagaggtgttggaaaccagcctgggcaacatagttggaccccatctctccaattattttcttaaaattagccaggcatggtggcacacacttgtattcccagctattcgggaggctaaggtgggaggatcgcttgcacctgggaggttgaggctgcagtgagctacgatcatgcaactgcactccggtctgggtaacagagtaagaccctgtctaaaaataaaatttttaagaaagtaaaatgagaattcataaactatgaattctagatgtggttctacaagaaaaactctagaatgtcagtctgtaggcatgctcaaaggttttgaccctatttttttttttttttttttgagacagagtcttgctcttattgcctaggctggagtgcagtggcaccatcacagctcactgcaacctccacttcccaggttcaagcaattctcgtgtctcagcttcccgagtagctgagactacaggcgtgcacaaccatgcctggctaatttttgtatttttagtagagatggggttttgccatgttggccaggctgattttgaactcctggcctcaagtgattttgaactgcccacctctgcctcccaaagtgctgagattacaggtgtgagccccccacccagctgaccctattttaaatattagcaaatgatgtatctttatatattaaaataaaatgtttagattatgaaagctattttttgttcccttaatttaatcatcactctgatttatttatcaactactattccttttcctcatctgtaaattgaggggatttgcatagaaatactagataatcttttaaattttttcttaaagcttaaacatgttataaaactgatgattcattttttttccacattctaagattaatactgttagattttattataaattaataaagttcctcttttaacatgtaaaataatgcctgacatttcttttaggtagttctgattttttattatgagtgtagccttaactgtagtgcctttgaagctgaattctccccatttgtgaccccagtattccttttttgtttagtgaacctaggggaaatgatatttctctccaaaaaatacctgaaaatatttggttagacacgtgctgggacaaaaagtgaagtatccacagtaataccattgctatgttcttgtgatataaccagattataattactaaatgatacaatttactttctttttttaattctggtaaaaaaaaaatacacaatataaaatttagaccattttaactatttttaagtgtacaaatcagtggcattaagtacatttgcaatgttgtacagccatcaccactattcctctccagaactttttttttttttaatcaacccaagcagaagctctgtacccattaaacaataactcactatttcctgtttcctccttcctcctcacccttggtaactgttttactgtctatctatgaatttgcctattttaggtacctcatacaagtaggatcatacaaaagttgtctgacttaatttcacttagcataatctttttaaacttcatccatgttatagcatgttatcagaatttcatcttttttaaggctgaataatatttcattgtatgtgtgaaattttgttttttgcttcattttgttgatagacatttaatttgtttccacctttgattattatgaacaatgctactgtgaatgttaatgaacaagtatctgtttgagttcctgcttttaactcttttggatatatacctagatgtggaactgttggatccacaacaggtacaccattttacattcctaccatcaatacacaagggttccaatttctccacctcctcaccaacacttattttgcatttaaaaaataatagccatcctgctgggcacgaggtggcatctcactttggttttgatttgtgtggtttactttcagccaaggttcagaaatacatagtgacaaatttctgtttctttaatttaaaatctttggtaacctgttacattgcattttgtacttttaaattacacatctgaattgattggttatccttgttaaagtagttccaaaattactgtagtttaaaaactctttaaatattacattgtagttttaatttgtttctgacatcttcaaagtttgaaattttcccttcagcaacaaccatttgttagctacattcacacgaaagcagcttaataaaggacattctacacaaaggtaattataatccattgatgccccttaatgcaagctgctttgtagtcattatctagcagtagatgactaaagaacttgattattcttgtttttcatttttattaaattaagaaggtttttttaaattatgtcattttgcaaatggttcttaggagtaatgcctttcaaggctccataatcactagataattaacctgcaaggattaagtacactcaactttgcctcaggatgcttaactctcaaatacagtcaattatctcatgataataactgctttgtcaagagttaccacttaactccacagtgaaaagtcaaatcacccataccatgcactttaagatagtttcaataataaaataacagtttgaaatggggcagaagaattcagttaaattttttcatagggataagaatgatatgctttagataaagctccccctcatatctagtattttgaatttcacaaatgacttcaatttataaagataatataggccaggtgcagtggctcatgcctgtaatcccagcactttgggagaccaaggtgggcagatcacctgaggtcaggagttccagaacagcctggccaacatggtgaaaccccatctctaataaacacaaaaattagctgggtgtggtggcacgcgcctatagtcccagctgctcaggaggctgaggcaggagaatcctgagaaccctggaggcggaggttgcagctagccaagatcacaccactgccctccagcctggcaacagagcgagactccgtctcacaaaaaaaaaaaaaaaggtaatgtattgctctgcttcatcagtccttttgctggcagtgttcctgcattgcaaattttcttataggaaagccattttgtctgttaacctcacagaggattcaatatattaaaaatctctaatatacaccaagaaaatggaaattactttctttacatattgatttaacttttaaaaaatctcgtttatcaacaaacgaattacaaaacagtgagcaaaattctgcagtttgttgtggttgttttttgttgttgagtagcttcactcatatttggacaggatatgccaaaaacagaaagactgctagatagatcaggacattttgaaagaaaatataaaaatgtctttaggtttgttatccatgtcctctaagcctgaatgatgcttgtatctctttataagtaaactatcattatctttttactaaaccagatgggatacattggctttttcttctgttatatattttactgccatggggatgggaagagactttattgatattttgtttacacttttaaaccctttttaatgtttctaatagttaattaataatttgaaaccatcaattctttaaattgtaaataactttgatacaggttatcttatttttcagtttctatacttctgtaaaatagaagtcatttgctcttttaagataaaaaatctgtgtgaatctatgtgtaattatgtacaccaaatagtgctatacatgcatacaacttctttcagatattcttcttttggttaagagcctttttttctttgtaaaggtattattttaatttttagaactatttttctgtgcactggagcacatgtttgggaggaaaaaagaaactttctgtcaagtccctatacacagagaattcttgtttgaatttttaaaaaattttgtcaagtctagttcttttatttatttatttattatcagttagagacagggtctcactgtgttgtccaggctgttctcaaactcctggcctcaagcagtcttcccgccttggcctccctaaggttctgggattacaggcatgagcgaccaagcctggccaagtctaattctttaaaggatgtgatttccaagtatttccaggaattcaagactgttacctagatccgtattctgacaaaagagatgatcttttctttcttcatatcagaatatttcccccatgaattgagggaaatggggctgtatctaaaaatggtaactctgccctttaaagtatacagaagtgccctgtttcttcctaagagaggtggaagtcccctttctgagactgtgcatatagatctctttattcccctttttctgctataagtgataagaggggctatgtagacaaaatgtaaggttgttataaaatcatcaaggaattgggaaagaaactttatcggaggatatacataaccccttcagaaaaaaaaacaaaaacttatggtgctttttggaagaaattctgacatagttgtattttctgagaaggataatgaaatttcagttaacatggaactgtaacttcgtaaaattgctgctcagctcctagatttaactttctccctagggtttttctaatatatttactcatctgaaaaaagtgagattgactgtagcacaagggagacttctgatgtcagtggcatgttgtaaagatgtgctatgggaaagattcagaaaatgcaaaggctatttaactatatgctctgcatctctcttcctttctacatagctctctcctttctttcttactccttcgtctccctctttacgccaactacattgcctctctgaagatgaaatgcttttaaatcatccccaatctaacatccatcactggtaaaaagccatctaattattatgtgttgatttttaaaaattaaaaaaaattattagaaaattaagaagagcatttaaatgtttttaattgcaaggagaaaataaatacactcaagtaaagaaaaacactgtgtaatttgaaatagtttgaattactacggagataatcatattttatgcagtaatgcctttctattttattcactatttctattaatctttatttgtttcagttactgtactataaatttgtaagtgattattttggtattatttgtatagtatgccataatataaaaataatgaaaaatattaaatatatatttaatgttcttatttaatgcctttaattttttttttctttgagacaaggtctcactctgttacccaggctggagtacagtgatgcaatctcggctcactgcaaactccacctcccaggttcaagcgattctcaagtctcagctttccacatagctgggattacaggaatgcgccatcacactcagctaatgtttgtatttttagtagagatggggttttgccatgttggccaggctgatcttgaactccaggcctcaagtgatccacctgcctcggcctcccatgtgctggggttacaggagtgagacacctcacccagccaaaaattattgtttattaaaaatcatttaatgacattgacatccttataaataaaaactgtaaatttatatcacagtagaaaaagtgctagacctaaatttagaaaacctgtcttttatcctagctcttgagtttttcacagagaaaataggagtcaagaagccaaaattctgacatgagggaaataattagcaaaatttaaataggtgccattgattagtcaatggtattttatcaacattaatttttattttattatttatttatttattttgatatggagtcttgctctgttgcccagactggagtgcagtggcatcatctcggctcactgcaacctccaccttccgggttcaagcaattctcctgcctcagcctcctgagtagctggggttacaagttcctgccaccatgcctggctaatttttgtattactagtagagacggggtttcgccatgttggccatgctggtctcgaactcctgacctcaggtgattggcctgccttggcctcgcaaagtgctgggattacaggcatgagtcaccgcacccagcttaacattaatttttttagttttggtaattttaatatggctatatagaatgtttacatttggaaaaatcctaatatcctttttgactgatccagatccagtccaggttgctcacattgcatttagttaccacatttccttcgtctctttaatctagaatggttcttcagtctttgtctttatgaccatgacaattttgaagagtcctgactggttttttgtagaatgcccttcagtgtggagtttcctcatgattaatacattttttataggaataccatagaaacagcctgggcaacatagcaagatgctgtctctacaaaaagtaaaattcaccaggcatgatggcacattcctgtagtcccaactacttgggaggctgaggcaggaggattgcttgagcccaggagtttgaggctgcattgagccatgattgccaccctggactccagcctgggttacagaacgagaacccccacacaccccccccccctaaaaaaaaacaacacaacacagaaatgctattgtgtcttttttcatgcgttatactaagattttagtgtgtttcgttactggtaatactaactttgatcacatggttaagaaaatgttggcccagtttattcacttcaaagttactatttctggccaggcatagtggcttacgcctgtaatcccagcactctggggagccaaggaggacagatcgcttgggcttaggagttcaagaccagcctgggcaacatggtataaccctatctgtactaaaaatataaaaattagctgggcatagtggcatgcacctgtagtcccagctacttgggaggctgaggtaagaggatcgcttgagcccaggaggtcacatggtgaccttggaagcaaatgctccctcaaacacgagatgactgcagccctggtctacatctcagttgcagtcttgtgaaatcttgagtcagaggcactcagctaagccatgcctggattccttttcctggaaactatggagataataagtgtttgttattttaagtcactaagttttggagcaatttgttacacaataataactaatatgctgtgaaaaacaaatttactaagagctcaatatctgtgtacaattttttttgtctttagccttttgtgtatattgtcaaaacacaggcttttagttaaagttagttcctttccccttcaagtattttaattttttttaaatatgtgaaacatttatatggttcttaacatcagaactatatgaaaaggtttactcagtagtgtcgctcctcccttatccctcatcttcctcattccccattctgtctctattcctaccctgtttcttcctacctaccctctataaataatctcattagtttctggctcacatttctaaatttcttttagcacaaattagcagctaaatgcatattttactgtatcttctttgttacatgaaaggtagcacactatagatagatcctctttgaacttagctttttttcaatcaagtgcatcttagaaatcattccataaaagctcatagagatccttctcatttttaattttattttagttatttatttatttatttatttatttttttaatgagatggagtctcgctctgtcacccaggctggagtgcagtggtgcgatctcggctcacagcaacttccacttcccgggttcaagggattctcctgcctcagcctcccaagtagctgggactacaggtgcctgccaccacccacggttaattttttgtatttttagtaaagacggggtttcaccatgttagccaggctggtcttgatctcctgtcctcgtgatcctcccgccttggcctcccaaagtgctgggattacaggcgtgagccacagcgcctggcctatttcatttaaaaaaaaaaaaaaaactgagacagggtctcactgtgttgcccaggctggtcttgaactcctgggctcaagcaatcctcctgcaatccttctgccttgacctcccaaagtgctggtattacagacatccagccacaataatcctcatttttttagttggattttccccattgtgtgaatgtaccatattttacccagtcactctcttatgtatggacattaagactgtttccagagtcttgcacttaaaaacaatctttcaatgaataatcttgttcatacatatttcttgggttgctagaggtatttcttcagagtaaattccttgaaatggaattgttgggtcaaaggataagtgcatataacgttttgttagatgttgctaaattcctctccaaaataattagaaatgttttcattctcagcagtagtgtaggtgaatgcctgtttttaatggggttattttaatatttggttatcaattattaagcattgctatcaaatggaattcactagaagcatgtaaaattctagctttatttcaaatacttagttgaaccagccaattcattttagcacagtaaaagtaatccaagaactaaaaagtgatcattctttaaggtacagattttaaagactcttttatcttttttttttcttttttttgctattttatcagacacattagaggaatatgaattaatccccattatacactctttagtttcattttctggccctgtattttcatcttatacttctctcctacaagcacctcttcctttctcctgtactgcctaactattcatgttttcttatcatcaatactcatttcatatattccctacctcacattctccccttctttccctcccttctccactcccattcagttggttattttataaatgtgattctgtgatcttgtgtatataattacaatgcttacatgtttcttttacactagaatgtgttcctttacagcagtgactttcattcttcactacattctggccacttgattggtgatcactttctgaccggaagttccaattatttaatcacaaagttggactttctggtgaccacttcccatcctggggctgacagtgagtcgccccatcagcataacaaaggcacttttaacaatcaggaaattctgagggtttttgaagctctgtgctaggaatccagacaaggacttgatatattttttactataccagtttaagggttaatgataccatgtaacaactttattaatagattactatttatagaaacttgataaatgtggtgggaggtggtgcagaatcatgtgatataatcaattataaatgaaagcacagataaaatttgaaataataagagagaaataagaatgaaggttggccacggtggctcacacttgtaatcccagcattttggggggctgaggcgggcagatcacgaggtcaggagatcgagaccatcctggccaacatggtgaaaccccttctccactaaaaatacaaacattagctgggcgtggtgatgcatgctactcgggaggctgaggcaggagaatcacttgaacccgggaggtggaggttgcggtgagctgagatggtaccactgcactccagcctggggacagagtgagattctgtctcaaaaaataatgaaaaccgaggagttttttctttctttctttttttttttttgagacggaatcttgccatgtcgccaggttaaaataaactttcaattctcttctcttgaatatctctcacccaacaatgtttttttcatgttgatcactttactaaagcgaacaattggggttttaccaaaattgtgaaggattttattcttccatacttatgtctgtgttcagggtcatacagattctactttttccttttagtttaaggtattctcttggagatttaatgtacttaaatttgaccacaatttattgagagcatattctgtgtcagacattgcactctgcactagatattcaggaatttctaaaaagaatgttaacattgctgttacatagtcagttactgatcacattcttttcctctcaacttttttcaaaataggaatctgcggtatgttttcacgtatggagttcaggtcaggcttaggggtccctgacaatgtgaatagttttaagctgggcctcaattcgtggtacccttatactaatttaacaagccgtggactctaggttccaccaaaaatattttgttccatcctctctggtttcagtccatggtgtacagaaagaaaactaaggaacttcagccccaaattgtcaaattttgctacttaagaaacagaagatttaaatctatcattttgtcttatattccagagttgactggttcctcctgtctttaacttcttgtccttgaagggtattctaattttcattcagaaatatgacttctcatagggtttgtgttagatattttcagggccagatggatatgatgttcccatttctgttttattgttaaactactattccttttgagctgtaatgaacaattcattctgagaggcaatatatgttttcagtaattgacttgaataaaagtaaatgttaaacatggagttactaagttaatacagtgggtattagtactaatttgttcaaattaagatagaattcttaatttgataaatagaattcttatattacagcatcagtccaattggattgatagtttgtagaaaggtaatttcttacatgaggaaagacaggttttctttctcttagcaaggtattaatgcaaaaatgacctcttcatttcctaccagcttccagaagggaaatgctggttaggaggtaaattcaatttactctacaagcaaacttcacatctgttatgctgaagtcagagtttatctttcttgttatgtggaacctagaaatataccatgaggaatactgaaaaataaactagcagaaattttgcgtgatgctgaggatttttagatggctgcaaaatgggtgaaagtaatataaacttaacaaagaatgttgtcacaactctctggaacttagtactgtttttcaactaacaaatggaagatttgtgagactaggtcgacttaatgtgatttcaatgcagtaattactgtgtggcatgggcatggtaagagataggccttttctagaaatattctcatctctgttttttttagttgctcttacttagatttatattaactcagcttcacattttcatttctttttattttattttaaacaatgagaaaaatactccacgatgtcactgatttagttatcagatttgctttatttctgtatataataggtaatgtgagtacaggaaatatatctgaaaaggttacttgtacctaaattttaagttagatcatttaaaaattacttataagtctcttgagtgttttatatagtagggcagatggaaaaacttatttgatattcatttttggtacctcttaggaaaataattgggaatgtattcagttggaaaaaatgttgagaagagtgttttatataatgattatttagtaaaacattaaaaataatttcttattctggaggtttatagacatcaaaattgacaaagattcatggattatacatttcatcaaggtacctttaagcgattttttaaaaaaaattctgactctaacaatgcatgctcattgtagagcgttaaaaatacaaaaacatgcaaaagaaaaaattaaaattaacatgtgtcatatcacccagcattaactactctataatttttcctgtgtttccttgtagggtttttcccacacatttttatttgtttttatcatatttatttttattccacacactttttattttgaaatgatttacaatctaggaaagaattataagaagagtacagagttctctcctactacacttttgagcattcttgctttttctctctttctgtctctctaaatatatgtgcttaaccatagtacatattcagatttttctagctgtcccaagaatgttctttctagtgattttgttttccaggatcatggatcatgcattgccttaacttgtcatgtttctttggtttccttaatctggagttccttgatctttctccttcatgccattgcatttataaagagtgttgtcaactgttctgtgtatgtaaattcttaaccaattgaaatagattttacatcatttttcccactttatatatatatatatatttatttatttatttatttatttatttttattttattatttttttttttttttggagacagagccttgctctgtcaccaggctggagtgcagtggtgcaatctcggctcactgcaacctccacctcctggattgaagtgattctcctgcctcagcctcccaagtagctgggaatacaggcgcgcaccaccatgcccagctaattttttgttttgttttgttttgttttgagacagagttttgctcttgttacccaggctaagagtgcaatagcgccatcttggcccaccacaacctccacctcctggattgaagcaattctcctgcctcagcctcccgaatagctgggattacaggcatgtgccacaacatccggctaattttgtatttttggtagagacagggtttctccatgttagtcaggctggtcttgaactcccaacctcaggtgatctccctgcctcagcctcccaaagtgctgggattacaggcgtgagccaccgcgcccggcctaatttttgtatttttagcagagactgggtttcatcatgttggccatgacggtctcgatctcctgaccttgtgatccacctgccttggcctcccaaagtgctgggattacaggcgtgagtcaccacacctggccacttaatatattttcaacattttccaatgtctttaattatgtcaattataattttggattgctgtataatataatttattttcattagtcttctagtgttggaaatttttactgtttgttttcttttcagtattgcaaatacaattgggaaataaactttgtaaataaatctttgttgtaattttaatttctgaatctatcaagtatttgttaaaacataaagcaacaaaacaaaaatcctacagaagaggataattaaatgttaatctttttgattctgaatacaattagaatggaaatttggaaaaggggaaaattgccagataaagaggttgccagatttagcaaataaaaatacaggatgcccatttaaatttgaatttcagaagggacacacgatatctgggacatacttatactaaaaaattattcattgcatatctgaaacttaaatatgactgagcatcatgtattttatctggcaaccctaccagtggtttgagtattcgggaagacttcatggtagagataaagagagggaataaagaagatgttttacacaaaaggaatggttgagattacctccaaaacaagagtgaacatagtttatgtgaaatagtctccataaagataaagactttgtgtctcattcactgctgtatccccgatcccttaaacaatctgtacactgtagtcactcaataaatatttgttgaacgagtaaatgaatttgcactataaataaagccaggcaacttgggacaaagattacctgttgtaactaagtagataaagataaaatttccatgaaagtggaaaacctggcagaagaatttggacttcctgccttcccttatttattttataatgattcattaagtgactgttatgtgccacatgcacaggatactttggagaacaaaaacagacatggcttctaccctcatggattttatagtctgtattagaggcagacattcaatttataattcaattattcatttaatagtcaataaatttcaattcaattatagcgtacaacttataaaattgaatttttaatcattcaatttataaatatgagtactgtaagggaaaagtatataatacttacattctgaaatcacacacagtgagggggtattcttgaaagaacctgatcaagataaatgtacatggtgttgtgtcttagggatagatccaatcttttctttgaaatcttcattcattcactaattttccctcgaatttatagaacactctttggactattacacttatacatcttttaaaatctttttatatgtgcaatttagtttacttactagattgtaaattaattaatttatttatttatttagagacagggtctcactcacatcacccaggctggagtacagtggcacaatcaccactcagtggcagtctcaacttcccaggctcaggtgatcctcccaccttaacctcctgagtggcttggactacaggtgcacatcaccactcctgtcttatttttcatatcttgtgtagagatggggttttgccatgttgcccaggctggtttcaaactcctgggctcaagtgatccgcctacctcggcctcccaagatcctgggattacaggcataagccctgcacctggcctagatcgtaaattctttagtgagctgggggtatttcaatttgcttttatcccctattgtttcatgtatgtaaaatatacacaggcgttaattattgacatgttgattcattgaaattataatggggcttttaatagctatagatatgccatgagcacataaaagacgatttcctgattctttgaccctcttaaagaagtttatgatgcctacttgtcattcttgggtccttagaccttctgtggcaatattaggtcggggatagatgtctaatgatttgcagtcagggagctttgataaccattgtcacatgttagcataaatcagaacccaatcacttttttttttttttttgagatggagtctcattctgtcgcccaggctgcagtgcagtggcgtgatcttggctcactgcaacctctgcctcccgggttcaagtgattcttctgcctcagcctcccaagtagctgggatcacaggcatccaccaccatgcccagctaatttttgtattcttagtagagacagggtttcactgtgttggccaggctggtctcgaactcctgacctcaggcgatcctcccgcctcagcctcccaaagtactgggattacaggtacgagccaccacgtccagccgagaacccaatcacttttgactctgccttcaatatatattgcaaatctaactaccttttactacctctacttcttcccttctagttcatgatgccattatcacttgcccagattattacagtagtctcataattgctctccctgcctctggttttgcctctcccctccagcagtgataggaaataatggaagtttttaagtaagcatggtagtatcactggatctgttctttgacacagctggctagtagtgtttggtagattggaataggggcatagtaaatgtgggttgacatggtatagtaggtagtcaagacagtccaacaatcaatcttaaagacatttcattttcttggtagttaaagaatataggcctaccagtacttgtaattttaattttaattgatttatatcattttacttattaatattcatttgaatcttagtttataatatctataatcatatgctatgctcaaatgtaattgagttactttttagagacaaggtctcgctatgttgcaggtttcaccatgttgtccagggtggtcttgaactcctgcgttcaagcaatcctcctgcttcagcctcccaagtagttggatctacagggatggcatgcaccatcatacccagctctgaactattttttaagtaaaattttttttagatgaagacaagcttgtatacaagagtagttaagacagtgtggtactgactcaaggatgtactaatagacaaaggatagaaaacagacccacacacatacagtcatacagttacagcaaagatgccactgggatatagaggagaaaggatagtattgggatcagtggatattcatatggaaaaaattaactcctaccttataccacacaccaaaattaattctatatgattgtacataaatgtaaaatagaacaataacacctctagaagaaatcgtatgaaaatatcatggtcttggttaggcaaagctttcttacaaagaatttaaaaatgttaacaataaagaaaatatagtctggtccaaatgcagtggtatttacaactaattgatcacagccagttacagatttctttgttccttctccacttccactgctttacttgactagccttaggaaaaaacaatttttcaggaaaaataagttggatgtgtcaaaattgaggacctttccccagaagacattgtgaaagtgaaaaggcaaaatataaagtgggcttaagaattatgagaagttcagcacagaggactagtggaagaaaatatgtttgtacataatttctttccctataaccaatactaagaatagagaaccctatatttaactgaaggcagaaaatattttgaggccatatttgttctcattttatgccatttacttagtaaatgtacataccttatagattcatgcatataatatacagtcctcccttggtatcttcaggggattggtttcaggacccctctcacacatacacaggataccagtattcaagtcccttgcataaaatggtgaagtatttgcatataacctatgcatatactcccatgtactttaaatattaatctctagattctttataatacctgatacaatgtaaatgccatgtaaatagttgctataccatggttttttgtattattattattattttttattgttggatttttttcatattttcagttcatagttggttgaatgtggatgcagatacagtgggccaactgtatacatattttgggatcattttagtgggtagtaaaacttggttttccccaactgtttctgttaattcacagccagttatgaaatatgccacatttgtcctgattaaatagtgaaatgtcttagccctttccactgattatattgatagaaaagattaaaaagtggtggataaacctaaccaaaaaaaaaatgttttcataagccactgctgtcagcacttatttgagattttaaaacattttgtagttctttatttttaaatgaccttacattttcaaaagggtttgttaattcaaaaggtctcctatggttaaggcagttcaaatagtagactgagggtagaagagggattgactgtaaataggcatggaggtatcttttgggggtgatgtaaatgttctaaaactggattgtggtgatgtttgcacaaaatttgcacaaaagcattgaattatacactgaaagcatattttatagtgtgtaaatgaatgccttaataaagcttttttttttttttaaggataccattaagataatgaattgtccagccacagattaggagaaaacatttacaattcatgtatctgacaaatgattgtatccagaaatcaataataagacaaatcaatagacaaatagcataatttttaaaaattgggcaaaagacttggacacttcatagagggaaataatctaatggccaaataagcacactaaaagaggatgaacattattaatcattaggaaacacaaattaacatcacagtgagatactgacccatcactcatccacttgaatggttaaaatcaaaaggactactaattgttgacaaggatgcagaacaactggaactctcattctttgctggtgagaccatgcagtgggaccacacatttgaaaaactgtatggtagttttttattttttttttcctggtaaaaattaaccgtacatctaccctatgatccagcaagtcatttacctgagaagaacaaaaacatatatccacaaaaagagttgtgcaagaagattcatagcagcaaacaggcatgttcattaacaagacaatttttcagcacattgtgtttttttttttttttttttttttttttttgagacagagtctcactctgtcaccaggctggagtgcagtggtgcaatctctgctcactgcaacctccacctcccaggttcaagcgattctcctgcctcagcctcccaagtagctgggactagaggcacgcaccacgacacccagctaatttttgtatttgtagtagagatggggtttcaccatgttggccaggatggtctcgatctcttgacctcatgatctgccctcctcggcctcccaaagtgctgggattacaggcatgagccaccgcgcctggcctatgtattcatttaacagtacactactgggcaataaaaataaatgaactactactacccccaactacatggataaatctcaggaacattatgttgaacaagaagagtcagatgcaaaacagtatttgtgttctacattataccattcaaacaaacaaaaacagtctataatagaaatcagaaagtagtttcctttttgttagggggtatagggattgactggtaagagacagtagaaaactttctgggattatagaaatgttctatgtcttgttttggataaccatttaagatccgtacatcgtattttatgtgatcatacctcagtaataagaatgcaaaatgctacaaaagcaagtcaacccaacatctctactaataaatctcaccattttaaaaagaacagtaaatcctacatctctattttgagaaaaaataattataattttatttaatgctatttaacatatgcttatatatgacatataaattgtgaaaagattatttaaacaaattggctaaagaaacttcatgaagaaggtgaatcttttgccttattgcatatgcttttatattgagtaaaaccaaagtgatttcccatggtagcttcttatactctgttctcatactctttcttgtgataaaatggaaactgatgttcttcccatgaaagggtaattatacattaatgtactctttttccctcctgtcctttttttattatgaaatatttcatatatcaaagaatatgtctaacatatgtgtattacaaagtatatcctctgcctccctcctcatttgaagatcctgccaatcctctgcagagctaatgcttattctgactttggggttttcatttcctttcatatatcccttatatatgtagtcctagtaggtgtatacatatgtatatcatgaatagttatatatataataattgcaaatacatcctgtttatttaatgggttatgtttctttaagttccaatacaatattttctaaattagaaaggtattacaattttaaaaaatgtgccaggacaaaattaataccaaattacaagaatggtaaagcttagaacattgtcattgactataaataatagctgcaattctattgttggtttcttttttcactagtccattttgataatatttcttgttgtggccaggcacaatggctcatgcctgaaatcctagcactttgggaggccacggcagatggatcgcttgagctcaggagtttgagaccagcctggacaacatggcaagaccttgtctctatttaaaaaaaaaaaaaaaattgttgtagtgaagcagtgttttctttcccacagaatatcgttcttcatttatttataaaaatatgatttggtatatatgcaaatgtagcttattttatatataaccatactgtaatagtctttgtggtaagcaattcagttaatatgactacaggtttaagatataatgtgaaatttggaatagattttaacttttaaaaaataatttatgttaggctgggcacggtggctcacgcctgtaatcccatcactttgggaggccaaggcaggaagatcacttgagcccaggagttcaagaccagcctgggcaacatagggagaccccgtctctacaaaaaaaagaaaattagccctgcatggcccatgcctgtagtctcagatctccagaggttgaggctgcagtgagccatcaccatgccactgtgctcccacttgagcaacagagcaagaccttgtctcaataataataacaataataatataacttatgttaagggctggtctttctttttctatatttaactgattaaactgattaactgtttgttgtttttttttatgtcataggtgtcagatccagctagcagtgccataagccagaattatagatggaagtgggggagagagagaattgtcagaaaaacttactaagatttctatcctggccaggtatagtggcttatgcctataattccagcattttggaaggccaaggtggaaggatccctggaacccaggagttcgaagctgcagtgatctatgatcatcccattgcactctagcctgggatacagagcaagaccttgtctcgaaaaaaaaaaaaaaaatctaagtggcttcatacagaaagtttaaagttaaatgtatactgttatgaatatcttattaaaatgcaagacaatcagagactgatctaaaagtaatcaaggatgatcatgtcttgggagtatcctgtttctcagttgctctggacagaaagcacctagaaggttgagataattcaatgcaaaatcagagatttccccccatgtaatcaacctcagaacttgagttggtcctaacagtagactcaaccccttggaaaagactaggcagagcaattttcctattgactacatctgagacgccattcattcttgtgtcacatgagacatagcatatactttttaggtctctaataatagcagttctctaagaagcaaactgggatgaaagacactattcacttattttcttaaatggggaaggcattaaaaggagtgaaggtttattaatgccacttttaaagatataaatagtagatttttattctaataagtcatacatcaataaaatttgttattgcagctccggggcagcaattacttatatattgacaacttatacatgttttacatgcccatttgctctccttttcactactgaaatgtagttaccatagcaatgaacacatcacatggttcctgtgctagttctaaaatagagaacagcaatatgccatatgagctctgcttattttctacgtaaggactgcatatacaacttgaggctattccataaccttctcagtgcagatagcttatcattgatttagaaagctttcaaagtaaaaagcaattggcagtaatatatttcaagtctctagcttctcttgtactgttatttgccactgagctaaaagaacagtttcactagctttgaccaccagggactctgctgttgtatatttagccatagattgtctatggaatagcagtgccacttagaagattggtgggagaggcatatatagcattcatggacacattttctaagtcttactgagcaattcttaaccaatcttagcttttctcctactgtctcccttaatgtttcaagtttttaaaaatataggactctgttttagaatttgaggaaaggaagatgccaggcacaactggaggcatgctattagttccttttatgtccattattgttgtgtaaggttttaaaatgcattggttatatagcagtttatctatagaaaaggacttcagatttcagtgcctggtggtatcaggccgtatttatgccttactatcacatttagagtgtgttgtaggctgtcagacctccagaaataaagtaggaacatacccctcttactgtgactcttaccagatacttatttgaaacagtccaagcactggcatattagggaatggtgctaactctttctaaccattaataagcaaaataaatttcaatgtgagcttttggctatactatacctatggtcaagtggcactacaaattcaaaattttaaatattctttattgaaactactaggaacaactgttttatatatagtagaggaaaccagggctttattctcttgactgaaacgtgtaagaagtgattcataggtcttcaaacacaaattagtaaatttaggaagctaaaaaggcatatatatttgactactgatgggggcaatatgttgattgtgtaatatttttatctaccctttcatctcagttataatttaaaaaccatttatatactacataaactatgtaatattggatacttctgtgtctatataatttgcaacaaagtagaataaatggccagagatgttattgtaatcttatggttgaatgttatttcttttttctaggtcattgtttaaaatctggacatcatagaaacagataatgcagagagaaaattctttcataattccaccacatctcaatctttgttattagttttaaaatatgtccttctagacatattttattgtaaaaagtatttaaaatactcattttattttattgccgcaagagagagaagggcatttattgtagggcaccaagcaaggaagatgggcagctcatgcttaagacccaacctccctgctggcttacaagcatgggtttttaaaggcaggggtacatttcaggaaagtagaagttacaggcaaaattgttaatcaatacatagaggttatacatgggttggctcaaaaaggagtaaggttttgagtgggggcttacaggtcatcaatggattaggagattctttgatttgcagttggttaaggaagaaaggctttgtctaaaaacttggggtcagcagaaaggagtgttgaggtttggccttaacataggttagttaggataaggaaacctgttaatcattatggggtgctatgtcagggtcaaggtatgagagcaagccacgatgcactgggtcagagtgaccagtttaggaaattgatagcccacaggtgtgactctctccaggcccctcaggaagcaatttagaacaaagagcagcagtcagagttcagtcttcagtttccctttatcaaaggtctatgtgacagcagttgacattttcttttttctgttttcttaaatttatttattaaaagaagtgtctcattctgttgcccaggctggagtgcagtggcacgttcatagctcactgcagtctcgaactcctggcctcaggcaatcctcctgcctcaacctcctgagtagctaggactacaggcacatgccactgtgcccagctcatcattttctatctggtgggtatgctggcatgttggaggaaggacctggcgagaggtgcttggatcatgggggcagttttccccatgctgttctcatgacaggagtaaattctctcaagatctgatagtttaaaagtgtgtggcagtttcctgctcgtgctctctgtctctcctaccactgtgtaagatgcaccttgcttctccttcaccttcagccatgattataagtttcctgaggcctccccagtcatgtggaactatgagtcaactaaacctcttttctttttaagttacccagtctccggtagttatttatggcagtgtgaaaacaggctaatacacttggtttctgaaaagtaatttggctggctttgaagtggggatgggccatgagccaaaggatgcaggcacttctggaagctagaaaggcaagaaaagattatcccttggagcttcaaaagaaatcaaccctgcatgcaccttgattttaccctagtgaggccgggctggacttctgatgcttcagagacaagggttcctccctcatctgtctcaggaagacttaggactaactttaggctttgaagtaaacagaagctgaaacatttgaatgtttgattttcatgatccagaactcaagcctcataggtcccatgcattccctgaacccaataggatgtcacagtctgcataccttcacaccatggcagtctggcttcttccctctcaggcctgcagcctcatgctctgggcttccctggaagctggtgttgtgggggcctgcagttgccaccctgctgtgtgtcagcactgctccctgacgctgttcatccactgacctccattccttggcccagctgcccaggcatggcagactacacgcaacctgggttgtggggaccaggcggagccagcagcactaggacctgatggccaaaacactcattttaatgaaatcatactttaattctgttttgtatcttctcacataaaatagctagatctcttttcctagtagtacaaacttatctatctgccttattttgtataagagtggtattatatgaatacatcattgtttattcttctattgaaagcttttatgttgttttctgggtttttgttattatagttctgtagtaatatgtcttatgtacttttgtgtaaatagttctataggctcaatctccagaattgaactgccaattcttagtaaaggaaaatttaacttttgatacattttaccaaactgccccttcaggggattctaccaaatcatattctctgtttaaatgtctttttaagctttgccaaactgatatatttaaaatggtattttattgtttcaatttgcagttttagaggtaatgttgtaattctatatcttttcatattatagtgcatttatattttcctcttctcttaactccttgtttgcctagctttctttttcttttggttggttcaatttttccaactaagttttttcatgttgtttttttttttctttttcctttgtatttgggaaataaatccttacttgtaaatacttcttgcagtttgtccattgactttttttttgagacaggatcttgctttgtcgtgcaggctggagtgcaatggcatgatcacagctcactgtagcctcaaccttgcagccctctggccacaggctcctgagtagctgggactacaagtgcgcaccaccatgcccagataatttttttaaaaaatttttttgtagaaaaaggacctatgttgcccagactagtctcaatctcctgagctcaagtgatcctccctccttggcctcccaaagttctgggattgcaggcatgagccaccatacccagcctgtctgttgattttattttcggtgctttttttgtatatggaactttttctattagtatttagtcatatttgttagtcttgtcctttatcccttctagcctttaccttatttagtaatatcagatgatgtgtttcatatgggtctaatttatgcattcattcacttacagaagctaatcatttgagtcctagtgtaccaagtatcttagatgatgggtcattgctgactgtacaatctaagaagaatcttatttgcaacaatgatgctttagcgtagcagcagaccaaattctctaggatgattagcagctaattctgaatattgctgtaaagtcatagtagcatgtaacatgtacagcaatagtaaaaacatgtaacagtttgttccttcctaaaattttgttaatttagtcttttatgtgtccttatatttataaatattagttttgtggctaaaatgtgtacatttttccaagttatagtattgagaagcatagctagtagcatttcacccaacagaaaaaattcctttagataaaagccaaatcacagttggcctcattctacatactgttctacaaattacaaaatcagtaaatgtttattgggtacctgtttttattgctaagctcttgcaagagaaagagagaggtggtaggatttttttaaggtgcgagctattatcctatttttaaagagctcataatctagtttggaatgtttggcataagtacatccaaaggtaaataataaaacaaatgataattgctcaacaatatgtaaagacccccctctccaaaccaaaacaaaacagaacaacaaaattgtcagtctcttctgtgagcagtattatctgctgaggacatgttactggtcgaagagctttggctgcagtcattcctagaatgcaaaatgaaatcatccaaaaaactgagagtggccagttttactagtcaaatggagtaagtggtcatctgtgagtttgtgaatctgtctgccagaatatatttattttcttgcttattccaccagttactccttcttgttaaagctttcaccgttattaaagagaagtacctcctggaaattttagcctgctagatgttgtcaaacctgatagcacagtgtgataggctaagattctttgttcatttgttttggatagggaaggaaagacacaatgaaaagactaggagtctgaggtgagggaagatgatgaagaatatgaatcaagggatcaggcatcaagataaccgttcatttatttaaatgtagactttatctgtcttgatcaggcatcaatataacctacatttatttaaaagtaaactttatttgtctaatgtatgtgttcctaatccctgaatctattcatttcattgaaattgatgagtactttcaatacaaatagttacaatattttaagatgttcactgtttataacatcattatatgagtccatgttaaaccagagaagcagaaccagtagacaatatagatttagagatttgttacaaggaattggatgatggaagtatggaggctggctaagcgagtccaaagcccagtcaagaggaaagcaggctagaaacccatgggcataagctgtttagagtccctcagctcagggaaagcctaagctctctttcaaagggctcacctaactttgccttgtaattttctataatggattcctagagtttaccaactaatatgacggtctagagttacatttaagtgaaatttgattgtgagattgtattcttaactgtctatatctggtgctcttgagcacgtatacaaccttctcgccttctctaggtccctaaaagtcatttcttaattcaaaaaatatttaaatgcctgctatgtaccaagcacttctcttgatagagtggtgagcatgacaatctagtagaaaagtgagacagggaaacaccaacattactgtggaaaacatagttacaggggaagtagaaggacattagtcatgtttttttcttcatgacccactgcctaacacatagtagatgcttaataaatgccttttaaataaataagaccacatggcatttttaaaggagtaaggacctctttaaaaataagtatatatggggaaggaaagagatgatgagaagactaggagtctgagtcttgctacagaactagggtaactggagctagtagaaaagcaaagaagcttctgatttggggatggattcaagagtatattgggatgggtgcaaacactttcactgattagcagtttacatatttccttcaaggatagtcttactctccttgtcctaacttttaacctttgcttcaaattagtttagcagtttgtactaagaggaattgccagtgaccaagtgaatatgatatacatataaaagaacagagaaaatcaagtctttactatgttgctgtatcactaattcaggcttccagctaaatgccagaacataaattaggtcccttatcaaatctggcacaaaaatatttaggatcctttttaatatagtacatgtgctttcaataaatgcctgctttggcaaaaaataaaaccagtgttttttgtgtcaagtacaagctgttgtactctgtaacttttaaactgtccttgtgaaccaggttgagggtaaaattaaatttggattttgtattcagttttacaatcaacaaataccattttttttctttgtgttgtgttgtcttatgggtgtttgttttattttggtttggttttggtttggttttcacttagaacaaaattcaaaatctactaaatactccctagccacactggcctgttttcagtttgagatttttttatttttaattttttttaaagatgacatcccactgtgttgtccaggctggagtgcggtggctattctcaggcatgattatagcacaactacatccttgaattcctgggctaaagaggtcctcctgcctcagccactcaagtagctgggactataggcttgcacctccacacctgacttctttctgtttttaagacagttgagctctttcacctgtcccctcaaactgtttgtacatgctcttccctctgccttgacctatttttacatcatgttcagtgttactcacccatcttactctcactaatttattaagtctcaaatattttctcagagattctttcttcacccatgcctccatatctcagttagatctcccttaaaaatctcttctgtgttactagttcctagcatatagtggatgtgtgataagtgaaaggatggactgaaacatagagcacatacaataggtatattctagtcattataaaatgtcctcaaggaactttcttaaatctgagttccaaagggccatgttattttgtaaataatattcttacttttactttagggaacaaaatcagcatttttaaatgaaatagatttaaaaatataggcatgtacattgtataaatgcatgtatacatatgtctaaatatggcaagttgcaaagtaacatgaataccatgattgctgtcataaaccttgaaagccactgtgttagtggatactgttgtataataatctccaaataagcacgtctagaaaacaacctgttttacttatcaatttccccaaacatctctctggtgactgcgtctttggcttcttttttatttatttatttattttttattattatactttaagttttagggtacatgtgcacaatgtgcaggttagttacctatgtatacatgtgccatgctggtgcgctgcacccactaactcgtcatctagcattaggtatatctcccaatgctatccctcccccctcccccaaccccacaacagtccccagagtgtgatgttccccttcctgtgtccatgtgttctcattgttcaattcccacctatgagtgagaatatgcggtgtttggttttttgttcttgggatagtttactgagaatgatgcgtctttggcttctaagagttctttgctgagagtaaagagccagaatctcagaaatcccccagaaagacgatttaagttaaatgcacccatcaagctttgaaggaaggcggcttaaaaaaagaaaaacactatattacattctacttttaattttcaaaacctgaaaaccttctcaaatccaggaaaactaatggtatttccatctattctctttgatagcccacaattcctatgattttcttagcatcccataatacattttgcttttatccttttactgtttttcttcctagaattttctttcaaggtccaacacagaaatcctttttctcaacaaacctttcctgactaaccctgtttccttttttaaaattctttgcattttctcaacagtttttgatatttattttttaacgtttgtatacaatactataatacagtcagttatttataactttattttgtgttagaagtaggttttttgtgtgtttgcattcttcctaattttacatgtgcaaaaagttactttaatcttatttttcttaaatgaaataatccaattttaaatccctttcctggagaattaaatataagtcattttgggggtgctttccttcacctcccccagaatctcacacaaaataaaacattcagagaattaatcgcccctgccccaccccaccctaatcttctgtccatgttggctgtcctgagttgtccactgttaaaccacataatcccttatagttcagtggctctgttgcttcttaggacatgaacatcttggccaaggcttcaatagctttctgtgttggatattttctcctggcatctccagatagactttttactcttttctttccctattctgtgcccaaaggccctgagaaaattgctaagtattagtaacatggagaaaaaagggatatagtttctgggactgtaaattattcaaaggatagttttaaagctctgggaaagtttggtgaaagttaaaaacgtgttcagagaggaggagttggagcctagtcaagtcacaaatcttctaattcagccaagctctagtagcactcctgaaacattactactatatccttaacatgtgcttttttagttcatgaaacaatattggcataactgttcccctaacaacttaatgagaaagttaaagattttaacaactcaagattgctgcctatgatacttatgatttttaaacaagttgtcatatcaataataataataaaaaaaccataaacctagctgggcatggtggctgacgcctgtaatcccagcactttgggaggctgaggcgggcagatcacctgaggttgggagttcgacaccatcctgaccaacatggagaaactccatctctactaaaaatacaaaattagctgggcatggtggcgcatgcctgtaatcccagctactggggaggctgaggcaggagaatcgcttgaacccaggaggcagaggttgcagtgagccgagatcatgccattgcactccagcctgggcaacaagagcgaaactccgtctcaaaaaaaaaaaaaaaaaaaaaaccatgaaccttcctttaggaaatagagcaatgtagtataaccccacttgcaattttatttttcagattaatgaatatgattaaaattaagatggaataaaaattaaaacaattaaataaaatacaaattggttgtataataaagacaaaattgttatcttgagacacatgttgcatctttccatatgttctaaaattccttaggaacttggcacaagtgctgctgaaataatttctgactgataagtggcagatgccttatcttttattgtggtattaattctaaatcccatcaaataagacaatgcatgatacaaaggataaatttataagcatttgcctcccaatttagacacagaatcattatcatagtacattcactttcaacttgtttctatgttctttctctccttcacatctggcctcttcatgtttttattttctctctctctcttttttttttttttttttttttgtggagacagtctcactctgtcacccaggctagagtgcagtggcacgatcacagctcactgcagcctccaactcctgggctcaagtaatcctcccacctcagcctcctgagtagctgggaccacagacatgcaccaccacacccggctatgtttttgatgtcttgtagagacagggtctcactatgtgagaggctggtcttgcactcatgggctcaggcagtccttcctcagtctcccaacgtgctgggattacatgcgtgagccaccatacctgggcctgttttctctttcttttcattctaaccataatcacttatctatttatggtttttgtttctatttctgaatacatttaaatgccagttataaaatcagaaattcttatttgtgcttaaacatagtaagatttagcagtagtttgaacttcaacatgattattaaatgtggattttaatactagtgatgattcacattttccaacttttatactttacaatttgtttttcttgatgagagtttaggtatctatgaatgaggagaaaagttaattgaattttggcttctagaaacaagtaattaatcttttcctgttaccttttaaaaagatactttactttttatagaaagatagcagtagaaaagaacaggtatttaaatctactcactgacttagaccaattatttcataatggaatctctacttctgtgaatatgtgttttgcttaacgagacctcctaaaaactcatttttatggtcattgaattttagagttagaaaagactttagaaagtgttattagcctctcattttttaaaaacagtttgtatcttgcccaaagtcacactaggggtaaagtaagaggcaaaggaagaactggaattcaagtttctagattccaagtccaggactctttctttttatctcattattttatgaaacatggagagcaagctgattgttcatttaagttcattacactgtatcttggaatttgtcatttctatgcttcactatttaaattaaaatattttatgtttatcacctgttttttgatctgccatgtaagaattttcacttattgtcttccctttaacattgagtctgcatactgctgctaaataatctttctacagtatagtcctaattatgtccctcaaaaaccataatatatctcaccccttctatcagccacatagttaaataaattaaatccaatcatttaacccattgcagactaaatctgcctttcaaatcttagtactttccactcctctgctcatattttatgggccaggcaaatggactacttacttgctattctcaggacacacgtctcatttttcataccactctatcctttcttatacatataacaactttgcctaaaattgtgcccatttgttgagactttgatcaaatttcacatttcccatttcttttgttctctctctctctgttttttttgttttttttgtttttttttttttttttgagatggagtctcgctctgtcgcccaggctggagtgcagtggcgcgatctcagctcactgcaacctccgcctcccagattcacgccattctcctgcctcagcctcctgagtagttaggactacaggcgcctgccaccacgcccagctaatttttttgtatttttagtagaggcagagtttcaccgagttagccaggatggtctcaatctcctgacctcgtaatccgcccgcctcagcttcccaaagtgctgggattacaggcctgagccaccgcgccaggccctattctctctctttttaattccaattacagtgtagtacaagcttgtccaaactatgacccatgggccacatgcagccctggatggctttgaatgcagcctaacacaaattcataaactttgttaaaagattatgaggtgggtgttgctgggtgtgtgtgtgtgtttagctcatcagctgttgttagtgtttgtacattttatgtgtggcccaagacaattctttttcttttaattgtgaccaaaggaagccaaaagattggacatcctttatgtattatattctgactttaaatattgctttccccttaatttttttttcattgtcatctcctcactttattgcaagtacagtcagcatcaatgttgagaactttttctcctaggaggtacaggatttggctctgatacggtgttgcctccacagttgctcagaatctaggctccatctgttacaggaaaggggtcctaatccagaacccaagagaaagttcttggatcttgcacaagaaagaattcagggcaagtccacagtgcaaagcaaaagcaagtttattaagaaagtaagagaataaaagaatggctactccatagacagagcagccctgaggactgctggttgcccatttctatggttatttcttttttttttttttacatgttctattttttaataaaaatatttatttggtcttatgaatacagaattattttatttttatttcaaatgcctaggtattataattctgtataatagttatttgtactttttatatttttatcttttttttattatactttaagttttagggtacatgtgcacaacgtgcaggttagttacatatgtatacgtgtgccatgttggtgtgctgcacccagtgactcgtcatttaacattaggtatatctccaaatgctatccctcccccctcccccaaccccacaacaggccccggtgtgtgatgttccccttcctgtgtccatgtgttctcattgttcaattcccacctatgagtgagaacatgcattgtttggctttttgtccttgcagtagtttgctgagaatgatggtctccagcttcatccatgtccctacaaaagacatgaactcatcattttttatggctgcatagtattccatggtgtacatgtgccacgttttcttaatccagtctatcattgttggacatttgggttggttccaagtctttgctattgtgaatagtgccgcaataaacatacgtgtgcatgtgtctttatggcagcatgatttataatcccttgggtatatacccagtagtgggattgctgggtcaaatggtatttctagttctagatccctgaggaatcgccacactgacttccacaatggttgaactagtttacagtcccaccaacagtgtgaaagtgtttctatttctccacatcctctccagcacctgctgtttcctgactttttaatgatcgccattctaactggtgtgagatggtatctcattgtggttttgatttgcatttctctgatggccaatgatgatgagcattttttcatgtgtcttttggctgcaaaaatgtcttcttttgagaagtgtctgttcatatccttcgcccactttttgatgaggctgtttttttcttgtgaatttgttggagttcattgtagattctggatattagccctttgtcagatgagcagattgcaaaaattttctcctattctgtaggttgcctgttcactctgatggtagtttcttttgctgtgcagaagctctttagcttaatcagatcccatttgtcaattttgacttttgttgccattgcttttggtgtcttagatttgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacttatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactatagccttgtagtatagtttgaagtcaggtagcgtgatgcctccagctttgttcttttggcttaggattgacttggcgatgcgggctcttttttgattccatatgaactttaaagtagttttttccaattctgtgaagaaagtcattggcagtttgatggggatggcattgaatctataaattaccttgggcaatatggccattttcacaatattgattcttcctacccatgagcatggaatgttcttccatttgtttgtatcctcttttatttcattgagcagtggtttgtagttctccttgaagaggtccctccttgaagaggtccttcacatcccttgtaagttggattcctaggtattttattctctttgaagcaattgtgaatgggatttcactcatgatttggctctgtttgtctgttattggtgtataagaatgcttgtgatttttgcatattgattttgtatcctgagactttgctgaagttgcttatcagcttaaggagattttgggctgagacgatggggttttctagatatacaatcatgtcatctcaaacagggacaatttgacttcctcttttcctaattgaataccctttatttccttctcctgcctgattgccctggccagaacttccaacactatgttgaataggagtggtgagagagggcatccctgtcttgtgcccattttcaaagggaatgcttccagtttttgcccattcagtatgatactggctatgggtttgtcatagatagctgttattattttgagatacgtcccatcaatacctaatttattgagagtttttagcatgaagagttgttgaattttatcaaaggccttttctgcatctattgagataatcatgtggtttttgtctttggttctgtttatatgctggattacatttattgatttgcgtatattgaaccagctttgcatcccagggatgaagcccacttgatcatggtggataagctttttgatgtgctgctggattcggtttgccagtattttattgaggatttttgcattgatgttcatcaaggatattggtctaaaattctctttttttgttgtgtctctgccaggctttggtatcaggatgatgctggcctcataaaatgagttagggaggattccctctttttctattgattggaatagtttcagaaggaatggtaccagctcctccttgtacctctggtagaattcagctgtgaatccatctggtcctggactctttttggttggtaagctattgattattgccacaatttcagagcctgttattcgtctattcagagagtcaacttcttcctggtttagtcttgggagggtgtatgtgtcgagggatttattcatttcttctagattttctagtttatttgcgtagaggtgtttatagtattctctgatggtagtttgtatttctgtgggatcggtggtgatatccccttattttttattgcgtctatttgattcttctctctttttttctttattagtcttgctagcggtctatcaattttgttgatcctttcaaaaaagcagctcctggattcattaattttttgaagggttttttgtgtctctatttccttcagttctgctctgattttagttatttcttgccttctgctagcttttgaatgtgtttgctcttgcttttctagttcttttaattgtgatgttagttttgagcctatgtgtgtctctgcacgtgagatgggtttcctgaatacagcacactgatgggtcttgactctttatccagtttgccagtcggtgtcttttaattggagcatttagcccatttacatttaaggttaatattgttatgtgtgaatttgatcctgtcattatgatgttagctggttattttgctcgttagttgatgcagtttcttcctagcctcgatggtctttacaatttggcatgattttgcagtggctggtaccggttgttcctttccatgtttagtgcttccttcaggagctcttttagggcaggcctgatggtgacaaaatctctcagcatttgcttgtctgtaaagtattttatttctccttcacttatgaagcttagtttggctggatatgaaattctgtgttgaaaattcttttctttaagaatgttgaatattggcccccactctcttctggcttttagagtttttgccgagagatctgctgttagtctgatgggcttccctttgtgggtaacccgacctttctctctggctgcccttaacattttttccttcatttcaactttggtgaatctgacagttatgtgtcttggagttgctcttctcgaggagtatctttgtggcattctctgtgtttgctgaatctgaatgttggctgccttgctagattggggaagttctcctggataatatcctgcagagtgttttccaacttggttccattctccccgtcactttcaggtacacaaatcagacgtagatttggtcttttcacttagtcccatatttcttggaggctttgtttgtttctttttattcttttttctctaaacttcccttctcgcttcatttcattcatttcatcttccatcactgataccctttcttccagttgatcgaatcggctcctgaggcttctgcattcttcacgtagttctcgagccttggctttcagctccatcagctcctttaagcacttctctatattggttattctagttatatattcatctaaatttttttcaaagttttcaacttctttgcctttggtttgaatttcctcctgtagctcggagtagtttgatcatctgaagccttcttctctcaactcgtcaaagtcattctccatccagctttgttccgttgctgctgaggagctgcgttcctttggaggaggagaggcgctctgctttttagagtttccagtttttctgctctgttttttccccatctttgtggttttatctacttttggtctttgatgatggtgatgtacagacgggtttttggtgtggatgtcctttctgtttgttagttttccttctaacagacaggaccctcagctgcaggtctgttggagtttgctagaggtccactccagaccctgtttgcctgggtatcagcagcggtggctgcagaacagcagattttcgtgaaccacaaatgctgctgtctgattgttcctctggaatttttgtctcagaggagtgcccggccgtgtgaggtgtcagtctgcccctactgggggatgcctcccagttaggctgctcaggggtcagcggtcagggacccacttgaggaggcagtctgcccgttctcagatctccatctgcgtgctgggagaaccactgctctcttcaaagctgtcagatagggacatttaagtctgcagaggttactgctgtctttttgtttgtctgtgccctgcccccagaggtggagcctacagaggcaggcaggcctccttgagctgtggtgagctccacccagttggagcttcctggctgctttgtttacccaagcaagcctcggcaatggcgggcgcccctcccccagcctcgctgctgccttgcagtttgatctcagactgctgtgctagcaatcagcgagactccatgggcgtaggaccctccgagccaggtgcgggatataatctcctggtgcgccattttttaagcctgttggaaaagcgcagtattgaggtgggaatgacccgatcttccaggtgccgtctgtcacccctttctttgactaggaaagggaactccctgaccccttgcgcttcccgagtgaggcaatgcctcgccctgctttggctcacgcacagtgcgctgcacccactgtcctgcgcccactgtctggcactccctagtgagatgaacccggtaccccaaatggaaatgcagaaatcacacgttttctgcgtcgctcacactgggagctgtagactggagctgttcccatttggccatcttggctccgctactttctttctttttttttttttttttttgagaaagattctcactcagccaccaggctggagtacagtggtgcgatctcagctcaccgcaacctccatccacctccgacattgaagcgattctcctgcctcagcctcccaagtagctgggactacaggcgcatgccaccacgccctgttaatttttgtatttttagtagagacggggtttcaccttgttggccaggatggtctcgctctcttgacctcgtgatctgcctgcctcagcctcccaaagtgctgggattacaggcatgagccactgtgcctggccattcttgctactttcatagcaaaacatttggctttggctttgctattctgctttattgtactctttgatatccagtatctaccagtaatgtctggactgcatacatcgttgaaaatacaactgtaattaaagatttaaatgcaatattctttcaggaaaatctctttccctgattttgtttgatattggaaatgaaacaataccataatccttcaggataacttcccacagcaggacaactgcaggaatggcacaaaatatgaattgcataaatactcttatagaacacatcagactagcactttcccaagtttttagtcagatctttgctaccatccctgaaactgttaatgcatatgagtagaaaaattttttacctttgtaagcaaagattctactactagaataatcaaattaactcattctaatgcacatttacttaattcatactatgtgtgaggcagttttaggatgtgatagaaaactttgttttgaagaagctgataaactaggtgggggggaaacagagtacaaataaattataatgcaacataagaaatagcataatagaagaatattcagaccactaaagtcagtcaactctgatccccaaaattaagtatgaaccacaaaaaaatcaagtcagtgtcaatctaatgcagatttatttgagggcttctcttttcttctttgcttaatgtaggtgagtgctttatccttgctatttggtaaatcagcaaggatttattatctattctttgcagagtagtatgttagatgctttgaggatactaaatgaaaaagagtttctgcaccaagaatgtataatctagtagaggagataagctatctatacaaataactgtgtctgcagtctgcacataattgttataaaagaagcctttacaacttgagccaaattcttttacaatgcagaaagccactcctggaggtagagaaaggagagaacatgaacaattcaagaagacttctgttatgcaaaagatggctgaactaaccctggagggatgggtaggattttgacaagagtggttgaaggtattctaattcacttagtacctacatgtgcgaggcagcatgaaggcaaaaaagcctggggcatgttcagagaatagcaagtattctagtttgagtggcacctggtacgtatataagggaatagtaaaagatctggctggaaaggaaaagtaggggcaggttacgaaggacctctgaaagtcagactgtggaactggaacttttatcaggaagcagtagttagttttttcaagcaaaagctaattagagttgatatttaggaggatgaatctaacagttgtgtgcaaggatgccttcaaactgagtgagactagtactggagactggttaagagactacaacaataacctgagtaagaattaatacaggcctgacctagttttgagtgagtaggattggaaacaagagttttaggtattataggatttatgcatataaaatggacttgacagaacttgaagaaagagaaagtgtcaaaaggacacagaaagtgaggcaggatatcttacaatgttaaaggaaaggaataatagaagttaccccccaccccagagaaaaaaaagtaaagagaaaagattggaaagttaaaaactgaacttttagagaaagactgcatttagggaatgtagcaaataagataagcaacagaaaagtgagagaatgggaataaagatatgcaacagaaaagaagggaagagagttcctaggaaagggtggggaaattcaaattctaaaatatcgatgaagtctcatttttcatgtattaaattatccagtggagttggaagatccaaaagagagcaattaaatatgctagagtgcatggggaaaattgacaaaagacctaaaagaaaaatatttaaccacaaaatgaaaagtaataggagatgctaagaaattttggatgggagttaaaattaaatctctgaaagaataaaagggaattaatactcaatttatatcttaaataaatatttctaaatgttacactatgcagaaatccttcttccctggaaaaaatgagatcaagtcctattcaaaaaggtcaagaagaaagactgaggttggtgacccgtgagaaaagtttctgagataagtgtaggtggaatttgtagtattatttatcataagtcagatggctgttaacaaaaagttaattttacatctcatctgttagcccagtcgctttataatgttcggtacaacagaaatgccactactttgtaaccacctaaatgctgtattaccttcaatttccattgtgttgttgatacccaagcagaactcattctttgtcatggagactacagaataccacaagcaggcactaaggttggataatgtgttatctcacattctgaaaggagggtctacatggtagatacatttcttgattctgttttgggataattggctcctaagataattggctatttcattattaaatgcagtatgaactttgcagaagtattcagtatctcttaaaacctgtttcttttccatatagcagtggtacctactttcaatttagtatttattcaccatctactacatgctccacttagtgttttgtattatttctctgtgtgtgtgtgtgtgtgtgtgtgtgtgtgtgtgtgtgtgtgtagtctaacttgtacatttggccaatttctttttcaagcatgttagatttttctctctgacttctttgtagatgtggggtagttttgttttttacttaagagacctgtattgattatttctatggctgtccttgctaattcccactggccattgtgaaaaatcttgtctatggtgtatttgtttctaagacagccacattacaatacactctgtacataattactatgaatcagctggcaagaaagaagaaaataatactggttattggtaatatttgttgattttatatgttagctttattaaagatttttttttcttatcttttttctttcaactattgctacctctgaagaggcttttggtagtatttagatgggttgtgctatccataggtaaaaattctgacctgggggatattacctttatttttcactagatgtaggaaagtagatgctgctctgtttttactccattttgttacattaaaaaaaaattacaatgtagtcctataagtttctttttttattttatccagtactattttagactgtgaatattactggaatttctagttctattccctcttctccctctaaaaatcaaaagtgccaaagagtagtagaccttttgtgatatgttctagtcaaaatagctaaaaactagcgctctctctttaaagttcatattcatctagaacatctcacaccttactcttaccactttactcacagtagtttaaaaaataaaactgtaccctgtatatttgttcatttttgtgttttatgtagagtttccattttgtttttactttttttcaagagtgaattttgtaaaacttccagagtagagtaagttacggccattagagtagccctggaggatgagacttatagtggcaatgattatcacaccttgacaacttgggaagggccatgggatgtggatgtggaaaatatataaaaggacattggttcacatttgaacaaagtggaaggaattattagaaaagcacttaacaagggtgctgatctctccccatctgaggtcttctttcttcttttcatctaattttaagcactgatcagtgaattctttctcattattttacataagcaggtatctaaacttataaaaaattgattatttatcttgtcttttagtgcctttttattaatataagttatttggtttttaaattgtgttgccaatgaatgaaggaagtcctgtcaaaagatatacattttacttatcttaaggctaacagccaccatgtccagcctagcaaacattttttttaatgaaagtccaagtagtatggtctctgttaagctactctacttcaactctgtctgtggtagcataaaagcaaccatagataatatggaaacaaatagtcatttgctgtattccaataagactttataaaaacaggtggcaggatgaatttgtcctataggctgtaggttgctgatcctagcataatgtattgattatacattatggtagagccctctgttggttggaagagaggaccagggaaaaaaaagtgaagatgtattagctatacagaactttctagttggtaagacaaaaagcaagaaaattacagtaatatagaatatgtaaaataaaggaggattcagaactgagtaggtaattcttcagagcatgtcaaatgtagattatggtaaagtagaatgtttatggtttaatacatcaagaactatatccttcataaaataaaatgtagctggacatggtggctacatcttagccaccatatttttacatgtacatgtttggtacaggcttatggtggcatgtaattccaacattttgggaggccgaggcaggtggatcacctgagatcaggagttcaagaccagcctggccaacatggcaaaaccccatctctactgaaaatacagaaattagccgggtgtggtggcgtgtgtctgtagtcccagcttctagggagactgaggcatgagaatcgcttgaaccggggaggcagaggttgcagtgagctgagatcatgccactgcactccagcctgggcaacagagtgagaccctgtcttaaaaaaaaaaaaaaagtgaagaacaaggtaagacacatttaatatatctgatcaagtggtcttgtccaaaaaatgtcctgatacatttttttaaactaataaatggaggattgcagacttactgaatatggcaggatcctttagcatgtaatactttaaaatggatccacactgaacttctgctggatgtactggagtaagagtggccagatttatcctccctcctcaaacaatgcaaaaaccagacaaggtatataacataagagtttttagacactagacaatactgggcagtgatccctgagagaaaatgaatgaggcatccctacaatttccatagcattctgcctagatagcttccagtctgtagtctgcaggaaggagatccaaaacagaaagaacccagtggcccaactgaatggagacaaagccaaggtggctagaatttgcatgagacagtgcgagagaagacagagctccacagagatagagcacacacactggatatctgcagagggctccccttgatttttaagccaagtactgaaccacataagtatgctaggaaactacttagggacagggataaagccactggaaaggaataagtggaacatttcctgaactcagataagattaataatagtttatagccccaataatcacagtggaaaagcctctaataaattggacatcttttttagtactcaaaagaatattacatcagttggggacaatattagctctagattaagagctgctctcatctcacctagtaaagcttctaaataagcttgtaaagaatcaagttgtttttgagtaaccaactgaatttcagagtaaagttagggccattagagtagccctgaaaatatataatgagaaacaaaatatttgatatggtttggctgtgtccccatccaaatctcaccttgaattcccacgtgttgtgggacccagtgggaggtaattgaatcatgggagcaagtctttcccatcctattctcatggtagtgtataagtctcatgagatctgatggttttaaaaagaggagttcctggccaggcacggtggctcacacctgtaatcccagcattttgggagtccaaggcaggtggatcacttgaggtcaggaattcaaaaccagcttgaccaacatggtgaaaccccatctctattaaaaatacaaaattagccaggcatggtggcacacgcctgtaatcccagctacttgagaggctgaggcaggagaattgcttgaacccagaaggcagaggttacagtgagctgagatcatgccattgcacttcagcctgggcaacaagagcaaaactccatctaaaaaaaaaaaaaaaaggagttaccctgcacaagctctctctctttgcctgctgtcatccatgtaagatgtgacgtgctcctccttgccttctgccatgattgtgaggcttccccagccacatggaactctaagtccaaataaacctctttcttttgtaaactgcccagtcttgggtatgtctttatcagcagcatgaaaatggactaatacaatattctacacctaaaacataaaattcataatgtctgttatccaatcaaaaattacctttcattacctgagaaaggcattgttaaaaaataaataagtaagccaggcacagtgacaaatgcctgtagtttctagctacttgagaggtggaaacaagaagatagcttgagcccaggattttgaggccagcctgtgcaacacagcaagaccctatctcagtcaatcaataataaatacacacacacacacacacacacacacacacacacgtatatataaccattcatgcgaagaagcaggaaaatacaacccataatgaggagaaatattaatagaaatggatttagaaatgatacagatgttaggattcgttgacaaagatgttaaaacagcatttctaaatatattatgtatttcaagaaggtaaataaaaacataatcctattaaagagtaatgtgggaaatgtaaaaaaagacctaatttctagaaataaaaaataccatgtctgaggtgaaaagttcactgggtaagatgtggcactacagaagaaaagattaaggatcttgaagacatagcaatagcaattgttcaaaatgaaacacctagagggaaaaaaagactggaaaaacaagcagtgtcactgtgagctgtgagacaactttagatgatcaaatatataaagactacggatggggcagggagacagaaaaaatatttgaagacataagggctgaaatttttccaaatttgataataactgtaaacccacaaatccaaaaagctcaacaaaccaaaagcagaagaaacactgaaaagctacaccaaggaacataatcaaattgcataagatcagtaataaagaaaaaaaacttaaagtagctaggtttctaaaaacaacaacaacaacaacaaaaatgcattacatacagagaaacaaagataagaatagcagcagtctcctcaacagaaacaatgcaagctagaccttggaacacagaaggaaagagaatattaacccagaattctagacccagtgaaaatacctttcaaaaacaaaagcagaatactttttcagacgtataaaacctgaaagagttcatcagcaggagaccattcagaaagcctcagatctaaatgctgcctgtaacaattacctgctgtatggccttggacatacttgaatctctctgaaccttcaaattttcatctgtaagataaaaataatgctaatttttaggggtttcgtgagaatccaatgatagaaaggaaaagaactgacattcattgaatgtcttctttataccaaccacgtattatctcattaaaaatggaaataacctgcctgggcaacatggcaaaaccctgtctctacaaaaaaatacaaaaattagctgagcatggtggtgcatacctgtagtgccaactgtttgggaggctgaggtgagcctgggaggttgaggctaaagtaagctgtgatcctgccactgtattccatcctgggcaacagagtgagacccaatctcaaaaaaaaaataaaaaataaaaatggaaataaaattcccaataatagggctactatcctaacatttttcttatgctagcctctttcttcttgttctttaatactaaaaacttgggttgttctgaaagaaattagtctaagtagcttgtctgtcttacgttttgatgaagcactttttcctaacttaatttgttctttagttaccagattaaatatgcttaaaagtgggaatgaacaactctccttgctagaatagacaagtcagttaatcactttgtgaaacagttaagtttcttgtaaactgcactttatttttttgcctgtgttttggctgcttaatttttttcagttatgtttattgaggtataatttatatactgtttatctaatttttattataaacctattggatagaggcatgagtgtctttatagctgtgcattgccccatagagtttttggcactcaataaaatgttaaataatatttttattcagcattctgtagacgggaagcatatggtaacaaatgtcagagcacaggttgaaaatctccaaaaagttatatgatatattctttggaaaagctagtagagatacttttgtgaatgaaatttctcttaaaaggggttcccagactcacattttatgcaacaaatttctccagccttcagttactttatttacaaattaaagtttttccttatcagaaataatgcataagttaaaatagtataatactaacgtggtatcataagaaagtatataaatggtttgatagataacataaagtaaaggtaactcatagtttgaaggacagcatgagaaaatatttagaagctttagcagtataagtctttatgttgtgatatattgtatgaaaagaaatacacagtggatagttctttattgttaaatttcagcatgacttagttatgtcactgctacagctgttgcagacattctagtggtaggagactttgactcaatattgtttttctcacctgaggattctagcactatttaatactcttattttagtgtcagaaacaatcattgcttcagaataacagaagacattgtgaattaaaacttcaaataaatttcatgcaaaggataatatctcccggttaatctgtgttgaagaaatggttgaccataatcaggtatacaaagccatttagatagcatatatctaaattttctttccagaatttgcttaccctctgatttgctgaccacacttgctttgaagttttggtttttgttgtcttgctatgttgcccaggcatgtctcaaattcctggacacaagcaatcctcccacctcagcctcccaaaatgttgggattacaggcatgagccactgcacctggccactttgaagtttttattaacataatttgaatgtgaaattacctgagtttttcttgttaacctcatgtataaaatgtgggatagggaatccaggcactgcttacttagcttggtgcctctggctctcataagacttttaataaaggtgtcaaccaggtttgtagtcatcttgctgctcagctaggggaggatcttcttccaagcccactcatgtccggtcacagccctcagatcctcactggttattgatcatgcaccactccatagtcctcacaacattgcaacttatttctcctagagcgagggctcagagagagaaggcttgtgatcaagaagatgaacaaaacataccatcacttttgtcatatatttgttaaagcaagtcactaggtctagagcacattcaaggggaggagaatgtacaaggatttgaataccaggttcaaggatcattgaaaaccattttgaagactgcctcctacacatataatccacagatgggacagatcattaaagtactctaggtgctctgacactcatttgtttatcctgagatcttaacaagaacttgaattcaataggcaaaatgatttcagtttcacataaagtatttcatttattcctagcaacaatgcaacgaaataggtatggttaaccccaatgttattgatgaagaaattgatgtactgagtgactggctcaagattacatagcaaataatttgtaaaactgggaccttagtgtaggccttttgattctagaccctgtactctttccattggctataattgcttcctaccagtactatgttgcacttaaagccattcaaggagaatattatacctctaaatttatatacaattatatgaatttttattatacagagatttttatacatatatgtagagaaagacagacacccccctgtcttaatctctaacctataccactccgtttaggagttatagtattattgagtcaaagtctaatatcattataaggcctgtaacagctgtagcaatgacacacatgtacacagatgctagcagcctaaaactacacttaggaggtaaatgtttgttgcatggagagatgaagaagcaaagtaagaaaacagacctggtctggtggctccattcccccttggcttgtcagtatacagaaatcattgtgtttctatataactagtaacaaataattggaattgcagtgagtatgggcaagttatggttttagtttaatattgattatagataattctactttataagtaagaacttgtgttatcagatgaaatatagagaaagttttctcctccatagttgtctttcatatacgcaaacatgcacttgagtttctttcctttcctgcataatctgaggattgtgctttttaatagtggcttgctgatccctttaaatagctcttaatgtaagtattccatagttttcattaatctgattaacatagtttttccctaacctccattcaaaaactatatttggttgttgttttaccctggttgctgaagcagcaagcctactgcaaaacctaagtggtgtggtatagatgagagtctaagactttaattatatgtcattttattcacaacactcaattccaggaaggaaaaaatgggtctgtttttgtaaaggacatattatgtgagtatcattcattgtaaaccaaaaatgatactgtattatagcatagacaacaatgagaactgattctgaaaatgtgacctgactgagaaactgagtaatagtgaaagttatcaaaatggaaaaaaagcgttaatgtgaaatccagccttctcagaaatactctttcctggcctgtttagttttgcttttgttgcttgtcatgcatgaatgaaagtgctgtactctcaggggagcaggaaagcctctgtgtcggttgtttatttccttaatccctcctcctttgtgatttttgatgtcagatctaaaatggaaagcctgtaaatataatgattatcacacggataatcacctgcattaggaaccgccctgcttttctattctaacccgagctgttctccacatgtcacatccactctgtggttggattttaacctgactgcttcattagatttgtgaaactcagtacgaggcgccctggggcagcacagatggggacttgcttgttttcttttctcacttttactgcaaaggcacactaaaaagtccttttcaatttagtgcgatcagttcacttggaattatctctgatatttggaacctgtcttgctcttctgcccaccaactatgcctattctttcttccttactttctgacctaatgtcttttctttctgcctctgcatgtcatgaatctgacaactaaaattctgcttacaattcttactgggtcaaactgttcccccgtgttgttttgtttgttttgctgacagggaaaaataaatgttgttccatcattgtacctacaaacaccttcagatcagaggttagctgtgggaaagtctgcagtgatatgagccagctgccttctctaatggagtgacttggggcaccagtccaagatcagaggaaggtgggaggaagtcagaagataagatcattttaagccacagaacaacaagcttagcttttctagtgatagggcacagctcagcaaacctgtgtgagggggcactaagacaaaaaattgagttgactttttttaagtacatctttcctcagtcagaaatatgttgatgcttgaaatagtttacagacatggaagtgtcctagggcctggtttccttaaaagataatgatttgacatttatatatgtgtcttcttgcagttagtcagctccataccataacagatcacagttaatttttaaaaataatttttttgggctgggcatagtaactcatacctgtaatcccagaactttggaaggccaaggcaggtggatcacctgaggtcaggagttcgagaccagcctgatcaatatggtgaaacccccatctctgctaaaaatacaaaattagctgggcatggtggcacacacctgtagttccagctactcgggaggctgaggcaggagaatacctttaacccaggaggcggaggttgcaatgagctgagatcgcaccactgcactccagccagggctacaagagcaaagctctgtctcaaaaaaaaaaaaaaatatatatgtatatatatacacacacacatatttatatacacatatatatacatatacacacacataaattttttacagttaatttcttatatttgagcaaaactggacattaaaaaaattttactgtatgtgaattttgagcatttatggcttagtgcaattttagtcctacacattcttcctttgaactttgtcttacagtcccctggggttctctcatgtctctgatgaagttccatataaataagtggttctagtatagcttttttgttgtctttttcatataagaatttgcttggttcagagtgacagcttgggaagcactacatcaatagcttttgaaccttttcctattccttgatatcaccgccagcaaatgttactgactatgtgatgtacaaagttctaaccttgcttgcacaaattgaccagttgtcaagatcaatatttatttgcttatttttgtctacatgaactaagggtaacttggtcaggcttatgtttctctagtaaatagcgtaaggagttgtactttcaacttaacacttcctgttgacttcagtgtttagctgtaatcatacattttgacctttctaaatcctcaaaatggttctctaacctatatgttattagtacattggaccataggtgcatacatgtatttttttcccaatgttttcccaaatttctgctgaagacactgactgtactttctgccttacatggcttgatgctacagtcgttttagttgagttggatctgctcactactcaggctcaaatcccatccttctattaatatctcttggcaaagataattttggaagaatgtgagttaagatgtagagactcttgacagttgtctgcagttttttttttttttcattttcaagagggaagtagagttgaaaagtaatattgcctcccttttctatctgtcctaaaattaaagtataagcacaaagagtgaagaaagggaaaggatttgattacacatatgtatttttgtcatttagtaacctgttataagagccttagggtatataataatcattagattgtgtccttaagatatttaaaatctagaagaactttgcatattaaaattttttaaccatacatatttttaatgctcaactgtttttaccctgtcatcttatattaaagaggatttttggactgtttattataaaaaatttcaaacaaaaaaggagacattggacccctacatagcacatacatctagatttaacacttgttaacattttgccacttttgcttcattttaatttttttctgcagtattctaaaataaattacatatatcatgacatttcatttctaaatacctcaggattcatcttaagaattaaggacttttaaaatcaaactgataattcctaatattacctaattttcatttcagattcaaatttctccccttgtcccaaaaatgtcttttatagctggtttgtataaaccaattaaggtttatacattgttcttggtcattttcccttttctactttacattacattgacttgttaaaaacattaagctagttgtcctacagaatgtcctaccctatgaatgttttcagttgctttctctgtgtatactttaacttgttcccctatcctctgtatttcttatagactgcaagttactggactaaagttttgattaattcatattaaagtatttaggttagaatactttataggtgatggtgtgaacttcacactgcatcacaacagaaggcaaagaatatttggtgatcccactattagtgatgataagtgatagcatcgatcactgggttaaagtgatgacagcttgatccttccattataaagttatgctttgctcccgtgaccagcatataatctgagatactttgattccatggaaatacccagttccctatcatcctttttacccaatgagtttaacatctactgaggatccttgcctgcataaatttcgttatgaggattgcaaaaagatgatttttctgaatttatacatttattagcaggcattcttctctacataagagctttttgagaggtattgttttaattaaaaacacaaccaccagcatattccttggattgtctttctttgctgaggtcagaacacctgaactcactgtggcagctacagtaaaaacatgtactacatcttctttattccaacttgtgaagtgtgttgacattaggctgcctttttttattattattattccaagggaaaaaagaaatctttattgctgtaagaataaaaattgaactatgtgggtatattgagataattgtgtaaagaagaagactgaatgagtttcaaaaaatggattatttcttcattaccgagcactttataattaactgttcttttttttttttatttcaggaagctgccacttttgctagagagcaaggctttgaggtgagttaacccacaattgcacactaaacagatcctaaaggttttttctagctgataatgaagttcttttggacagtgattgatgtgctattatactctcagagcctcgcagcagttgccatggaaacttggcagtcgtcatggtttctttgttctgccagcacagtgttatgacgcactctgctaggtctgcacccaacatcgcctacagatgttatttattgaattttgaaaagcctcttgggaagccaagaggttgggcacggtttcaagctgcctctgcagatatggggcctgtcagtttgttcagttaaaaagctacctcattagctgcattacatttcataaggattcactgctaaagcagtggtggaacaagactaaataatgaaatataatgtcgtttaaataatttcagccctatcacatgtagattatcattatgcaaattaatttctaaaaggttgtacttaacagttgttaggaactgattaatttaaatcctgcttttataaacttactctttgaacctatcttttcttctctctccctctttttttctggggagacggaggtagcataaaatatacatacattttctgaaataaaatatcaataattggatttaatttctaggtcctaattctgtttttctgatataagtgttatcctgtcaagattcaaaactccatgtggttgttgttggcaaaactgagataaccgtgttttttatctgtataatacccctcttccaactgattgttagaaaacactgactaatatgaacccaggttaactgacagagaattaactaagttggagttgtttatgactatgatatttattgagtgaactatgtagaatgctgtgttcttacagcaacttaaagtgttacagggtagtaatttttaaaaatttaatctaaccacagccgaaatgtaggaactttctttttatttgcatattcagtattgtctatcaaacagggaagaggtgagtggtgattgaatagtatcagtaaggactagtaagctcactttgaactctagagaaagatattatatgagtttgtgaaactctttttaaatgtagtaaaggcagattatcaagcagcaaagtaatacatgttcatgttattcatgtcatcagacttgacaaacgagacatagagcttcctcttcatagaggaaagacaaggaacatgtgatacagatattctgttctgaagatcctataaaagaactactccagagtagggaaacttgcttctttgtactcaattattaggagctgtgatagtttcttacaagtttgcttttttatgctttaccatattatagtaaatctaggtttaagtcacatttagaaaaaggatttccaagtggtgggtttttttctaatttaagtttcacattttaatttcccaaactggcaattatatgtaggacaaaatgtaatcatgggaatattcaattaaaaagtcaaatgttttgatcatgagaatataaataaaaattttcaggaattttttaaagttttactgattttaagttttaatattacaaaaattatattatctgttgatacatcagaattctccatagaagaaaactttcagaacatacatttgtatcctgtcagtttactgtgttaccataaaaaatgtatttttggttctataaaataaccaattttgcagatacttagaaatataatttgttatataacatgatcatgatcctgtagtatctacatagcagtttttaaaaaatagtttattaagcctgattaatacttttatttcccccttgagctacttgcttttcatgtgcctggtttacattcagtcatagcaacaaactactttttctattttccattaactagcactatattcacctttccattagttcttacttactgattcttgaattgtttttgccataaatctgccataattgattacagcatataagcaaaatgataatgattataatcacataccttattacctcctgacatagcaaaactgctctgtcagtgatattgacagtgatatgttagactaaataaagcacatagtgtcttgatgtgtctcttcgtagattcccaaaaccatcacaagcattgcagaatatatttgaaccatgagtagggtaccctcaaatagatatttttaatcaaatgtaatccatgtatggaacactatctagagaaattcaatgattttataatgtcactaaagtttcctaggtcattagacagaaatggcagagcataggtttgaaacttggtattcttaaggaataaaacaaaaataaatcactttatcttaatagttttctgtgtgaaaatgcattaatactcttggctagtgtgacaaactagacaaaaatctgcattttatcccttctaactttaattttgactctaaatttggagcatgaatgagaagaaagaagtgaaaagattaaaagaaaggaaaggtgagtattttttccttccatcagtgccgctgtcctaccctcattttctcctataaatcccaatcagttccaaaagccactgagtattgccactagtgatctggctgctgacagaccaatccaagcgcctctaaaaataaccagtgtttattcgtcaggaaatattctcagtggcattttttttttaattgattattattctggttagcttctctgcaaattttacttttgtaaaaaaaaaaatctttaaactgaattcggcagttttcagtgagaagcagcagcttaggagagcactggagaatgagataaaaactggagctgggcagaacacaaagcataagagaggatttttttatatatataggtgatggaaaattgcatagtgcctgatttaaatgacagacctgctaagaatttaaaatgacaattcttggggtaaaaagttttataaggccttttattattctagaaaatcagttcagactggagtgtgtttttaaatctagcttttcttgagccgaactgattaaatgttcgtatttttagaacataaataaaaataaggtgctcaaaagcatgtttcattataaagccttttttaaactattgaaaattgatttaaataaagtgaagaaaatacctcaaaacctaaatatatatattctctatcttttcattgtctctgcaactgagtaaatgacaaatgatgaagagaattcataccttctctattggatcatttatttccttttactccaagtaataaattttagattttttttaaattttagatctctaagaataatacttctgctcataggggaaacaaagcaatccttttcgcctttttcacttcctccatagcccctgactacccagaagatcctagacttgtagtctttctctgaccaatgaggattctttcatcttacaccactgaaagagaaaagtatggaattgtgctatccaatacagcatctactagccacatgtggctatttaaattaggattaattaaaattaaataaaatttaaaattcatcacttcttggccttttggctaagatcaaatgtaaaattttaaattcagtccttcagtcatactaggcacatattgagtactctatagactatgtagctaatgactactttattggataatgcaggatagaacatatgcatcatcacagaaagtttcattgatcagcatggatagaaagtctacagagaatgtattcaggcagtgttgattaccaaagaattaccttaggtgacttttaggttcctgtgttcttcacaaatataaatagtgcaatgaatgatcactcagagtttcagagtttctgaaaataagaccctaaatcaggccctgctggctaagagagtgcagtgttgtttttgtaggtgcctgaaccccaaaagaggacaattttagaacagttcagttaagggaaagcaataagctagtcttctaattctcttcatttaatcatttatttattcaacaaatatttactgagttcttactatgtacataccactttgatagaccccaagacaaggtggaagtgaccagagagtgtaccatgaaagagcatgtgggaagggttcccattttagctatgatggctatggaatgaccctaaaaatatgaatatctagcaatgacaaaaaaaaagcgacacaaacagcaaaacaaatttcaaacagagagaacaggactataaaagtctctgaacgagagagaacttaatgtactatgtactccaggaactgacagaaggccagtgtgactggaatggagttagtggggacagcatatgagatcaatctggcactgacacatcatataaacagcataactattaaaggagtttctatttggaaaacaaaacaaaatggtatggctagatgactcaatgtgtggaaacactacagttggttttctacagaactaggtagactgtgacaggattgcttaacctttgtataaccagctggttaaaaatagaataaagattttctttatccagtctatcattgatgggcatttgggttggttccaagcctttgctattgtgaatagtgctgcagcaaacatatatgggcatgtgtctttatatcagaatgatttataatcctatgggtatatatccagtaatggtattgctgggtcaaatggtatttcttgttctagatcctttaggaatccagttcatgttctttgcatggacatggatgaagctagaaactatcattctcagcaaactaacacaggaacagaaagccaaacactgcatgttctcactcgtaagtgggaattgaacaatgagaacacatggacacagggagggcaacatcatacaccggggcctgttgtggggtggggggttggggagggatatcatcaggagaaataactaatgtagatgacaggttgatggctgcagcaaaccaccatggcacgcgtatacctctgtaacaaagctgcatgttctgcacaggtatcccagaaattaaagtatgattaaaaaaaatttctagtaatagtaacactactagtaattcaaatgaagtgtgtgtaacagaagaaataaaaaaaaaattaaaatgctacatctgaaaatacctatttcatacaaagcaaggaggtaaagaagggatagaacatatttttttaaaatatgacatatggaaaacaaatagcaaatggcagatattaattcaactgcattaataataatgttaatctggagtaaataatatgataaaaaggcagaaattctcagactagataaaaaaactgaggtctaactatatgctgtctgaaagagatgtatcttcaattcaaagatacaaataggtaaaaaaaaaaaaaaagaatgaagagagtatgttctttgatttggaagacaatgtgatcaccaatgacaataaaaccatatttctacatttataaaatgctcacagtttataaaacctttcccaacatatcagtaatacattcatacttgcacaaaccttgagagataggtagggcatgtattgccatatcagttcaacagattaaaaaaataggctatatggccgggtgtggtggctcccacgcctgtaatcccagcactttgggaggccaaggtgggtggatcacctgacatcaggagttcgagaccagcctggccaacatggtgaaaccccatctccccttaaaatacaaaaaaatagccaggtatggtggcagatgcctataatcccagctacttgggaggctgaggcaggagaattgcttgaaccaggatgtggaggttgcagtgagctgaaattgcaccattgcacaccagcctgggcaacaagagccaaactccatctcaaaaaaaaaaaaaaaaaaaaaggctctatgactttttcaaagtcatatagctaatacattatgtagccagaaccagagctcagctctctatgtctggtgctctttactataaagcacacagctttctctcacacattctaacatgttggaagaggagattagatttcaaaatgactttgagaaatgaaaaatacctttttttttttttttttttttggggagggggtttggctttgtcacgccaggctggagtgcagtggcgtgatctttgctcactgcaagctccgcctcccgggttcactccattctcctgcctcagcctcccgagtagctgggactacaggcccccgccaccacatccggctaattttttgtatttttagtagagacggggtttcactgtgttaaccaggatggtctcgatttcctgacctcatgatccgcccgcctccgtctcccaaagtggtgggattacaagcgtgagctaccgcgcccatcgccatatcagttcaacagattaaaaaaataggctatatggccgggtgtggtggctcccacgcctgtaatcccagcactttgggaggccaaggtgggtggatcacctgaggtcaggagttcgagaccagcctggccaacatggtgaaaccccgtctctactaaaaatacaaaaattagttgggtgtggtggcgggcacctgtaatcccagctactcagaagcctgaggcaggagaatcacttgaacccaggaggcagaggttgcagtgagccaagatcgcaccattgcactccagcctgggcaacaagagcgaaattccatctcaaaaaaaaaaaaaaaaaaaccactgaaattcgctggagtaaaaatatgagccaaattaattaagaaaaaatagcaaacttaaacacaagatcaggaatgacttgtgaatgtggtaggaaaatggtttaggatgaacatgctatagttttgtgataaaaaaaaacaacaaaaagcacattgctagcatttatagaagcactataataatggttaagtgtattatccttggagtcagactgtgggtgctagtctgttctccactacttgtatttatgaccttaggcacattacttaacgtctctgactcagtttcttcatctataaaatggcatattgtattagtacctactgcctagagtagttcagatttaatgagtactttattttattgattggttgattgattgttttgagacagcctcactctgttgccctgactgaaatgcaatgatacggtctcagctcactgcaacctctgcctgctgggctcaagcaatctgtagattcaatgcaatccctatcaaaattccaatgtcattctctctctctctctcttttttttttttgagacagggtctggctctgttgcccacgctggagtgcagtggcgtgatctcagctccctgaaacctctgtctcccaggctcaagccatcctcccacctcagcctcctaagtagctgggactataggcgcatgccaccacacctagcaaatttttgtatttttttgtagagatgaagttttactacgttgcccaggctagtctcaaactcctaggctcaagcgattcacccgcctccgcctcccagtgtgctgggattacaggcatgagccaccacgccttaccttaatgaatactttagagctttatacatggcttttagtttcttcatctataaaatagggataataatagtacctactgactagagaagttaagatttaatgagcactttagagctatgtacatggctcacagctcaattttatgagctttcaactcatacttcttactcctccctgtcttcatcttcttcgttatagatactataattgaatgttccatattcaaaactcttgaagccctttctagcgattttggggcaacctaagtatgtaaccattttagagagtattaaaatgagagtaattagaggaaataaattaatatttaagttcttagcatgtgctaaaattgcattaagctatttcacttacctcatcttctttcatcctcacaatttttaactttttattttaaaataactttagtcttagaaaaattacaaaaatagtacagaattcccacatacccttcacccagtttaccctaatattaacatcttacataaccaaagtataatgaataacagaaaattaacattaaactacaataactgaactatatacaggctttattctggtttcaaccgttttttctctagtttcctttttctgttccagaatcgaatcccacattgcatatttgtcatgtctccttagtctcttctaatctgtgacagttcctcactcttgttgttcatgaactttatacttttgaaaattattggtcagtcattttgtagaatgtccttccatttgagtttgtctgatgttttctcatgtacattgagattaggcatttttggcaggaaaaccacagaagtgatgttcctttcttggtgcatcatatcagggaggtacacagtgtcacagattcttattgctggtgatgctaaacctttatcactaggtttaggtggtgtttgctagtttatcctctgtaattcccattgtatttaataaatatcttggaggagatactactttggggctatggaaacattctattttatccactaattttagcatcactaaactaatctatctggcttaaggtgatgtctgtcaattttctctactataacattatgatttttccttttgtaatgaatatcttagggggacatactttgagactgtaaatatcctgttttctttaatttttgcccactaatcttagcatacttatccctcaaaatcttttaatgtgaacattttcttagttttgtagatgaggaaatggatcttagagaggtttattaacttgccccaaatcatacaaatagtaaatccaagcctgtcatattctaaaagtccttgtaatttcattgtttgttaagatgtgtgagcttaagtgtaagggagaagaacctattggggacagaggagaggaattactgtagaaggagaaataaagttttacatacatctgggaagaattatgttttgtacttggaaagtttattttgtcctttaattgccattttatgaggtttaatttgagacataagaaacatttctttgattaaattaccaaagctctcaacaaaatatgtcttctcacagggttggtagaaagcaaccatggaatcttattcctttttttttttttttttttttttttttgagatggcgtcttgctctgtcaccaggctgcagtgcagtggcatgatctctgcacactgcaacctctgcctcctgggttcaagcgattctcctgcctcagccctcccaagtagctaggactacagacacgtgccaccatgcccaactaatttttgtatttttagtaaagacgggatttcaccatgttagccaggatggtcttcatctctcgacctcgtgatctgccctcctcggcctcccaaagtgctgggattacaggcgtgagccactataaccagccagaatcttattcttaatttattccttatatcaccttgaagaaagactttcttttaaagaacatctagtacattcataagattctgctttcaagatgatgaagtgaatgtgtttttctcttatctttattaaatatgagctgtacttaatcacaagcaaaaatcctatagtagtaaaatatatttgtgctaaggaaattgccaaaatatacatgagtcattttaattatatgtgtacacttatttaggtgagtgaagacattgcatggcattttttggtcctttcagctgttactagtcatttctaaaagtctgtctcctgaaactgagggaatttcttctcatcttatcagagttcagacttagttctgttctaaaataagcaaccgaaagcgaaatagtcagcatgtttgaagtcagcagcactgtcctactacaaatggctattcttttcagaaacaactgtcctctagaagtcatcctgttaggtatattagaagcttagcttcatatattatctggaatttattaaatattgagtgaacaaacaatataaaaatatttcaccactaattgtcatccctttaaaaatgccagtttctggtgacgtttgtaacgattgcaaaccattgtgacttgtctgctttgcttgcctaaatgttctctctcatatattctatttgttctcttatatatactttatttatgccactcagctatatttccgctctgataggtgtttctttctctataactatttgaaactttgcatagtgatagaataaactagttttgttagcaaagcccaaaactatggacagttttaaaagcccactgaatacagacatggattttcaaattatccaaaatggttgaaaagatgattctaaaacctctgcctttagctcaaggttaggtttcaagatttcagaaaacttcaataaagatttcagtaaaactttatggcctatgtggtgtgaaaaacagcatcagagtttgacaattagtttgtcattttttaaactttatcttttttaaagaaaattaagtctttgtaggaaaggattagcatttctttctctcaaatcagtcctttgaaaaattgacattataagaactgtattttttccaaagtcagcataattatgttctgtaaacctctaaaataattaaattttcctctttataaaaacctctctttaattgggaatttgaaaactgcctggatatttgctgatacttagtcattgttaataatttttgaagtatgataatagttttgtggttatgtttatcattacctttcaaagatatatactaaaacatttatagatgaaattatgtatagttcttggagtttactttagaataatttgaaaagcaagtggatgaggatataggtgaaataagattcatcatacattttaaatttgtgtagatcattgatgggttccttggaagtcactgtgctattctatttacttttgtatatggttaaagaaatttttaatgtctcttaatagatatgcaggtctcttattttgatcaatagaagctaaattgttaatctactaataaagttttgttttattttattggtcatgagaattttttccttccttctattaatagactaaagacattaaagagatagccaaaaagacacaagccctgccaaagatgaactcaaagaggcagcgaatcgtgatcttcacccaagggagagatgacactataatggctacaggtacatgtgggaaatgtgtgatgaatctagtattatggagattaatcaattacaaaaaaaaattctgtattctttctattataatatatacaatatacatatacaatatatataaaatgaaatattttattttaataaatatttctaccctgtatctcagtagaaaagatttcatgttcaagaagatagtttattaacatttagttaaataaaccactttgatataatttatttacttagttatcttggggattttgtcaatcaagaaatatctttcctgaaaaaaagaatacatttcatttataaaatacctgcactagagtaaaataaatttactcaattatgaacaaataaaatccagaactaagttacattttccatttttccttcaagaagaaaatctcattttttgttttatttcaccatctattttatagcactcataaaacaggaatttcatctagtaagcaaacatgttattgattaaaatgattaatagtgttaatatggagctacccactattaaaaatataaatgttttaattctgtctgtaccattcagattaaaaccaatcagttgattagttattgtaaactggagcaatttagtattacctatgtgtttgttcagtactctgctgaacactgaaatataaaataggaaccttaaagatctaactgggaattaatattcataaaatataagtacaaagtaaaatataattatagttcttatctattggtgctaactatatggattgtattgactcaggagatcagtaaatcttgaaaaaagatgttatagtgaatatgaagtacatttgtgttgaattaaatataaagcctgaaataggccaaagatgaaattactgtcaagatattttctttcttttttaaaataaattttattctttatatttgaggtttataacatgatgttataggatacatagatatatatagatcaactttcttatttcagaatggtcaaaagcaagattcagagatttgtttcaaaaaatatttgcttcaaagtagttcagtgagtggtagataaagtgagggtataaatgaaatgagactggtaatgaattaattgttgaagctagacagtggatatatgggggcatcattatgctattatctccacttgtggatatgttttaaattatccataattaaaactttaaaaaaagaaagaaaagtttttttttttaaatttcaaacaagattcagagatgttgagtggctttcccaagatacattgatatccttgctaatccttaaattctaggaaggattaaaagaaaggaggacaagtgggcacagtggctcacacctgtaaccctagcaccttgggaagtcaaggtgggaggattgcttgatcccaggagttggagaccagccttggtaacagcaagacttcatctctacaaaaaaaaatggaaaaaaaaaaaaaattagctgagagagtagtggcacatgcccatagtcctggctacttgggaggctgatgcaagaagatcacttgagcccagaagttcgaggctgtgttgagctatgatctctccactgcaccccagcatggatgacagaccaagaccctgtctccaaaaaaaaaaaaaaaaaaaaaaaagaacggagggcaatggagtcaaagaggatcaagtaagcaaaggcacaagtactagcaatcttttattgtgatggcaagaagaaccaccttgttaatttgtacaagagagaaaagaaaccatgaaaagatatccctgcactgatacaaactatctgaattgctttcttcctatagtataaggattattcctgtcttagcagtggacagtttagaaaagtgaaaaacatacaggcttcttataggaattgtagtactaccttcagatttacaaaatattctttggttgctctttgtggagacattcattttaagtctttgtatattctagatatacatactgtacaagtgtcttccttattgtgaatttgcagttttcccaaaattgaaaattaacctccccattctgtgactgtatttccttgtgaactcattttattctttattaaatctattaagccattcttaggaatgcttacaagctggaatttatttgaggaaagacactggctaatctttgctgttcctaccatatgaaaatgaacttaaatcaaaggatgcactatatctgcaatgcatgataaatacaagatggatagagaatctgttcagtggtgtcagctacaaaagcaaacatgataaatgttaatgcagttttgagccctgggataagctattcagtgcacaagtgtagctgaatctctttgctatgttgttattcattgcagccaaataaatgtcaataataaaagagaattaaagattttcatttcccagaggcagtcctctaatacggcttgatctttcatttcatttgtaattcgttctcatgtcaggatgcaatcattcgccaggctctgggtgtcatgttaagccatttaataatgattaagaacataaaaatgcttggcctgtggggcaattcacaaaagagatgccaatttgttattgttttccctcctttcctcttgaatatggatcagctttttcccacctcctagcattaaaatactaatggaagatagggagggaaagtgtcccttaatttaccataagtgacattccagaatggcacaaggcagtgctaacacacatattaaaagactaattaggaatcattgtgccttaaacctatttttttttaatgatactttaagttctgggatacatgtccagaatgtgcatgtttgttacatagttatacacatgccatggtggtttcctgcacctatcaacccatcatctacattaggcatttctcctaatgctatccctccctgagctcccccaccccccgacaggccctggtgtgtgatgttgccctccttgtgtccgtgtgttctcattgttcaattcccacttatgagtgagaacatgcagtgtttggttttctgttcctgtgttagtttgctgagaatgatggtttccagcttcatccatgtccctgcaaaggacgtgaattcatccttgttatggctgcatagtattccatggtgtatatgtgccacattttctttagccagtctatcattgatgggcatttgggttgactttgctattgtgaatagtgctgcaataaacatatgtgtgtatgtgtctttatagtagaatgatttataatcctttgggtatatacccagtaatgagattgctggatcaaatggtatttcctgttctagatccttgaggaatcgccacactgttttccacaatggttgaactaatttacacttccaccaacagtgtaaaagcattcctgttcctccacatcctcaccagcatttgttgttttatgactttttaatgatcaccattctaactgacatgagatggtatctcattgtggttttgatttgcatttctctaatgaccagggatgatgagctttttttcatgtgtttgttggccgcataaatatctccttttgagaagtgtctgttcatatcctttgcccactttttgatgtggttgtttgttcgttttttgtaaatttgtttaagttctttgtagattctggatattagccctttgtcagatggacagattgcaaaaattttctcccattctgtaggttgcccgttcactctgatgatagtttcatttgctgtgcagaagctctttagtttaattggatcccatttgtcagttttgacttttgttcccattacttttggtgttttagtcatgaagtctttgcccatgcctatgtcctgaatggtattacctaggttttcttctagggtttttatggttttatgttttatgttttaagtctttaatccatcttgagttaatttttgtataaggtgtaaggaaggggtccagtttcagttttctctatatggctagtcagttttcccagcaccatttattaaatagggattcttttcccccattgcttgttttttgtcagatttgtcaaagatcagatcgttgtagatgtgtggcattatttctgaggcctctgttctgttccattgatctatatatctgttttcataccagtaccatgctgttttggttactgtaggcttatagtatagtttgaagtcaggttagcatgatgcctccagctttgttctttttgcttaggattgtcttggctatacgggctcttttttggttccatatgaaatttaattttctctaattctgtgaagaaagtcaatggtagcttgatggggaaagcattgaatctgtaaattactttgggtagtatgaccattttcacgatattcttcctatccgtgagcatggaatggttttccatttgtttgtgtcctctcttatttccttgagcaatggtttgtagttcttgaagaggtccttcacatcccttgtaagttgtattcctaggtattttattctctttgtagcaattgtgaatgagagttcactcatgatttggctctctgtttgtctattattggtgtataggaatgcttgtgatttttgcacattgattttgtatcctgagactttgctgaagttgcttatcagcttaaggagattttgggctgagatgctggggttttctaaatatacagtcatgtcatctgcagacagagacaatttgacttcctctcttcctatttgaataccctttatttctttctcttgcctgattgccctggtcagaacttccaataccatgttgaataggagtggcgagagagtgcatccttgtcttgtgccggttttcaaaggcaatccttccagcttttgcccattcagcgtgatattggctgtgggtttgtcataaatagttcgtattattttaagatatgttccatcaatacctagttttttgagagtttttagcatgacggagtgttgaattttatcgaaggccttttctgcatctattgaggtaatcatgtggcttttgttattggttctgtttatgtgatggattacgtttcttaatttgcgtatgttgaaccagccttgcatcccagggatgaagccgacttgatcatgatagataagctttttgatgtgcttctggattcagtttgccagaattttattgaggacttttgcatcaatgttcatcagggatattggcctgaaattttctttttttgttgtctctgccaggttttgctgtcaggatgatgctggcctcataaaataaattagagaggagtccctctttttctattgtttggaatagtttcagaaggaatagtaccagctcctctttgtacctctgatagaattcagttgtgaatccgtctgctcctgggctttttttggttgataggctattaattactgcctcaatttcagaacttgttattggtctatttagggattcaacttcttcctggtttagtcttgggagggtgtatgtgtccagtaatgtatccatttcttctagattttctagtttatttgtgtagagatgtttataatatccactgatggtagtttatatttctgtgggatcagtggtgatctcccctttatcattttttattgtgtctatttgattcttctctcttttcttctttattagtctagctagcagtctatctattttgttaatctttgcaaaaaaccagctcctggattcattgatttttggaagggttttttgtgtctaactccttcacctctgctctgatcttagttatttcttgccttctgctagcttttgaatgtgtttgctcttgcttctctagttcttttaattgtgatgttaggatgtcgattttagatctttcccgctttctcctgtgggcatttagtgctataaatgtccttcttaacactgctttagctgtgtcccagagattcgttgggtctctgttctcattggttttaaagaacttatttatttctgccttaatttcattatttacccagtagtcattcaggagcagattgttcagtttccatgcagttgtgtggttctgagtgagtttcttagtcctgagttctaatgtgattgcactgtggtctgagagactgtttgttatgatttccattattttgcatgtgctgaggagtgttttacttccaattatgtggtcaattttagaataagcgtgatgtggtgctgagaagaatgtatattctgttgatttggggtggagagttctgtagatgtctattaggtctgcttggccagagctgagttcaagtcctgaatatcgttgttaatttttggtctcgttgatctaatattgacagtggggtgttaaaatctcccactattattgtgtgggagtctaggtctctttgtaggtctctaagaacttgctttatgaatctgggtgctcctgtattgggtgcatatatatttaggatagttagctcttcttgttgaattgatccctttaccattatgtaatgcccttgtttgtcttttttgatctttgttggtttaaagtctgttttatcggagactaggattacaacccctgctttttttttgctttccacttgctttgtaaatattcctccatccctttattttgaacctacgtgtgtctttgcacatgagatgagtctcctgaatatagcacaccaatgggccttgactctttatccaattccccagtctgtgtttttcaattggggcatttagcccatttacatttaaggttaatatattatgcatgaatttgatcctgtcattatgatgctagctggttattttgcccgttagttgatgtggtttcttcatagtcttgatggtctttacaatttggtatgtttttgcagtggctggtaccagtttttcctttccatatttagtgcttccttcaggagctcttgtaaggcaggcctggtggtgacaaaatctctcagcatttgcttgtctttaaaggattttatttctcctttgcttatgaagcttagtgtggctggatatgaaattctgggttcaaaattcttttctttaagaatgttgaatgttggtcctcactctcttctggcttatagggtttctgcagagagatcagctgttagtctgatgggcttccctttgtgggtaacccaacctttctctctggctgcccttaatactttttccttcatttcaaccttggtgaatctgacaattatgtgttttggggttgctcttctcaaggagtatctttgtggtgttctctgtatttcctgaatttgaatgttggcctgtcttgctagattggggaagctttcttggataatattctgaagagtgttttccaacttggttccattctccccatcactttcaggtacaccaatcaaatgtaggtttggtcttttcatatagtcccatatttcttggaggtttgttagttcctttccattcttttttctctaatcttgtcatgatgctttatttcattaagttgatcttcaatctctgatatcctttcttctgcttgatcaatttggttattatatttgtgtatgcttcacgaagtgttcgttctgtgtttttcagctctatcaggtcatttatgttcttctctaaactggttattctagttagcaattcctctaaccttttttcaaggttcttagcttccttgcattgggttagaacatggtcctttagctcggcggaatttgttattacccaccttctgaagcctacttctgtcaatttgtcaaactagttctctgtgcagttttgttcccttgctggtgaggagttgtgatcctttggaggagaagaggcattctggtttctggaattttcagcctttttgcactggtttttccttatcttcgtggatttatctacctttggtctttgatgctggtgaccttcggatggggtttttgtgtggacatcctttttgttgatgttggtgctattcctttctgtttgttagttttccttctaacagatgcctctgctgcaggtctgctggagttttctggaggtccactccagaccctgtttgcctgggtatcaccagcagaggctgcagaacagcaaagattactgcctgttccttcctctggaagctttgtcccagaggggcacccgccagatgccagctggagctctcctgtatgaggggtctgtcgacccttgctgggaggcatctcccagtcaggaggcatgggggtcagggacccagaggcaatctgtctgttaggagagctcgagcactgtgctgggagatttgctgctctcttcagagctggtaggcaggaaagtttaagtgccgaagctgtgcccacagctgttccttcccccaggtgctctgtcccagagagatgggagttttatctataagcccctgactggggctgctgcctttctttcatagatgccctgcccagagaggaggaatctagagaggcggtctggctacagtggcttttccaagctgcagtgggctccacccagttcaaactttttttgcgaactttgtttgcatctttgtttacactgttaggggaaaaccgcctactcaagcctcggtaatggcagtcgccccttcccccaccaagcttgagcatcccaggtcgacttcagactgctgtgctggcagcgagaatttcaagccagtggatcttagcttgctgggctccgtcggggcaggatccgctgagctagaccacttggctccctggctttatccccctttccaggggagtgaacagttctgtctcgctggcgttccacacgccactgtggtatgaacaaaaactcctgcagctagcttggtgtctgcccaaacagcagcccagttttgtgcttgaaacccagggccctggtggtgtaggtacccgaagaaatctcctggtctgcgagttgtgaagaccatgggaaaagtgtagttatctgggctggagtgcaccatttctcatggcacagtccctcatggcttcccttgactaggggagggagttctcgaccccttgcacttccccggtaaggtgacgccccaccctgcttccgctcgccctttgtgggctgcacccactgtctaatcagtcccaatgagatgagccaggactctcagttggaaatgtagaaattacccgccttctgcgttgatctcgctgggaggtgcagaccggagctgttcctattcagccatcttgccagccacccaaacctatttttaaatgatcacactgttaagtttgcagtacttagcaataatgtatcaaaatgtttccttggagttttattctacagacctatctccttttgagatatgatatacataaactactttgtcttattttataaatttaattctttaaattgcctgtaaatctaaagtattttccgctcaccctgttttatgggtcatacctctttcagattgagtttccatctaccctagaggttctgtcacataccaatcattgtttcagtccttgcaggttaattgagtttcaaaaaaattttcaagggagtgctgggcactgaagaatattaagagtaacaggctgggcaattccacagcagagtatatgtccaaaataattgaagcaggaacctaaacagatatatgcccacccatcttcatagcagcattattcacaataaccaaaaggtagaagcaatcaaagtgtccatcagcagatgaacagataaataaaatgtgatatatacatacaaaggaatattattcagctttaaaaaagaaggaaatcctaacatgcactacaacatggatgaaccttgaagacattatgctaagtgaaataagccagtcacaatgggataattactgtgtgattccatttatgtgacatacctagagtagttagctttatagacaaagtagaatgatgttagccaggggctgggggagggctgaatggaaagttattgtttaattggtaaaaagtttcagttttgcaggatgaaaaagttgtaaagatgggtagtgataattgcacaataatatgaatgtacaatggcactgagctgtatattcaacaatgcttaaaatgttacattttatgtatatttttattttttaagcatatttttcaatttaaaaaaaattaaacataacctaaagagtaagatgctgggggtgaaggcagaaaagatgactgtccattttgatcctctttataaatgttgaatgaatctgttgaataacatggcagtaaggtgaaggaaatcatttctgtgtttataaactggaaaaactaacagtgttctttacctgttggagagcaactactaatgagatcttcatacaataaaaccttattatattaagcatggtagtaaaaaagtaaatatatatatgtatgtaaatacatatatagtgctttatagaaagtttaaacttccccaagtttctatactaaataaatcaccaaaaattggagaaagcaatacaacttttgttctgaattggaaataatgtgtttccaattaaataggtccactgaaaaataaactgtagatttttctgtttcgtttgttttaagaccaggcctcgctctgtcacccaagctggagtacaatgacacaatcatggctcactgcaacctcaaccgggctcaagcgatcctcccttcccagcctcctaagtagccgggactacaggtgcctaccaccctgcccagctaatttttttgtattttttctttggtggagactggattttgccatattgcccatgctagtctcaaactcctgagctcaagtaatctgccttcctaggcctccctcctaaaatgctaggattacgggtgtgagccaccacacctggcctaaattgtagacttttctgaacactcagaattcttatttgaattgtaatttttcacaaagggagaaaatatattaagtcagatgttttcaactggaagactggtgctatcacatcaaaatcacctagtgagtttttggtaaatacagtcctaccttttttttttttttttaattttagaattgggggagggtgtgatactttttcagggttgttacatggatatattacataaggctggggtttgggcttctattgaacccatcacccaaacagtgaatataatacccaataggtagtttttcaactcacccccacccacttcctgcctccccctttatgtccatgtatacccattgtttacctcccacttataagtgagattgtggagcatatggttttctgtttctgggttaattcactttggataatgtcctctggctgcatctatgctgctgcaaaggacattatttccttctttgttatggctgcatagtattacatggtgtatatgtaccacactttctttatccaatccgctgttgatggacacttaggttgattccatgactttgccattatgaatagtgctgtaataaacataagaatgcaggtatctttttgatagaacaatttcttttactttgggtagatacccagtagtggggttgttggattgaatggtaatcctgtttttagttctttgagaaagttccaaactgctttccacaggggccaaactaacttacattcccaccaacagtatgtgtttccttttctctgtatcctcgccaatgtgtaatttttttactttttaataatagctgtgctaactagtattatgatatctcattgtggttttaatttgcatttctctgattattagtgatgtggaacatttttcatatgtttgttggctgcttgtatgttcccatttttaaaaattgtattgatttatttgtattttatagagaaagtgtcttgctatgttgctcaggctggtctcatacttcctgaggctcaagcagttctcctgcctcagccttccaaagtgctgagattacagacatgagtcaccatgcctagctgtatgtcttattttgagaagcatttgttcatgtcccttgcctactttttaatggagtaatttgggtttttcttgttaatttgtttaggttccttatagattctggatattagtcctttattggttgcatagttagcaaatattttctcctaatctgtaggctgtctgtttattttgttgatagttacttttgttgtgcagaaactctttagttaagttacaatggtcaatttttatttttgttgcatttgcttttgaggtcttagtcataaattctttgcctaggcctatgtgcagaatagtttctcctaggttttttctaggatttttatagtttgaggttttatgtgtaagtctttaatctatcttgagttaatttttgtatatggtgagaggtaggggtccaatttcattattctgcatatggctagccagttttcccaatatcatttattgaattgagtgtcctttcatcactatttatttttgttgactttgtttaagatcagttggttgtaggtttgtgggtttacttctgggttctctattttgttccattgatctatgtgtctatttttgtgccaataccattgctattttggttactataccctagtagtatagtttgaagtcaggtaatgtgatgcttctggcttcgttttttgcttaggattgctttggctattcagctaccctgccttcttaaaagcacctttctttcaatctgatacaaccctgtgaggagtattagaaaatacaacttcaaggagatgtttgagaatgcgggcagtacagtctggggcaaggggagtgtaggattatgtatggttgaaaatgttccctttggtgatatagcaatgctgtctatcctccacctgtcactttgagaatcactggattaggtgatttaataatgctgcaagttccgtaatctgctggaaaaacgaaaacagaactttttaacagctaagggtctagttcttcaataactcaggccttgggaaatgcttcttttttcgatccttcaaaatccatccacacttacaggcaatctacagtttactttaaatagtctcctacttttgaggtgcttataatttaacatagttacatcccaatgccctttgtcattttattttaagtaaatggggttattgacgttacttgtcttcatgttcctgagtccttaaagaaacgtgttacctcatctgctagttaagttttcatgttctatgaaaacactcaatgctgcccattactctgtaagaaaaggtcagtgtgatttgcaattctggtagacgtaaagttcagaaaatgtgcgttagaaaatgcaaactctaaaggaaaacaatctcagcattggaagaataatgtcagcacatgatcccaactcaaaatattaatataaatcattttgaaaatgtctctactacagccaaatcaattttaaatgataaccttgttggcttagattggtgatggtaaagatagaataaactaagtggcattcttttaaaatgtcttgtatggcattcatagaaaaaagttcttaccaggtaagatcttagagaaaatatatttctcacctatgaatgtaagttactaagttattagctcatggtccatttttagattattgtaatcacaaaagataaactcctttaattaattggtcaaaaataatttagaataacatgtggacctgtcacatttttgacaaagtagtatctttgggatgtggttcatttagttcagtgatctcaagcctgaagaaatgagacttctttcaactcccacctttttattgaaaaggatcctgctagaaggcaaaataagaggcaacctatcctaagcagatataagccctattatagcactgatttctggagggatgtttaagtcagatttgttgagatatagattacatatagtaaaatccacaaatatgttactaaataacatgtaacaaccaccacagactatagaccaccttgtacagtttgtattgaagtataatgtgcatacaaaattgatacaacttttcattaagtggatggacctgtgtagctataaccagatcaggaaatacaatacttatagcacttaagaagcttctccttgtgccccctcctaatctttatccccactgaaggtaaccattgtcttagcttctactactgacagttagctttgcctgtttttgaaatggaaccactcagtatgtagacttttgtctgctctatctccatccatttttgtgcactttcttactttttgacaacataagatcccccgggctcacgttgtattttctccacttcagtcctataatcaactatttctccaaggaaccctggttccctttattgaagaatggtttttagaaacctgtaactgtgctctagatatgctctttgttccttgagtgtctttgcttctaggccctcttagcaaacagaacttggcaatatatgtatgtataataacctatgtatactcactcatctatatttatttctgtatctatatgtttatatatttttaaaacatgaagtcatactgataaattttatttcagtccagcagcacaaggctcattctagccttcattcttccttttgtacaacttcttcctttgacattgaaaattctggctctcattatctaaaatgtatttacttatttgttttatcctaaagtagttttgaattgcttgcccatacccttgtatgagaaagagatttaccctttagagtataatatttgcttacagttctttttttctgtagcccaatagtgtccagtcaatatatagttatccaaagtaaattagctcttttatttcatccactcattatggttacattattcatttgtaatacaggtagggtcacttgttaagagtattccattttggtttcttttcacatcctgattggggttttattttctcaataaaattcactttttgtagtgtcaagttctgtgggttttgacaaacacataagatcatgtaaccaccaccatagttatgataccaaagagttacatttttcagctccggatttgcaaggatggtaccaatataaactcccccaattttatgagacggcactaattgttccacatctctaccaatatttgctactatccatctttttaattttagccattctggtgagtatgtaatagacctcataatgattttgattggaatttttctgatgtgtagtgagatggagctccttttcatctgcttactggtatttgtttttttgtgtgtagttttgttttgttttgtttttttgagatggagcctcactctgtcgcccaggctggagtgcagtggcgggatctcggctcactgcaatctccacctcctgggttcaagcgattcccttgcctcagcctccctagtagttgggactacaggtgcccaccatcacgcctggctcatttttttatttttagtagtgacggggtttcaccatgttggccaggctggtcttgaactcctgacctcaagtgatccacctgcctcggcctcccaaagtgctggggttacaggcgtgagccatcgtgcctggccttgcttactggcatttggatatcatctttgattgtattgttgttgggttcttttgcccatattgagttgtcttattgatttagaaatctttttacagcctgtatgccagtcttttgttagataaatgtattgtagatatctcctgctactctgtggcttgccttttcactctcttcatggtatcttttgataaacaaaagttcttgattttaatatagggcaattcataatgttttccccttatgattaatgcttcttatattccattaaagaaaatcatggcagatctcaaacttgtgaagatactcttctgttgtttttttctaaaacttctattcttttacttttttcaactagcacaattcatctaagattaatttatatatatatataaggtgtaggatagggagaatgattcatttattttgcccatatgaataaccaattgacctggcatcattcattgacaggaatatcctttccctaactgcattacattgacacctttgtcatgtttcagatgaccttatatgggtgagtctttttttaggctatttcattgtcctcattctctatcctttaccaattgcacactctcatgataacttaggtttataatcagtctttttatctggcaatgtcagtcttctgagtttgttcttcaagattatcctggcttttcttggctctttgcatttctacttaaattctagaactggcctgttaattgtcaccaaaggaattttttaaaaattccttactagagttttttcagattatattgaatctgcaagtcaatttggagaaaacttatttctttacagtattttgtcttccaatccatattttcctctatttatgcagtctttaatttttctcaggatgtttttttcttttcagtgtaaaggtcttgtatatgtatcttttgtaagattcttaggttttcgatgctatctatttttaaatggcatccttttaggtttctgtttctatttgttttttactggtatatagatttctaaataatgatctttttcacatattaactgcaataacatatcagataattattttggattttctatgcatataattataccatctgtgaataaaaataatttgcatttctgcttttccaattctcatacagtactttttttcttactacactagttagcacggtaagacatgtagaatacaagtaaattgaaatggttatagtgagcacctttgtcttattcccgatatcagttgaaaaaccatcaatattttatcaaaaaggataatgtttgctatagtctctttgtagatactctatcagataaaggaaatttctttccattaatagtttgctaagagtttttgttttgttcttaagagattttttaaaaatcatgaatagttgttgtatttcatcagataatgtttttgcatgtaaaattactatatgattttttcccttttttcttttaatgtgtgaattacagattgattatggaaagatatttcacctttgcattcttggaataatgccaacattgacatatctttttaatgtcttattggatttgatgtgatgttattttgttttctgtttgtttttttgagagagggtctcgtcttgtcacccaggctggagtgcagtggtgctctccaggctcactgcagcctccacctcctgggctcaagcagtcctcccacttcagcctcccaagtagctaggattacaggcacgtaccaccacgctaattttttaaattttttgaagagacgaggtctcactgtcttgcccagactgatcttgaactcctgggctcaagcaattcacccaccttgggctcccatagtgcggggattacaggtgtgagccaccatgccagccttgctttatgtattttaaagctatcttaactaagtgtatataaatttataattctcacgtcttcctgatgcattgaaccttttaccttatgaaatgtccttcttaatctctaatgatgcatcttgccttaatatctatgccagctttctattggttagtgtttacatgatatcttttttcattcctttattttcaacctttctgtgttcttatatgacttttgttgttttttaattaattctgacaatcttcatattttaatcagcctgtttatatttaatataagttactaatgtatttgtgttcatatcttacatcttactctttttgttctgtcttacatgtgtatcttcttttttctctcctttcctgctgtttttggattgatcaagtatttttttctttttcttctcatttagcttctcggtcttgccctgttgcccagactggagtgcagtggtgtgatctcagctcactgcagcctccaccttccagtttcaagtaattctcatgcctcagcctcctgagtagctgggattacaggcatgcgccatcatacccagctagtttttgtgtttttattagagacagttttgccatgttggccaggctggtcactaactcctgacttcaagtgatccgcccgcctcggcctcccaaagtgctgggattacaggagtgagccatcgtgcccagcctgaattctcagtttttgtttgtctgaaagtttccttttgcctttcaatgtgtatagttctctatgttgggagttatactttttgagttctttataaatggctttccattatcttttggattctcttatttttgttgagaagtcagctgttactcttattctgctcttttatatataatatttttattttctctagctgctttttagaatttgtcaaactttaactttatccttagttctggttttccttttatttatcctgctgggatttttagtgcttcttgaatctgtgattgatgactttcatcagatttggaaaattctcagccattatctctttagatactagaactgtttatacttgggaatctagttatacatatactaggtcttttcattgtatcccatatgccttttatgctctttgtgtgtgtgtgtgtgtgtgtgtgtgtgtgtgtgtgtgtgtgtgtgttttaccccttttcctccccgagcttcaggctgtatattttgcactgacctggcatttagttccctgattctctcttctgctttgtcccatctgcatttcaaaacatccagtgaggctgggtccagtggctcatgcctgtaatcccagcactttgggaggccaaggcaggcagatcacttgaggccaggagttcaagaccagcctggccaacatggtgaaaccctgactctaccaaaaatagaaaaattacctgggcatggtggcaggtgcctgtactcccagctacttgggagactgaggcaggagaattgcttgaacccaggaggcagaggttgcagtgagccaagatcgcaccactgcacacgagcctgggagacagagcaagtctctgtctcaaaaaaaaaaaaaatctagtggatgctttatttcaatagtcccttttttattttctaaagtatctgattatttcttattcatcctagttctgtagtataatcctctaccttgtcatctatttttttctaacatattaatcatagtagtaataaattctgtgtctgaaaactacaatatctcagtcatttgtaggtctggtttttaaagattttttttaatttccacataataattgcaaatatttatggggtacatagtgatgggtttggtgttttaagagagggtcttgctctgtcaccgaggccagaaggccagagtgcagtggcgtgatcacagctcactgcaacccgtatcttgcaggctcaagagattttcccaactcggcctcctgagtagctgggactacaggcacatgccaccacacctggctaattttttttatttttattagagatgaggtctcgctgtgttgcccaggctggtctcaaactcctgagcttaaacgatcctctcaccttggcctctcaaattgctgggattatgggcgtgagccacaacaccctgcccatcgtgatgttttgatacatataatgtatggtgatcagagcagagcaattagcatatccatcatctcaaacatttatcatttctttgtattgtgaacattcaatatcctccttctcactatttgaaactatgtaatatattattgttaactgtagttatcctacattgctgtagaacactagaatttattcctcctatctagctctaattttgtatacttttaaaaatctctccctattgcctcctccttcttacccttcccagcctctaatatcctctgttctactttttacttctgtgagatcaactttttttagcttccacgtacgagtgagaatacatagtgtttaactttgtgttcctggcttatttcatgtaacataatgtcttacagttccatccatgttatggtgaatgacaggatttcattcttctttatagataagtagtattcgatcatgtatatataccacactttctttatccatttatctgttgttggacatttgggttgatttcatgtcttggctatagtgaataatgctgtagtaaacatgggggtgcaaatgtctctttaacgtactaatttcctttcctttggagaaatacccaatagtgggattgctggatcatatggtagttctgtttgtttcttttctctgcatcctcaccagcatctgctttttttttctctttttaatgatagccattcttactggagtgagatgatacctcactggttttgatttgcattttcctgatgattagtgataatgagcttttttcccatttttttggccatttatatatcttcttttgagaaatgcctgttcaggtcatttgcccttttttaaaacagagtagagttttttgtttttatttgtttgtttgtttttttactgttgagatgtttaagttccttgtatattctggatattaattccctatctgattagatgagtaagttgtatgtatttttttctattccataggttatcttttcactctgttgattgtttcctttgctatacagaagcttttcagtttgacataatcccatttgtttatttttgcttttgttgcctgtgcttataaaaggttgtactcataaaacattttcccagaccaatgtcttgaagtgtttcccttatgtttccttctagtagttttattgttttgggtcttacatttaatccattttgagttgatttttacagagggtgagagctaggagtctagttccattcttatgcatatgactagatgcatatttagttttcccagcatcatttattgaagaaactgtgctttctccagtgactattcttggtgcttttgtcaaaaatcagttgactgtagatacgtggattaatttctgagttctctattctgttccattggtctttgtgtctgtttttatgccaataacatgctgttttggttactatagctttgtcatatattttgaagtctgatagtatgatacctccagctttgttcttcttgctcaggatgttttttaccatttagggtcttttctgattccacagaaattttagaatattttttctatttctgtgaagaatgtcattcgtattttgataagggttgtattgaattggcggatcactttgggtagtatataggtctgtttttttgtttttgttcggtttggtttctatttccttttggggcttgtttcttggtttgcctgataattttttatcaaatgttaaacattgtccataataaattatagagcttctgttagtgtagagtccaattagatctaggactaagccacctcaaggttgggttatagtttttgtaagacccagtctacctctcatttgcttccacttctataccatggccctcctggaatctcagctgaaatcctggtgtttttatgagatccctactcattaatgggttctgaactccaaattttatctgttttgtgtaccatacaactagcacaatcaccactctgccttatggatgccttatacttggtgtcttggcctcttgtcctgcttcctgacaagtgtggcaaataccttgagtagagtatttcctctcctgagtttcaggcctactttattgttttcccctcctcttcaggatcatgaccctcagttctgtctgtcttgacagtcccaaactcgaatttttgtcttaccacccactagagattgcaaaaagttatgttggcttctctgcctcttagtagtagtccattgcccagattctcagcctcttacccgacacaggaatttgcaaataccctagggagaaaacgactttttgaatgtcagtttagctctttaagatcctcttctctctgagaccttctcttgtcaaattttgactaccttgtcagctctctcatcccttctttatttaaaaaaaaaaattaagcttttctgcctttttatggtctgggaattggtttactacaagctatggcattagagcctaaccaataggtcccttattgaatacatttttttattattaaatagaaaaatacatagcccgagaaagttaagtgggcttatctgtgtattaaggaatactgtttttaggaatgtgacttaggaatactgttcttcataccgcactttgggaactgctggattaggtcactttcccaaggtctcagaattagaaacaaaagcagctagattagaacccagcctcggcctggtgcggtggctcatgcctgtaatcctagcactttgggaggccaaggcgggagggtcacctaaggtcgggaattcaagaccagcctgaccaacctggagaaaccctgtctctactaaaaatacaaaataagccaggtgtggtggtgcatgcctgtaatcccagctactcgggaggctgaggcaggagaatcgttagaacccgggaggcggaggttgcggtgagccgagatcacactattgcactctagcctggacaacaagagtgaaactccgtctcaaaaacaaaaaacaaaaaacaaaaaaagaacccggcttcttgaatcccagactagtccaatctgttccataccatgttaactcattggcttacatctgtggttttcaaccagaaacaactttcccccttcctttcagttatgacaactggctggtatggaagagttgggtcttccactggcattttgtgggtaaaagccagggatgctgctatatatactataatgcacaagacagccaatccacaataaagaattatctggcccaaattattaattgcctcaagattagaaaagccctgtcttacagtatccctcaaaatttatatatttaaaggatcactggctgattcctctttacacttaatcataaggtcaacaccaataggctttagtaggataaagcatctttatcctactaaactacatccagaggccctttgacccaagaaaatgtccatatatgatctagtccgtacttgcttaactgtgtttctcaaagcttttgccaaatatgctccaattctaagacttctctttagttagaatttgttagagctggaaaactttctggtgtagaattgtgcgtgcatatcttgtaaatgcattttgtatgcatgaatggatatctagatgatagtgacatttacctacacatttatagattttatttatatatatacacatatatacataatatatatgtattctaggcatatatatatatatacacacacattagtctaaatggttcttagaaaatttattcattttggtttataactctaatcaatttctataatcaaaagctcttgaaaatgtaatacaaatagatatttaattaaagaggtatattaccaaatgtttttcagaataattattgtttgtaccagtgagtatttctttcagaaattcaattagactctaaaattcatttttcagagcattacaacttggcggcaaaattttcttttggctgaaacactgcatgcaagcttttggctcagaaaaaaatctttggaagtatagctgaaaagtctgattcagataactgaatggctaaaattttccttgtttaaaaggaataaactggttacacgtgaaatattaaaaactgtatttaaatggatagttaactattgccttatttcttttaagtcttaaccaagctggcttatcctatttcaactgctctagaactcacatcatttttgattcattgattttttttttttttttagtatcccaatagaagccatcatttctaaggttccaccccaactttgctgagccttggcccagaaaatttgtttagcttttctctgctgttgttaagctattttaaattttaaatttttgtgtttttaaacctttctgtgtttttaaagcctttctggtttaataaacaattctaaaatctcaagaaaatatccaaattcttttgttaataatttggcacttagccatctattcaatttatttatcatggtaaattttgcttatacttaattatttcctctagtcctagaactccaccccttaccataataaaggggcagtttataaaacaggtgtttttgtaagtaatttacatggtttagtatgcaaaaagtacaataatagagctgtttagctgtcagtacttgtgaggaagtaagcagttttttcgttattaggatgaccatataacttattagaaaaactcagatgcttttgagagtgaaagagtggggtgctattaataatactaggacagttctgggcaaaccagcccatatggtcacactaatcattatagatatttaaacaaaaatatttggtaaaatgaatttgtgtattggttgaggtttttggctgtgtttatttctaacatttcttccagtgaaaagattcttgatcatgtgctaagtatatgccaggtaatatagaacttaaaaaaaacatgagaacctctaatctcaagcaggacaagttggagaggcaagatacttatagataatgcagtaatgtaacagcacaaataaattcaattcattatggttttattgagtgcctactgtatgtcaagaattgtggttataaagatgaacaaaacaaaaactccttttcttgaaatctagaagagacatacttaaataatatgatgtgaaaaatgatattattttcatgaactaatttttatagaacaaatggaacaagaagttggggaaagcttttcaaagcaagtgatgtatgaactaggccttgaggaatccttacaattttggcaagttgagattacaaaggtattcaaagttaatgaggtaataaaagcaaaaggcagagtccttcatatgatttgttacaagaaatggcagaagggagatatggggcaaccatctctgaaatggtaattgtgatgggatttaaatgctatgctgggcaatacattattaagtgcttaaagtatatatatatatagagaagacatcctttggactgagaaacattttgtgatcagtttaccgtaattccataaaagaaaggaatcacacttccatttgtttataaagccctgtttcagagggatcaacaaatactaaagatgaaaatcctttttttaattaaatgctaaagaataaaagctgcaataatccctctaaaaagtattagtgatgaacaatcccatggggttatagtgagacaaatgtgatagggttagaaaaattgtagagaaaaattatggtaaaagcactagggaaatgccttagaaaattaataaagattggcttggtttaaagacggtaaataaagactaatgcaaaaggctaatgaattcagtcatggagaaagtttatactatagtgtttgctaaaagaattaccactagatgggattttattaagcatttttttattcaaagaaaaagggtaactcattaataaaatgtgtagttgatactaaataaataaatcaactagtgtagttgatactaaattaggagatagtgtagttgatactaaataaataaatcaactagtgtagttgataataaattaggaagatactgtagctgatactaaattctagaaattctggtaatagactctagaaatagatgtttgaaataggtgtttaaaataatattttaaagaaaatcatattcaccccattttaaatccacatagaagcagcagttaacattaaaaacttgtgtccacttccaggagatagtcatggtttaagggtccagaaatcaatggtagaatcacctgaaatttagaacagtagaaatatgtcttcactaaagagtctaaattttttttttttttttttggaggagtcttgctctgtccccaggctggagtgcaatggcacgatctcagcccactgcaacctccacctcctgagttcaagcgattctcctgcctcagcctcttccaagtagctggaactacaggtgtgtgtcaccatgcctggctaattttttgtatttttagtagagatggggttttaccatgtttactaagctggtcttcaactcttgacctcaagtgatccacctgcctcagcctcccaaagtgctgggattacaggcatgagccactgcgcctggcccaagagtctaaatttataggatgtatatgattaaaagtgacttttgtgaacatttaaataaatatttgtgactgaattttctatggaacatttttccttcagtggcttgcattttaatgaaggaattattttaaaattaccttattccctcccaatgttgtttaaatatctagagggtatctagggcttaaggaagattggatgtggaacaatgagtggaggcctagagaacaagggtagtttcctgcaacagttatatggatccctagcaaggttcatatttctgtctatactgctggttaatctgaatattcccataaattgtggaacataatccatggccttggttttctgtttcttgtagtaagatttatcattttatttctaccataaattagagatcattacatgattactatgaaggatctacattgctatttgttatgatcaaataaacagtatttttgcagttgactattcagggatctgttaaagcatttagaccttaggccctcatagcatatatatataagctttttggagacttggctctcactactttgagaatttggcacacagggtaatcaaaaaaaaaagctttcttggctcttgcctgtaatcccagcattttgggaggctaaggcagaaggatcccttgagctcaggagttcaagaccagcctgagaaacatagcgagacctcatctctactaaaaaataaatagtaaaaaattatcccagcacagtgatgcgcacctgtagtcccagctaatcaggaggctgaggtgggaggatcacttgatccagggagtttgaggctgcagtgagctatgattgtgcacactccagcctgggtgacagagtgagaccctgtctaaagaaaaaaagctttctttcgaaatggcctcaggtttatcgatttttaatttaacattgctctacagatttattttgttgagtttttttttttttaagtactaagagtgttttgggcaggggaaagaaattcacagtgtttttttgttgttgtattttgttttgttttctgagacggagtctcgctctgtcacccaggctggagtgtgcagtggcacgatctcggctcactgcaacctccgccccctgggttaaagcaatcctcccacctcaacctccccagaagctaggattacaggtatacatcacctcacctggctaattttttttggtattgttagcagagatggggtttcaccgtgttggccaggctgatcccaaactcctgacctcaagtgatccacctgccttggcctaccaaagtgctcggattataggtgtgagccaccacacctggcctaccacaatgttttttaactgaacagttggctgcagtaagcttttagaagcctacacgttggtatttgagcatacgaggtggatcataatggggatcattaggtttctttgacaggtgatattaagaacccaacccagcatgccacttgtaaaccatctatacatagagacatttgtcaccattgacagttgtgacatttaatctgggatctatttgcaactcagcttcctatgtattactatgtatttaacagtctcaattcaggctcaaagcatcagcttttttcttctagtttttctaggttttacttaacaaaggaaaatagaaatatctgtttactattgaggtgatcatttctcctcagatgagtcatgccagtcacgattcttggatgttgacctcttgtgctgtttttgtagttcacaagccaaagctgcactaaataggattatggaaattagattaatggtccaggaatgaggcatagtgctttggttgaataggaaagtctgtaaagtggagccagtagtacctgaaaaaaacttaatccaggtgaggcagatgttctgaagaatctcactcgtctcacctggattaagtttttttcaggtcctgctggctccactttactgactgctattcaaccaaaccactatgcatcctttttggagcactaatctaactccaaaggggtacaacaacctcatcacttctaatatgaatacaaccaagatattgtgtgagctgagagtggcagaagaaaactggaaaaagctctctcttagatagccagtgtcacttggagaagtctattcttatgtaaaaggagttatattggtcttctaagaagaaaggttgtcaggaactggcaagcactaaaatgcctaaccaacaccttggagttagagcagtctagttttagaaggcagagactaggagggataatcagtcatagctaaagatagggaatctagaccaaagctcattccagttcctaggattagtgcagaatacaatttattaagctagaacagaagctttgcagtcacaattagatcatcacaacgtacatctggatgtcagaaataattctgcaccctactcttttttttttaagttaaagagactgtctcccaggctggagtagagtggagtgatcttagctcacttcatcctggaacacttgggctcaaacaatcctcctgcctcagcctcccatatagctgggactacaggcacacgccaccatgctggctaatttttttctattcttttagagacagggtcttgctgtgttgtccaggctgatttcaaattcctggcctcaagtgattctcctgctttggcctcctgagtcactgggattgcagggcaccctattcttgatttttattcttcccttgtcaggactagcttagaactgttaccccaactgtataagtaagtgcatccttaactatcaagacccaagaaagatatgagcagagcaaaatgaggagctcacgcaagcaaaattaagacttgaaatgtcagcagataaggtatctgaacatgtctatgacaggaagccagttgcaacttaactactgcagtgctaaattaaaccactgctatgtataccatatttgaagtaataattggatacaaaggtatatggcccttacttcaaagagcttatacttgtgaagtgtacactagaagacagtatgtagaaattttaccaaatttttatcaatttacagtatgaattttaccaaaaaattcactatagaaataatgcatgacttcacatcacactggtgatcagagaaacaatgtattttaaaagtgacatatgaactggtttgtgaaatacaaatgaaattttgatgcaaaatataactagaaatgaccttagatatcagctggtacatcttagaaattcgagaaaaattaagacccactactagtgggataaatgttggtgtacagtttttcttggtgacagcttgagaatacatatcaaaagccttaaaatatgcatatcctttgactcagtaactttacttacaaattaatcctatggaataatttaacatatgcacagatttacatgcaagaatgttcttcatagcattggtcttaaattttttaatttttttaacttctcattttgcagcaaaaaaaaagttgtaaaaatagtagatattttccatatatccttcatccagctttcccaaacattagcattttatataaccagagtacatatatcaaaaccaaggagttaataaataggtagaatttttgtcaaataaataaataaaattttaaaaccagcaaactactatagatgtgatactattattgaagctacagacctttttcagatgttcccaattatcccacttttttttttttttggtccaggatacaatctaggattctactctgtgcttaataggtaatcatattcttttattctgttactatctggcataattcttcagtctttttttctcctccttaacattaacacttttgaagagtactggccagttattttatagaatgtctctcaatttttgtttgactgatgtttccctgtgataaaattcagattatgcatttttggcaagaataccacagaaataatattatgctcttctcagtgaatcatattcaaagacgtgatactaattagcctcgatagtagtgatgttgactctgattcactttacttggttaaagtggtgcctgccagttctctccattgtaaagttagtattttttctttcttattgaataaatatctcatggggaggtacttcaagatacgtcttccatacatacatggattaatcttgcctgaaataattattactgtggtattagccaaagaattatattttatttttattattccttataaacttctcaattcaaaattatacacttattaatagagaagagctttcccctttttttgtttattaatttacttatgtcatatggactcatgaatattttattctattatttaaaatatattactatcactatttattgtgtttctcaaattgtcgtagatttgaccattggaagtgccctcaagttggttcttatgaacttccaatgtactacagttattttctgacttccttacattctgcgaccacaagatctccaggttcagcttgtgttttccttgccccagccatgaaataggaatttctccaagaagccctggtttcttttattgtacactaagaatttatacacacatctatatctgtgtctatatttaacctgtgtgcgtgtgtgtgtgtgtgtatgtgtgtgatatatatatgatttatttatttttttttttttgagaaggagtttcactcttgttgcccaggctggagtgcaatggcgcaacctcagctcactgcaacctctgcctgctgggtccaagcaattctcctgcctcagcctcccatgcccagctaattttttgttttgtttttttttttttagtagagatggggtttctccatgttggtcaggaatggtctcaaactcctgacctcaggtgatccacccgcctcagcctcctaaagtgctgggattacagacgtgagccactgtgcctggccctgtgtatatatttttaaaacatgagtacacagtagtatcacctattgcaatccaataccacagagttcaggactggcttagagctgttaccccagctctgtaagtgcagcctgaaccatcaagaccagggaaacatataagcagagcaaaatgaggagctcacacaaccacacatcctggttaattttaattaagttttttaaatatatagaaaattaccatggttctaaaagtcaagaactattcacaaagatagagtaaaagaagtgtcacttccctgacattactttttcgccattcttgttttagcgttcttcccaccctgttcccacctacctcttgtaggtaaccaatctcagttttttacttatcttttctgtatttcttctttttttttctaacagcttcactcagatataattcacacaccatacaatttccttatttaaagtatacaattctttttttttgtatattcataggttgtgcaaccgtgaccacgatcaattttagaacattttcatcatcccagaaactgtctctctccagcttcacccatcttctcccaaccttaagcaacgattaatctactttctgcctctatgcatttgccttttctggaaattgcatataaatggactcttacaatatgtggttttctgtgttaggcttctttcacttaacataatgttttcaaggttcatccacattatagcatgtgtcagttttttacttctttttattgccatgtaacattctattgcatggtttattcatttcctagggctgccataacaaattaccacaaagtgagtggcttaaaagaacaaaaatttattatttcacagttctgaaggctagaagtccaaaataaaaggtatcagcagggccttgtaccctctgaaaactctaggaaattgttccttgtctcttcctagctactgggctcctggaaatcaattcttggcattccttggcttgtagctatatcacttcagtatttgcctctgtcttcgcatggccttcttccctgtgtatatctttctgtgcccactccttttattttaaagacaccaataattggatataaggcctaatctaatctagtgtgacctcatcttaactaattaatctgcaaagactttatttccaaacaaggtcacattctaaggttccagatggacatgaattcaggggcaacactatttagctttctacatatagagatacaacattttatttacctattcttcagttaatggaatttcattcctgtatttatttatgcccagatgagcagatacatgagcattttcttatttctccttcctttttatttgaaaagtggcatactgttgatatgtttgttttttccttttttcagtttataatatattctggaagttttttcatatcacttcacagagctctagctcattctaatctaaatattcagccatagagaatttattaatatatacataagatggaaattgatttagtattttaatttttatgaacatggaatgatgtatacaatatattggggatgttttcttctataggttttttaatctgtgttttcaaggtattatattcacacagtatgaaattcctccttctagatgttacccatctaatcagccctttcccagagtgaaccaatgcttccactgaatgtcagctatacacattgttccacaccttgcctttttgcttaatatatcttagagattgttccatttttttatagctgtataatatttcattttcttgtcacatcatactttattttactaatcctcttttggtacacatcttggtatttctagtcttttgctacaacaaatataacagcactatttgcaatgaccaaaataattggaaacaaccccaaaggtccataaagagtaaactgaatatattatatatttatgtgatagcatacataatgaagagagaatgaatggattaccactcaactcaacaatatcaatgaatataacaaacataatgtggaacaaagtcagacccaaaagagtgtatacagaattccaaactaaatagggtaggaatagctcatgtcagaacagcccttcttcaggtagcaattataactcttaacaaaatattacaaaaccaactacctggagacactggagaagaatgaaaatcaggcagaaactgaaggagagtctatacttggaggaggagaatggccttgagtacatttcctatttttatgactctttctctagggccagcccaagttggcaccaagtagcatgcctaaaagttggtagaaaacacgcagtcttactggcttgaagatccagaggaagagtttaggtaaaaagtgagtgaggaaatttcagaaaggagaaaaaccatacagaggtagccctaaattctacatacagaccttatccaaatctctggatgacccctcaattacgcatatgcagagtggattcctagcagcccagctaaggctaaaagaacttaataaagatgtctcattgtccattgctggggtgcagagtttggaatttcattctagccaagtttacttgtctccttaaaaaaacaataataatcccctccttagaaacatttgagtagactgtacaacagaggtcagcatttttatttattttttttttttgagacgagtctcgccctgccttccaggctggagtgcagtggagtgcagtggcgcgatctcggctcactacaagctccgcctccccagttcacgccattctcccgcctcagcctcccaagtagctgggactacaggctcccgccaccatgcccagctaattttgtttttctatttttagtggagacggggtttcaccgtgttagccaggatggtctcgatctcctgacctcgggatccgcccggcctcccaaagtgctgggattacaggcgtgagccaccatgcccggctggcatttttttcttaaaggaccagagagtaaatattttaggttcacagggtactctttcagtaatttaaatatgacaaggagcaaacttgaatataggtatgtagaaattatcaagtgtggaaaatgaagagaaaaaaaacaatgaacatggccgggtgcagtggctcacacctgtaatcccagcacttttggaagccagggtgggtggatttcctgaagtcaggagttcgagaccagtctggccaacatggtgaaaccccgtctctactaaaaatacaaaaattagctgggtgcagtggcacacgcctatagtcccagctacttggtagggtgaggcaggagaatcactagaacctgggaggtagaggttgcaatgagccgagataatgccactgcactccagcccaagtggacagagcaagactccatctcagaaaaaaaacccacaaaaacagagaacagagcttccttgacctttaggacaacagcaaaaggcctaaaatgttcataattggagtctcaaaaggaaaggagctagagaatgaggcaagataaatatttgatgaataatggctgtaaggtttcccacttctggtgaaagacatgaacttacagatttgggaagccctgtgaaccacaggcagaataaatacaaagaaaaccacacctaaacatttaattagactactactgaaaccaaaagatgaagagaagatattgaagagcaaagtagcacattgcatagaatgggaaattatatgaacaactacagattccttacagtggagatcaaaagaaagtggaacatctttgaagtgctgaaacaaaactgtcaacccagaattctatctccagcaatattttccttcagtgatgaaggtgatattaaaacattgttatataaacataagagtatatactatgtgattccatttgtataaagtcaatggaaacaggcctcaagttacttttgatggggattagtaattgcaaggaggggagggaatttttcaccataatgaaccactccataaattagtaacataaaaaacagcagttttattttctcatgattctccagtcaaggctaggctcagccgagtagttctacttgtcttgacagtggtcacttgttggctacattaaggtagtacgttggctgcaggctagactcattagggatgttcagaactctctatttagtctaaaggccaacatttccagagtcagacttccaatttgtactcttctctgtatgtgtcatacctcaattaaaagcccactttcagactaggtgcagtggctcacacctgtaatcccaatactttgggtggccaaggtagaagaattgtatgaggccagggattggagaccaacctgggcaacacagcaagaccccatctctaccaaaaaaaaaaaaaaaaattagctgggcgcagtggcacatgcctgtagtcctagctactcagaaggctgaggcaaggaggttcgtggagcccaggagttcaaggcagcaacagtcagccgtgatcacaccattacactccagccttggcaacagagtgagaccctatctcaaaaaaaaaaagtctactttcaaagggcaatagataattatttttttaattacaatctaacaaaaatagaataatctaatataaatagaaactacaaaatgttccagaaaatgtaagtattcctgtgtgactagtgtagaattaatataagaaacattaataggtgataaagtaaaaaagataacttagggttagattacactgagatttgagtgcttggctacagagctgggtcttatttgaagggaagtgggaaactattgaagggttttgagcagaggaatgatatgttcaaaacagtggtttaggaatataatcccatgctagtgtacaaattagactagaggagggagagactattatcaaacggatcaatttggaaacaatttagataagcaccaataggaattgaattaaaataatagcaagctaatgaaaaaaagggaataaaatgtattaattctacatctacacagattgagagcctactatgttctatgtacttggtaaaggactgtatatatttttgtctttatagtcaaggaattcacaacatatgaaatgtagaagtatgaaaaaataacaatttgttgtaataagaactataatagatgaatatttaaggtgttaaggacacaagaagaggaagcagccaataatacagaggagtctaagacatgctttagataagatttaaccttacatgagtagttacagtttaccaaacaaagaaggcaaagaacaacattctagccagaagaaacagcacataaaaagtcacaggcaaagaagagtagagcatggtgaattgggggacatagttcactatatctacatgtgcaagctaagcataggtacagaagctagaaagataaggatcacatcactaagggcaaaagacatgaaaaatttggtgactatatgagatgaaacaagatttagtgactttataagaagacaaggatgaccttaatattttgaatttaagtgactagaaggataatgataaacccaatagtaagaattgtataacttatagacacttttcatctgagtggacattaaatacctaggagttctttttatatgtgtgtgaagaatagcactagatgtgtttcatcaatgaaattctgaatataaaataatcatcataggttcttaaagccagtcaacaaccaagaattgatactgaccactggcacagtttttttcaaaaatgacaaactttaaaagaaaaaaaaatgccttgaatgaatgtttttcttaactcagaagaaaagaaaaatctttaactacatatagcttacctgaagaaaaaacagaattgcagaattgctgtgaatgttctaaagacctggttctatataatcaagttaattcctctttcatgtgttttaaaatattgttgatccaagaaccaaccatcagctatgctggaagtctataattatgcattgatatatgagaaggctatcattctctacagacgactggtaccatccttagcagaatacttgaggctgcttttggtttagggaatctgtagctcagagattttcctagaaagtaacctctgttgttcaaattagatagccatttgtggagacaaaacccactgggtataggtagtattacctgaatcactaaaagataattgattagaaatccaaatcaaaccttgagactgctgagtctagatgagtggctgcctagggatagagggcaggaaggggtgggaccttacaaagacacatgaagaaacttttagaattgatatgtttgttgttttgattgtggtgatggcttcatgagtaatacctattcaaacttttccagttgtacacttaaatagtgcagtttattgtatgtcaatcatgcttcgataaagatgttagcaaaggaaatgactttcatcttagaatggtcagataaactgttttaagtgctacaccattatccatataaagaagagatggccatttaaaaatatttatacaagacttgaagcaatgtaggtaacctgaggtataataaattgagtgtcttgatatttagagtcctgatgtaatacactttattaagatatagatttgtaaatttatgctaattctggatgattatttttcttgagttggtttctatggactgaatgttaaagtgggttttaagcaggttttatataatatatcaataccacattagcttgattttttttattgcgagagatgcagaaagatcaatatcttacatgctctatatcaccataaatactttcaataaagcttttttggcctggtagggtgactcacacctgtaacctcaacactttgagaggctaaggctggagaatcacttgaggccaggagttcaagaccagcctgggaacatagtgagaccctgcaaaaaaaatatggaaattagccaggcatggtggcacacgcctgtagtcttggctacccaggaggctgaggcaggtgatcacatgagctgaggagctcgaggttacagtgagctatgatcataccacttgcaatgtagcctgggcaatagagtgaaaccatgtctcattcaatcaaacttatttgaaccttcgtacatttttgcttttattaatgagcttttcttttaaaatcagacttttaatggctttctggcagtgtcatcctggttgtggttgagactaatatgagctctagtttgtgttttttgttattgtttttgtttgtttttttgagacagggtctctctctgttgccaaggctggagtacagtggcacaattacagctcactgcaaccccttcttcctcccagactcaagtgatcctcccacctcagccttccgagtagctgggactataggtgcacaccaccacacctggccaatttttaaatttttttgtagagacagggtttcatcatattgcccaggctggtcttgaactactggactcaggtgatccacccacctcaacttcccaaagtgctgggattataagcatgaaccaccatgctcagctgagctctaattactgaagattaattctataggttgaacctggatatgttagaagacataggggactttcataaagaagttcaaattagaatatgtgagataggagaattttttaaaagaattgttatttgatacttagggtgtagtcatatactcttaatattgctagagtgtaaattggtaaaagttttcatatccttttatacagcaatttcagctcttggaatttaaataatcaaaagtctgggagcatctacatgtgaagacattcatgtcacttttatgtataatagtgtagcaacttgaaactatatatattatgttacatgaaaaataaactaacacagtgggttcattcactttgtgaaacttcatcacttatttgaggactttgagtataaacaaatcagaatataaaattacctgctattacgaagtagcaagagaggctgggcacagtggttcacacctgtaatcccaacactttgggaggccgaggggggcagatcacttgaggtcaggagttccagaccagcctggccaacacaataaaacccatctccactaaaattacaaaaattagccgggcgtggtggcatgtacctgtaatcccagctacatggcagactgaggcaggagaatcgcttgatcccaggaggcagaggttgcggtgagccgagatctcgctactgcactccagcctgggtgacagagcgagcaagagcaggcgagcaagcgagactccatctcaaaacaaaaaacaaaacaaaaacaaagtagcaagagtgagtatgccagtgtgctgggggtaagatgatttagatactctgtattttccatgtcttattttcatactttaaaaaacatatcagttgtttctaaaagaacatattccttttagttacaaacatatacattcagcaaccctaaagtagcatagactactactggctgaagctctggggttttattagtacagtgatgacttaattaacaaatcctctttgaacaaagcctcttcactcaagactggccttggtgcagtaggcatgagagaaggaccagttttctctgagctagatcggtagcagcagggactaatgaggcagggccttgaaagtggctctctctcagatctaactcctcagggactggctaaagctgaagctgagggtactggtgcactcctgggacctacacagcctggttacccaggtgttgaaaaaacagtttctgtgccaacaccatatgtggcttttaagagactcggcaggactcttgctttaggcagagcattccttgtgtggaatgagtaagctggaaaataacaaagagggaatcccatgtgctaggaagcttcctcttgtcttctgtgtgctccgtgtactgctttttcaattctctgggccttattttgttcaactataaagtaaaaggagtagctaaaaaatctctaatatatctttcagttctaatagactacatgtttaaatcaggaatcggcaaactttttataaagggtcaaatagtaattattttctgctttgcagggcatactacctccattgcaagtgctcaactctccctctgtagcgtgaaaacagctgtatataaacaaatgggtgtggctgtattccaataaaactctatttataaaaataggcagctagccagatttggcccacaggccatattttaacaagcccaggtctagatgttaatgtaatgggaatgtcatattaagagaattatttgatgaataggatataattcttatttcatagagaccattctctcagactttttatttttaaagcgtaggcaaatataaaatattatttcactgtcaggatgtaataccatgggaaaaagattaaaaatactctggcaccaaactgttgtagtaaattatctgaaatagagcctttgacttcccaattaaggaagaaaatggtgtctgcaacacctgtgactgggttattttaagtcttcaaaagttaggggcctagtagaagagagtctcaagggcttgttcattttctttctcatcaaatgggccaaatcatgcttttcatagtagaaggtaggctgtggaccctttactattttatttttaaatatttctcttggctaggcataatggcccatgcctaaaatcccaggctgaggcagaaggatcccttgagcccaggagtttgagaccaccctgggcaacatagcaagaccccgtctctactaaaaaaaataactttttaaaaattaaaaataaataaataattttttggtggtccagaaaggggcagctgccatgctttgcaggtttcagatccccatctatcttgggttgggtttctatcttggtcttaagttatcagtattctaatatggagataagtctgccttcactttggagacctttgttagttcttccatgtcaggcttcagctagtatagtttgtctaatgcatttatataaaacttgtttccaacaatgaaaaagcaattacaggttgggatatgtaattcaggcccattactacataaaaggatcagcacagtggtactttatctgactagggaagtctaaaatattcttgttggccagcttgctttcacataagcactgttcgggatcttttctaagttgcagaacatgaattccttattggcctatcccactagccacagctgtgagcacaacagaactgacacatacctggtaattataccttatctaaagtgaacagggccaccttcccagcatagtgacagctatagcccttaatctaatgcagtggttctcaaagtatagactcactgggggtgccctttctgaggctctttcaaggaatctcttctatgaaatcaaaactacttcacagtaattcaaatatattatttgcctttttgactctcaatgacagtagagttttccagagactacataatgtatgatatcacaacagattgaatactgaagcaaatgttaagaatccagctgacttctgttaaccagatattaaagagattagcaaaaacttaaatgtcatactctctactaatatttttgtttggaatatatagttattcttatgaaaatatgttaaaatgtaggtttattcagaaattttctgagatcattttattttctaatacagtaaatattaataaatatgactcacacaaaatctatttggagtcctcaatttttttttcttttttttcctggcttacattttttgatgcactcaatttttttttttttttttttaatttaaaaagagacagggtctcactatgttgcccaggctggtttcaaacttctgggctcaagcaatcctcctgccttggcttcccaaagtactggtattacaggtatgagccagtgcacctgacctcaataattttttaagagaaaaagtttgagaacccctcctctaatgtaatacccttagttgcaatactctgatctcatggttactgatatcatctttaccatattccctcttataaaatatttactaaaattatccccagagataacccttgttaacaatttagtgattacttctagacatctttctactgagtgcttgcattcacacataatatatatacttttacatttattggatcatactgtggtctttcaaaacttattctcctgagtttaatttttctacctgatcactctctgaattcttataaaatcttaagttcttttttttttttttttttttttttaagacagggtctcactcagtcactatcacccaggctggagtgcagtagcatgatcatagctcactgtagcctcaaactcctgggttcaaaggatcctcttacctcagcctcctaagtagctaggactacaggtgtgtgccaccatatctggctaactttttttatttttagtggagacaggcatctcactatgttgctcaggctggtctcaaattcctggcctcaagcaatccacccacctcagcctcctaaagtgctgggattacaggcatgactcaccatgcttagcctaaatcctaaggtcttaaaattgaaagggacagaggggtcatcttatctcattcccaactcaagtcagaaaccctctctaaaacattcacaacctgagaggtccatttaatttggttttataaaccctaaattgttagaaactttttccttctcttggacataaatttgccttcttgatcacttttacccataggttctagttctactttgggaaactatatagaatgcatcttatctgtcttcactgggcttcattgtgggtattttcttctgttctatcttccagttcactaattcttttttaagttgtgtctaagcttctattaaaactatccactaaatttttactttcaatttccatttaaacctgttgtattctagtcctctgttaaaattctcgattttatctttaactcttgctatttcaaagtttctgtttgttaagttcaatatctggaactgctttattaagctgtaatttctgctggttttaatttcctgcttgcctctttgtattactgtttattttttattgtgggtgatatgttgtatttgcaaaattgcttatagaaataatttgaagtataggatgattcatgtttgcttttggcaggcatggggacattggcacactatatttatcttcatctaagtttaaagatttagatgattagaggctaagctacaatcccttgtctaggtctttctactgcctgttcacacacccttaatccttttgattcccaccctgagataaggagattttaactaggcccattactcttgacagactgggttccagactttgtcctcctagcatcaaacaccagactcacttctctgggtttctatcatcctctgtattatagcctggtaattcttcattcttttgttaggacttcaatgccttcaaacagattttttaaaaatatgtccagatgttctaattcttgataagacagttggtctgaattacctaggctgccattagtacctgcaacctactttaatccgtattaatatttttctgtccttctggattgcttgggaaactgttaaagagcaggaataaccctgaccaggcatctgtaccacattcaaccagatgctctgtaagagctcctcttgaaggtttaatctgatattaatcagataggaagtacagttcttatgaacagattcagtcttcccacagggatgagttcagttaagaggggcaatggatacggtgtacagtggccccattttcctttatgtttatattctagtcttgtaataaaactaatgctcagaatgaaaggtctcaatttaggatttaaaccaagtataaacaaaaagttaaaacaagctattgttcaaactttgacttaagtgaaagaattggtttttttatttgtttgtttatttttgaggcagggtcttgctctgccacccaggctggagttcagggatgcaatcatagatcactgtaacctcgaactcctgggctggagcagtgctcccgcctcaggctcctgagtagctaggagaacaagtgacaccacacccagctaattttttaatttttttgtagagatggggctttgtatgttgcccaagctggtcttaccttctggcctcaagtgatcctcttgccttggcctcccaaaagtgctggaattgcagacatgagccaccatacccggcctggttttattttaaaaaacacttttgctgcccttctgtaaaatgttaattatatgtatgcacattttcttttatctggtgcttctctaaattcctttagcccacgtcttatccaactagtcatgtgggaatttcctctttggggaattaaatatttaatattaacttctaggtagtacagagcagcccactgtgtttcacttttgtattattcctttgttagcactaagttttctgtatcagcttgtctagaatttttgtttcaaaattgtattcttctaatttatttgcagtttttctcttctaattgtttaattgtccatcccctaccccctgccccaaggcaaatgtactgtcttttatccatatgtgcccataaattctaaactcaaagatttctggttctcccttatatttatggtatttttctacttctctgttcagtatatttttgcaagtgtttcagttttcttcagtgtttgaggttctctagtgtgtcatttcattttcatgcatcagagtaattcctaccattcttatatggagtctcttacctgatgattttttaattagtaaagtgcaatattgaacaacattgaagattttatttcttaatctaaaacataatatttatttaataatgaaatggaaatataggttttgtgaaagggagaaaggtgtttctctaaatattatacctgtgtcaaaaagctgcaagtgctactaccactgttttgtgacccctgaatgatttctgctttctttatattaatacttactctaatagtaattgaactcccaaaaagatcacaaagtccccaattgctagctttataaatacattgatgtgtaccttgtttgatgagataaaagcttcagtaagtgatatccccacctgtgtggttaatttcaaaatattgtttgtctaatacattgttgtcagtgacaactgaacaagaacttttagaagcagttggctgtccattaatggcagatttcaaggctatgcaaattgtgccagttcagccctgcattttttcgatattatcatatcaattgagtcagttcagagtagacaaagcaaggttatgggaaccacctagagcatcatgcaccatttaacatcaatgcagcatacatgaacatctgcaacttcgatcttattaacagaggatagaatggaaggcagtaaacagctttcttcatcacttaattgcaaaatagtatttcctaatgtttgcattgtttatcaacacgaacttcatcaataattgtataattatggttgcctagatcacagtgccctcatgcatcttgtcacttattatagagtggtctgagtttaatttgaatttgaacacatgatacaaggataataatacaagttccttgaaatgtgagttgcataatacaaaaattttgtgtagtaggagaatggcaagttatgattcttcagtcactttggggattaacacaaggaaaaacaggactgaaaggcagtgaaagatgaggggaagccactagttagattcaaacatagacccattggacatgagagtaggttatgttccttagaattaatcatgagtaattcgatgtttgctttaggcccaaattgagctgaattaaaacaggattattatgcttaggtcttcccttcagtctctgtagttaaagagagaaaatggcagaaaactacaaatatagtgaggaaaaagctatggtggccaaagttaaaaataccacatgctgaggaaagccttgacatagctgctcagccttcattgctgttgcttttgaagcctgataatgccacactactcctaattagcaaatgttagtattacagtaagcaatcaagtgcagtcttcaggctttgtggcagcagtttcgcagtgcaaaatattgaagaaaaaatgaaggaaaacaatataagctcagccacagttattggtgtggtcagtgggagttgtctcacaagagagcaggaaaaggaaaatgtgaaaaacagtgggtgcatttaaagcatgtaagacaagagctggctagtctgaaaagtttgtctattttaatcatgaaaatctcacatttttacttaaatccattttatatttaaggaaaaatctaaggcttgttcatgaaattacacttgaaatattttaatttgtggttagagtctcctccccatctcaaattaaaaggtattaaattgtatattgagtgagctccgtttgtactcagctcttcccaattaataaacatagtcatttccttaaaaaaaaaaaactctagagttagaatgttttctctcactaattagtctgtatttatgcctttaataattatctgttcattttctagcagcaaatgtttgttctcagattaaattggagaaggaaggaaaaaaaagatagctacccacagtatagtatccacagacgatatagagttatgtccctctttgtgtggttcttgagtataatagacataacagaagctttcttaatatgatagttaatctattattttctgtatttgggggatgctaagaactggtttactagaggtaatagtttgatctgtagttatttatgttaaaatacttttttaaaaggtaattacagcttctactataaacttgaaaaagttggtctaactctgtgccgaatgagcggggagatattactatatacatacatataagtgtatatgcctcttacctgaatacctcagggagcacacttttctgaaccagggttttgtaataaatgtgtgtactactaattctgacacatgtatagttctcctttaaataacttgtatgcaaacgttattcagaaacgtcttctaggagctatttatcaaaactgctataataataactttgtcctaatgagtttcagtctctgtttagggagtaatcgataaactacaaattaatgttccataattcacattataatgcacatataattattttgagatgaggcaaaccctatgcatttaatttacagctataattaagtaagctcatttgatactaattaagtaagtctaaaaggatcataggtttgtgtatttaattatcaaggtacaatcagcaactaattccttgaaaagctttcctatcttcagttcaacactgatctcagcccacactacaatttatcttcttgcatcttcaatagattaaaatgcattgtgaattgtggagaatctacttggtaagttagcttctttatttaaaaagtatatatatgtatatatatatacacatacataggcttaagaatacagaaattctataatctggcaaaactgtccttaagaagtgaaggagaaattaagacatttccagataaaagataaagaggtttattgccaatagacctgtcctacaagaaatgctaaaagggaatgcttcaggattaaatgaaagaatgctagacagtaactgaaagccatatgaagaaataaagaactcctgtaaaggtatctatataagtaaatataaaaaccagtattgctggtttgtaactcttctttcattcatgaaaggaaaatgcctaggccgggcgccgtggctcacacctgtaatcccagcactttgggaggccaaggcaggcagatcatgaggtcaggagatcaagaccatcctggccaaaatggtgaaaccccatctctactaaaaatacaaaaattcgctgggcgtggtggcacacgcctgtagtccctgctactcgggaggctgaggcaggagaatcgcttgaacctgggaggcggaggttgcagtgagccgagatcacaccaccgcacttcagcctggtgacaaagcgagactccatctcaaaaaaaaagaagaaaagtgcctaaaacaataattatatgttaatggaaagacatgtaaaatatgtaatttataacaacaacataaagagggaaacagagctgtataagagcaaggttttttatactgtccaggctaagttggtaacaattcaaactagattgttatgaatttaggattttaattgtaattgccatagtaaccactaagaaaataagaaataggtcagggcgcagtggctcacacctataatcccagtgctttgggaggccaaggcaggcggattacgacgtcaggagatcaagaccatcctggccaacatggtgaaaccctgtctctactaaaaatacaaaaattagctgggcgtggtggcacgcagcctgtagtcccagctacttgggaggctgaggcaggagaatcacttgaaccccggaggtaggggcaggagaatcacttgaacctgggaggcggagtttgcagtgagtcaagatcgcactactgcactccagcctggatgacagaccgagactccatctcaaaaaacaaaaaaagaaataaaataagaaataatgaagttttctctagttttgttaaagtagtatataaaaattagattattagaaaatacacttaattgctagcttagaagtcttttaaattctactgtcagccgggcacagtgtctcacccctgtatttccaacactttaggaggccaaggtgggaggatcacttgggcccaggagttcaagaccagcctctgtaacatagggagaccctgtctacaaaaaattaaaacaattagccaggtatgatggcaagcacctgtcatcctaggtactcaggaggctgaggtgggaggaccacttgagactgaaagattgaggctgcagtgagtcttgattgcaccactgtactccaacctgggcgacagagtgagactctatatcaaaaaaaaaaaaacaaattctgtcagtcaatcaactaatattcaagtatttaatatagtaggcttcctgctaagtttcaacaattgtctccatttcttcccactaaattttttaatgtatagtcaagaaggaagagctatctgatgtctagagtgacattctagtgttgggaaatgctagataagatgttcacattttcagatttcccagccacatttaagctcaaaaaatatgaatacttgtccccatgactttcctgaaggtctaaaagatatttctgtctccatcccttcaaaaccaagatacctgattgtgaggagtagaagacccctatatggtccagtgtatgttctcttcaatctcaaagcgtgtttagagtattgccattgctatcagaaatgtgaactttcccctcagatcctagattttcagattaagctaatcttagaacatgggctttcctccttccttatcagaggccactgtggtaaaatattatagaaagtaattgttggccagtcgcagtggcttatgcctgtagtcccaacactctgggaggctgaggcgggcagatcatttgaggtctggagtttgagaccaccctggccaacatggtgaaaccctgtctctactaaaaatacaaaaattagccgggtgtcatggccggcgtttgtggtcccagctactcgggaagctgaggcaggagaatcacttgaacccaggaggtggaggctgccaagatctcgccactgcactccagcttgcgtgacagagtgagactctgtctcaaaaaaagtaataataataattgctaatacctaatgttgcgctttacagctcacatagaacatttacttatattatctaaaatgaggtattaaaatagatgaacaaactgatatctgggctgggagggagttgttgcttcttttatttctttggggtactactagcacagcctgtcagtacattaaaaatagagactttttggcattactttgttttttccaagattaactagcacaacacaaatttcttgtgcctaggtgtaaccagtgttgagacttcacataccacacacaattaatgacatcaaccttgcagtactgacagcgatatcatgcccagtttgtatatggtgtctgggtcatctgaggaagttaaaatagtattgtgatctgtgaacaggccaagtctagcaggtgccatttgcatagactagaatataaatagtatcctctaaagctatatgatgtaatgtccctaaaatgaattatctcccatcttctttcattctcagaaacaaaaatactgattcttgtattgtttgatggaaaactattagttgttcaacataaccagcaaagtataaagacttgacacctaatggcttctgttttctctgagagttagaattagtatgtagcttaagaagagctgtaggcatttagaatgatatttggggtggtggtggggaaatggaggcatcagctagggatagtttagaaccagttctaaattgagtggaattgccaaaattcggtatggtattggataacaaatatggcctattttgacacagggtcttaattttttttttaataggcttgtgccattcttcttaatctaataggcattggcaatccctaattacggagaactggtttgtctagtgacatcccaaacataggaagaatgtttccttctttaaaattttttgatagacacttgagtcaaatgaagaaatcccagatgaaaaattttagaaaggacattctactctcctgtagaatgggaaaattgtcccattcagctagttgtaagccaaaggagaaaacttaaggggttgtattatgcagctacatttttgaactgataacagttacccttccctgtcctttcctgcctaaacagatcctgatgctgcaaaccaacatttctttctttttttttatcactgttgatgaaggttatttaaaacagaatcagtgatatgttagcaaatattttatgactggctttcaggaaaaaagaacatagattcatagcaattgtgtcatggtttaaatactcccaccatcaatgtgaggtcactgaatgtagatttgagaagagctttgtatatgcagaattaattctcattagccaatctgagcaggctccagcacaccactgacagttaaaagaggtggatgactgatgtgagtaaccacatgaatgaatgtcaaaaacattatgctaaaaaaaatgtgctgaggtaagaagccagatataaaagaacatatactgtatgattacatttatttgaatttagaacaggcactattaatttacagtgatagaaatcagatcagtagctttttggtttttgttttattgagaaggaatttggctatgaagggatatgaaggaactttctttctttctttttttttttttttgagacagagtatagatcttgtcactatgctagtagcgccatcttggctcaactgcaacctctgcctcctcagttcaagcaattctcctgcctcagcctcccgagtacctgggattacaggtgcccaccaccacgcccaactaatatttttgtatttttagtggagacagggttccaccatgttggccaggctggtctcgaactcttgacctcaggtgatccacccaccttggcctcccaaagtgctgagataacaggtatgagccagcacacctggccaagaactttcttagatgaaaatattcatagcagcattacccaatagaactttctacagaactatcaacataacaattgtattttcaatctctgcttaggaaaaataaccaaacagcaatttaaagatagcctgtaggccaggtgtggtggctcatacctgtaatcccagcattttgggaggccaaggtgggcagatcacttgaggtctggagttcaagaccagcctggccaacatggtgaaactccgtctctgctcaaaatcaaaaattagccggctgtagtggtgggcgcctataatccaagctacttgggaggctgaggcaggagaatcacttgaacctgggaggcagaggttgcagtgaactgagatcgcaccactgcactccagcctgggcgatacggcgagacttagtatcaaaaagaaaaaaaaaaagcctaatagtaagatggaacccagtatgctagtatatatttaacagtcagctcatagcaaaccaagccctagtttgttgtgttttctaatttctatggtgtaaatactctcaccatgactcaccattcaaactaccaagatgaaggcattgaatggtgagttggaaagagaaatgtacgatcaattcataagctggtgtgaactcagtttctgaactgcttctacccgtcactattattgacggactgaattttcttggttttagtttagttctttagattattcaatctttcccagagctgtgtctttgcccagagactttattgaacctcagagatgtctggctaggctgtagctcaactttagatcctttaacagaaggaagaacacgagggctgagtgcggtggctcaggcctgtaatcctagcactttgggaggctgaggtgggcagatcacttgaggtcaggagttcaagaccagcctggccaacatgatgaaaccctatatctactaaaaatacaaaaactagttgggcttggtggtgggcacttttaatcccagctacacgggagggtaaggcaggagaattgcttgaacccaggaggcagaggttgcagtgagccgagatcatgccattgctgtccagcctgggtgacagagcaagactccatctcaaaaataataataataaggaataacatgcgtatgatccttaaaatatttctgcaactttttttttcccctggtgctgcagcttctattcgtaaagaatggtgaggaacacaaccaagctttaaaatcagtgtacttgagaggttttgttgttgttgtttttacaggtaattaaccatatgttacacattttaatctgcttttaagtgcaagagagattggcaaatgacttaataaagaaatgacttctgcttaaattggataaaatggttgtttactggtgtttattgctgtattccaagtagacaagtaatctgtgaatccagtttagtttattggacaataaatggtactcagaacttttatcagtgtttgattgtcaggatgcccattgaaattgacttcatacttagggaactttaattttattgtacagtatgcactgttaaaaaaaatatccttgtctttcagtataaacctatgacattgccttgtggcattatcatccctgagatgctttcttgctctaagatttcttctatgtcataaagaaaaaaggaacttttggttccttcatatctaatgcagttttttcttttgtaaactctaaatattttccattgccaccatcaacaattcaaataacaatcttactgatggaaagtccatgattagaaatagctgcttcttcaaaaataaagaactttgtatgtacctatccattttgaaaatcttaaccattgtgctcagaaggagagatatgattttaagaagggtcacatttagaataccaataatgtcctactcctgaaataattgggaccaggccgctaaaaagaaagcacctgatgtttggcctttcagtattttctataactatgacgccttggtccaaattatctaataaatgcttcttcctattctcccgccctaagagtccatggtctctttataaagaagaatcatatacatacagatattacttgaatttatatggcatcctcatgaggtgaatcccacctatgtcacttaggattcatttgattgccctggtttgatccaattcaagtattaattcaggccaggtgcaatggcacatgcctataatcccagcactttgggaggccgaggtgggcagatcacttcagttcaggagttcgaggctagcctggccaacatggggaaacccccgtctctactaaagatacaaaaattagccgggtgtggtggcaggcacctgtagttccagcaacttgggaggctgaggcaggaggattgcttgaacccgggaggcagaggttgcagtgagtaagccaagattgtgccactgcactccagcctgggtgacaagagtgagaccctgtctcaatagaaaaaaaaaaaaaaggccaatatgggcccagggcctgccattcagacttccgcttgtggcagagaccaagggatggcagcaggttagtcgcaggtgaagtcataacaagcggtgtggagccgcacctgggcaacatgtcggaaggaaatgcagtgagcgaacccagcactctgcaagggccccgacccctcctgactggggcccaggagctcagcaggcagcgactggcaccccttcaccccgggccgccttcccttcatccgctctgggaaccttaccctgggggttgaggttgggggtcaagaagaaaaccttcaccccaaatatcatcagtcagaagaacccaaggaagaagtaaccgtcaagaaggagaaacatgaaagggacagagatggacagagacaggtgcatggacagggatgaggccacccagaagtgatccagtctcactccatctttgagaagggcccagctgaaatgatgaagaaaaaaggaactggaataagaaagtgaatgtgtcagacatgggaccttctcatatcgtccacatcaaaaaagagaagaaagagttggacgaagacacgaaacatctcaccatgctgtagaaggacgatttcattgatgaccctgggctgaggaatgacactcgcaacatgcctgtgcagctgccactggctcactcagggtggctttttaaggaagaaaacaatgaaccagatgttaaaccttggctggctggccccaagaaagaggtgggggtacctactgtgaaactgaaagaggagctacaagatgaggaggaggccaagataaaggctccttccagagcagccaggaagacccccgggcctcccgaaggacatatccgtggcagagctgcccagggagctgagcctcaccaaggaggaggaattgctgttcctccagttgccagacaccctccctggccacccacctatccaggacatcaagcccatcaaggcagaggtacagggcaaggacagagaggtggtactcatcaagcaggagaacgaccaggaagccaggctggcaaagaatgcttctaccctagctgacctgacagagggtcaggttggcaagctgcccatctgcaagtccgaaagggtgcaactcctcctgggcaaggtgactctggacgtgaccatgggaaccgcctgctctttcctgcaggagctggtgtctgtgggccttggagagagtaggactggggagatgatagacctgggacatgtgaagcacaaacttctgtgttcccccgattttgaatccctcttggatcacaaacactggtaaaatgatcagatggaggaggatggcggctgctgtctgctccagacattttgttctcgaatctctgcaacccaggagaggccagttgagcccacccactccagcctttggcagccattgtcccagtttcccccagggcccacagggcttcctcccacagcagctgtgaatggcacagttaccttcccacagtgtgaagatggtacatccttgctgctggggacttgtccatgctatttgtttttgtatttatattttgtattttgtcttaatctcttcaactgactgcatcctcccaagggaggagggaggatctgtgggaaggtgcaggcttttggtggctgttgggccgtcaggcagcaagtgtgaggactgcagcttttgctggtgctcccttcttcctcccagaggcagtataggagagagagcaaggattgagtctgagacttaagcatggggtcccaactcatcagttcctggttctgtatccttgcgcaaactacctaacctttctgagcctcctgttcctcatctgacaaaaatggggatgatacctacttcacagggttgacgtgaggattacatgggatattatagatgaaaactccttgcacaaggccagaaccagtagccactcaataaatgttaatttccttttaagtaaataaataaataatcaaatgttaattcaaagtcccacatgagagcgttctgtgttttgtggtgtttgttttgttttgttttagagacagggtctcattctttcacctaggctggggtgcggtggcacaatcacagctcactgcatcctcgaattcctggactcaaaggatcctcctgcctcagcctcctgagtagctggaactatagacatgtgctaccatacctagctagtttttttttttttttaatctgtagactgcctctgtggacagtttttcaaattttttgtagaaacagggccatgctttgttgcccagactggtcttgagctcctggcctcgagtgttcctcccaccttggctgagacgacaggtgtgagccactgcacgtggtcagccttctatctttaaacaggatctgaatctagattcatcaactcataaatatgttctcatttttaaatgatggaatgatggaaagtgaaagcaccaatcaaatcatattttcattatttccagaatgtgttcagcacagttaggtctggaaaggtttttgggaaaggttgtgcaaggttgaatttattcactgttgaaatagcacctctaaatttcaagcaattgtatgatttacttttatacaagtgtcagaaatgctaaattattaaatcccaatggcaggatcactgacaactagaaacttgagtttatttgcttccgtggtttactaaactaagctagagaaatatagtacagttatttactacttaagatcagccagaaaatgtatagtgagttcatactgtactagattctgggagataatcaaatgtaaaacatataccagtctcaaggaagttaaaatctagtaggaataatcactatattcagcaataattgttaattgagcacctactctgtactagatacagtactaagagctgggaataagattaagtcataattcctacctataaggagttcaaagtttagttgagaagacatttgtaaagaagtaattgtaactatgatagataccttcctggaagtatgtgaaggttataagtgatggcataaaagagaataatcagttctgcttggaggccaaggactatagccaagaagacatgccttatttggaactaagagtgaaagacaatttgaaatgtagacttgatacatacacaagaataaaagatcatggcacatttgggacatcatgagtatgaccaaagagtaactgactaaagttactcttttggtcagggaaagataaagtttgaacaataggctggattcatatcctagagttaagagttcattcaatagagaaccattgaagagtttttaacaggggaataacatcagatttgtattcatgaaaaagtactctgtttattcatcatatatttattgagcccctataatataccaggcatagttctggatgctagcaatcatcagaaaaaaatattgccttttctatagctcctcttacctaggcagccaagttttgtgccctgagccctagctcctttcctgtgctcagctgagtgaatcagggttaggaacataaccaaaggtagacagtccatagatggtcagtgagctatgagctaaaacagcagaggaaatcagttttttgtctgtctgtttttgatgtaggatctccctctgtcacccaggctggagtgcagtggtgctatcatggctcactacagccccaacctcctgggctcaagcaatccacccaccttagttagcctcccaagtaactgggactacaggcacgcacccccatgcccggctggcttttaattttttttgtagagacagcttgttgtgcaggctggtctcaaactcctgggctcaagcgattctcctgtctcagcctcccaaggctctgggattacaggcataaatcaccatgcctggctggaaaccagttcttcagataagagagtgcagcatgtaacatttaaagaagtagagaccaggttgacatgaacagctttatagtaagattaaagtgatatgcttcatttagtgaacctattaaagataacagaaacctcgttaattcattatacacacacacacacacacatatatacacgtgcatatatatatgtgtatatatatagtcaggtgcagtggcccacacttgtaatcccagtacttcgggaagccaaggtgggaggatcacttgagcctagaagtttgaaaccagcctaggcaacatagggaggcccatctctataaaaaaaataaaaataaattagctgggcatggtggcgcatgcctgtggtcccagctacttggaaggctgaggcaggaagatcacttcagcccagagctcaaggctgcagtgagctgtgatggcaccactgcaccccagcctgggtgacagagagagatcctgtctctaaaaaatttcttaaatgcagtcacacacactaaacaaaggggaaataaggttttagagcagtaattccatctatcattgttttcttggtcatttttccatggaaaactatttttgtattcaaagtcaacactcattctcttatatgtttacattcagaactgaagaccttaactggaattaacttaaaacatttgtagaaaatcagatgcaaacatgaacaaactaagagattttaccacaaacaatgatgtagaggcaggtagtctgcaaggtcagaaccatgccttcagaagcagcaattttaagtgagacctgaatctcctatactcaaaggtcttgcattagtcaggattctctagagggatagaactaataggatagatatgtatctatataaatgggagtttattaagtagtattaactcacacaatcacaaggtcccacaatagaccacctacaagctaggagcaaggaagacagtccgagtctcaaagctgaagaaagtctgacgttccagggcaggaagcatccagcgcaggagaaagttgtaggctgggagggtaagccagtctggccttctcatgtttttctgcctgctttatattctctggcagctgattagatggtgcccaccaagattaagggtgggtctgccttccccagcccactgactttggcaacaccctcacagacacacccaggatcaatactttgcatccttcaatccaatcaagttgaccctcagtattaaccatcacaagtttcatttcaagattaataatatccttgtccatttaatcataaaaaggaatgcttattatgtgccaacttttccaagtgctttatatgtattaactaatttactcctcagaaaaatcctgtaagtacctgcaaatgctattattgttccttttttctttctttctgagacaacatctggctctatcacccaggctggagtgcagcagcactatctcggctcactgcaatttccgcctcctggactcaaaccatcctcccacctcagcctcccgaatagctggggctacaggaatgcaccaccacacctggctagtttttttgtatttttttgtagagatggagtttcgccatgctacccaggctggtctcgaacttattagctgaaacaatctgcccatctcagcctcccaaaatgctggggttacagacacgagccaccgtgtctagcctcctattttaaatatgagaaaattggcctggcacagtggctcatgcctgtaatcccaacactttgggaggccaagttgggaggattacttgagcctaggagtttgagaccagcctgggcaacatgacgaaaactcttctctacaaagaatcagctgggcatggtggcatgcgcctgtaatcccagctacctgggagtctgagataggaggatcacttgagccagggaagttgaggttgcagtgagccgagattgcaccactgcactccagccagggtgacaaagtgagaccctgtctcaaaaaaaaaaaaaaaaaaaagaggccaggcgcagtggctcatgcctgtaatcccagcactttgggaggccaaggcaggtggatcatgaggtcaggggttcgagaccagcctggccaatatggtgaaaccccatccctactaaaaatacaaaaattagctgggcgtggtggcacgcacctgctgtcccagctactcaggaggctgaggcagaagaatcgcttgaactcaggaggcggaggttgcagtgagctgagattgtgtaactgcactccagcctgggtgacagagcaagactctgtctcaaagaaaaaaaaaaggaaaaaggagaatttaatctgattaccagattgtaaatggcaaatctggaatgtgaacccaagcagtctgacttatgcacttaaccacagttatactccctctactctctatggagaatttatcaacttaatttagtcaaatttggttatcagtaccaggcttaagggaatttaaatgtcagttaactgctgtgtaacaatgaatcaaaatctatttattccatcatcacctttttttcaggaaaatagtagcaacattacttgaatgacaactttgggatcatattttactacttctctttcattcatttgtcccaaattcctgcctttgccatgggactctaggcagttgacaaactctgtgagcctcagagtcatcatttataaaataaggttagtgataccttactcatgtgagaattagatgagataaagtatacaaagcatttgatgcagtgctttttcactcagataactaccgttgcattccattgcctgatgtatcaaatccaaacttttgcgtggctttcaaagtctccctagaaatggctagatcccacccatcttgatttatttcttgccttacttgatatataaactttcttctgtctctattcctcttgggacatacacacctttcttttcctctctttttcattatccacatgtttaagacctagtttaagttcagtcttctccgtgaaagcatctccagttaaactatattgttctttcccttttttgaactcctgttgcagttataatagatgttacattgtgtgatatttcacaaattctttgatatatgctaggtttctctttccatctagattctaagctccttgagaagatagatcatgtcttaatatttttcctgtatctcccccagaggatctaacagagtatcataactattgttctatgagatctaatgagctcacagctattgttcaacaaatacttattacctgattgaagaaaataagctcctaaaaatacctgataatattatataggtctttatattgtcagggtgtttttataacactgttaatacttaatccatataatagtcacagaaaataggtagaacagatattatcttcattttttaggtaataacactgagtttaaattacattgtggcttgcccaaggattcttggtaagtagcgttattgaccccaccctcaacccctgccattccagtccattgtccgttctctatcaggctgccaaaataattttcttttgagacagggtgttgctctgtcatgcaggctggagagcagtggcacaatcatagctcactgcatcctcaaccacctgggctcaagcgatcctcccacctcagcctactgagtagctgggaatatagatgtgcaccaccacatccagctaatttttccattttgggtagagatgaagttttgccatgtctcccagtctggtctcaaactcctgggctcaaccagtcctcccgcctcagcctcccaaagtgctgggattatagacatgagccactgtgcccagcaatattttcatatcaaagatgagattgcatcactcccttatttaaaactttccaacagtttcccattttacatagaatgaaatcctgcaaaacccccacattcagtatactccaggtacagtggccttctttagcttcagcagtcttagtttgccaagcttgttgctagtctggggcctctgcacttgaatgttctacccctggaacttcacatggcttgttccttcttacccttgaaatctcaactcaaatatcacctcctcagtgaggaagtaatacctatgtaaattaactcccctcccttgtcacacttcatcatatcatcctgttttattttctgtatggcacctattaatatctcaaattaggccgggcatggtagcgcatgcctgtaatcccagcactttgggaggccaaggtgggtggatcatggatcacttgagctcacgatttcaaggcaagcctggccgacatgatgaaaccctatctctactaaaagtacaaaaagttagctgggcatagtggtgcacgcctgtaatcccagctaagagtagctgaggcacaagaatagcctgaacccaggaggtggaggttgaagtgagccaagaccacaccactgtaccccagcctatgcaacagagcaagatgctatctcaaaaaaaaaaaataatatatatatatatatatatgtatctcaaattagcttgtttatatatttgttacttgtgtattgtctatccccactagaatgttggcctcataaaagcagagtttttatcctattcacatctgtattcccagtccctaataaagtacctgacacatggtagagtcttaataaatatttattaaataaaatagctaagcccgaactagactaaaactatggcttttttgctcctaatcaagtgtacttcccatgaacatttaatttttcctactttttgtggaagcacttatacctttggaactacagtaagaattgatgttcagaataatgacattaagatgtgctgtaggattctctattatcaaagaaaaattttattcagttcaataaactaaactaattaaagcagggatgtcatggcatattattatattaacacatttagaaagatttccaaataaaaagactttctgctttttctttagttaactagaaaattaaattaactcagagctctttatgcctcaaaagtccttgttaattaggattgttctataaatctctattattagcagagttcatcatcttttttattgccctgtttattagggcagtctaagcagggtgtctttgctcatatcctgatatgtgtgtcctagtgaaaagaaaagcatttccggattctcattttttccctattccttgatataggcatatttcatgctgttagtataacaatttagtttccttctatcagttctctccataaagctggaatgatattattgacctatgaagcaaaataattaaatttaaggtctgtttaaaagcattaatgctttgtgacgttgtttatgataatagaagattgaaaatagcctaaaagtccatcagtaaaggattggttaaataaattatactatatccatgtagtggactattatgcagcaataaaaaataatgaggacattctctgtttaccaatatagaaagatatccaagattttaaaatatgatccagagtagcctagatagtatgatacctttttttgtgtgggtgaggggaggaaaaaattaagaatgtagtttattgtatatgcatagaaaaattctagaaggatatataagaaagcaataacagtgataaccagattgggaagtagaaggagcagaaaccagctgaagggcagagatgaggagagggagattttatagcatagcttttcatatgttttatatttttgaatcatacgaatacattacctactcaaaaagttaaattaaaaacaagcacaactaaaagtaatatgtggccaggcatggtgcctcacgcctgtaatcccagcactttgggaggccaaggtggatggatcacttgaggtcaggagttcaagaccagtctggccaacatgatgaaactccgtctctactaaaaatacaaaaattagccgggcatggtggtacacacctgtagtcccagctactcaggaggctgaggaaggatatcgcttgaacctgggaggtgaaggttgcagtgagccaggatcgcaccactgcactccagcctgggcgacgcagcgaaactccatctcaaagaaaaaaaagtaatatgtgattctggactgaattctataccagatgaaaaatattgctataaaatacattaggacaattaagaaaattgaactgtggactatagattagattaaaatgttgttttctgtgtttatcaactataacctggctaacagaatatcatcactcttaggaaatacacactgaagtattaaggggtaaaaggcataatatataccacaaatgctaaataaaactttgaaagaataaataatgttatatatatgggaggaatgatcaactaaatgtggcaaaatgttaaaaaatggtaaatctggataaatgttgcatagaaattgtctgtatttttctgggaacttttctgttaatttaaaattatttctaaatagttttttaaaagaaacaaacaaaaacattttaatactatggatattaccttattataagcaatggcataagaatgtgaagggttctggtttttacgtagtcatacttttcactttctggagaagtttttaccatcacttttctgtttcttccatgcctattgatgctgggtcagaggcagtggcaggggtagtgactgaattttaccttgaggttgaaaaacaccaggccaagtgtggtgactcatgcctggtgtttaggaggctgaggcaggaggatcacttgaagccaagggctcaagaccagtctggagaacacagcaagaccctgtctctacaaaaaaaatttaaaaattagccaggcatgttggcttgcacctgtagtcctagctgctcaggaggctgaggcaggaggatccttttagcccaggagtttgaggctacagtgaaccatgatcacaccactgcactccagcctgggaggcagagtgagaccttagctcttgagagagagagagagagagagagagagagagagagagagagagagacagacagacagaaggaaaatgaagaaaggaaggaaaaggaagagagagagaaaagaaagaaagaaaaacacctgcctacctgcctttcaacctgctggatcaccttcacttgtatcttctcaacagtttaggacatcaacaaaacagtaacaatgtggcattttaaaaattctttgaacaaaattttctaaggatatcgtgaggttgtgtgtatctagtgctaaaatatatagttaatttagtggaggtaaacctgcagaaacatttaattgtttggcattgagtaactggatttgtattattgttcaattagatattgtggcaattgtagaaacttaaccatctctaatataattgactttcattattgatgcatgaagatgtttttattctaattagattggcctcttaagtgattaggtagtgaagcttgtctcatatttaagtgaagagtaaattatttgtatgaagtgtctagaggatgcctaaaattgattattttgtattctaggtaagctaaattttattgttttgaatgaaggcactctgcaagtcttatctaataaatgacacaaaacaaatctgttatcaactgaattgttagtgtttgtttcctgtctgcttggggaagcttatgatttagtggttttttagaaatccagaaagtaggaataataattattcccaacccttttccttctcactttacaaaaagtttgtgaagaattgagaaataaatgctacgaataatcttaagctcttaggtagaagtacttgatcaaaactaaccaggtcatttttctacaattagtgcagaaagctagtttttactaattgttcccacagctactccaggcccatttcatgcctaagaaaactaggtcccagtgagagtcatgtgagtgttgtaggcttcattggttgaataacgtccttacctgtaagtgtatattcagatttagtgaatgtacttcatgtgttcatataataaatttcctagaatagctatggagtaggtcatgccggtaaaaactgttagttttgtgacttttttttttttttttttttgagactgagtctcactgttgcccaggctgaagtgcagtgacatgatctctgctcactgcaacctccgcctcccagattcaagtgattctcgtgcctcagcctcccaggtagctaggattacaggcacatgccaccatgcccaactaattcttgtatttttaatagagacagggttttaccatgttggcgagtctggtctcaaactcctgacctcaagtgatccacccgcctcagcctcccaaagtgctgggattacaggcatgagccactgtgcccggccatgactttttataatagatctgtaaaccagcttaagtcatttgaaaatcagagcatactgaaaatgtaataaaacataaatattattgaagatttttcagagtcatcattttgaaaggagttcttgtagttctttagataatagaaaataatgaaaactgagtttatgacgcatcttttgcatatatgatattcttatatacttatctgtactgataagtataaaaaggtagaaaataattctactttgtatttcaggaaattgagcttcatatgaaaactaaggataaagtatctcaatgatgtgtgtgtgtgtatatatatatatatatctccagaaaaaatcattataaagctgcatttatgtagaattttcagcaatttagataaataagtcatgatttttttttttttttcctccgagagggagtctcactctgtcgcccaggctggagtgtagtggtgcgatcttggctcgctgcaacctccacttcctgggtttaagcaattctcctgcctcagcctccagagtagctgggatttcaggcatgtgccaccatgcctgacaaatttttttttgtatttttagtggagccgggattttaccatgttgcccaggctggctgaactcctgacctcgtgatctgcccacctccacctcccaaagtgctaggattacagatgtgagccaccatgcctgaccagaagtcatgattcttaagaataaaattcaaaataatctcttccgttgtcgattaggttctgttcataaataaatatttatgcagtcaaaaatgaataattgttttcaaacgaggagctcaaggaattctatgtaattttggtttacttactatttatatataattattttccaatctgtaagtctagtgattaattcttatattacctaaaatgttttatagacatgttagattattacataatgtaaatgtattgtaaatagtaatggtttcattaacttgagctcattttacttatttagtacctgtttggttttagtttatagttgttatttccctgtatagtgtagcttgtacttggaagtagtaaaaccagatttctttataagtatttatggtacagaccttttcctaaatcagactgcagacctttcctgagtatttctaataaagtctgcttacattttttttttggcctgcatagtagtttgtgctatatatactctctagaaaatgtaattctggatatttgtgccataactttcaattaatcaaaatcttgtcaactgccatataggccctcatgttacaaaatgtggaaagttcagttacttaaagagtttggctgggcattgtggctcacacctaatcccagcactttgggaggctgaggcagtcagatcacttgaggtcaggagttcaagacgagcctggccaacatggcaaaacctatctctactaaaaatacaaaaattagctgggcgtgatggcacatgactgtaatcccagctacttgggaggctgaggcaggagaattacttgaaccaggaggcggaggttgcagtgagctgagatcacgccactgcactccagcctgggcaatagaatgagactccgtctcaaagaaaaaaagtttaagccagatgcagtggctcatgcctgtaatcctagcactttgggagaccaaggcaggaggattgctcgagcacaggagtttgaaaccagcttgggcaacaaagtgagaccctgtctctacccacccgccccccaaaaaaaagcaaaaaattgaccagctgtggtgctgcgtgtctgtggtcccaactacacaggaggcagagagaatcccttgagcccaggaggtcaaggttggagtgtgttatgattatacaactgcactccagcctggatgacagagcaagacctaaaaaaaaaaaaaagattttaaaaaagattgactaagtgaatgagtcctcttcttgaatatcagtcattccaggagagtattttcattaacatatttatgtctcttgttgaaagtatccattaagagcaggtagcaaaagctagacagaatatgcttttgaagattctctatgctctttattaatacctttcttaagtttctcaagatctccttttgcctccctcttgatcttaaacgagactgaagtttaagagtctttagccactctgtccccatagggatgcaaatttatgatttcagaagttccagcccccaataagaagcactgtccaatcgtttgcagatgtatcttgtaagccagatttcatgacagataagtccattccactgtcatgtgccatgtttaaagtactaaattaggttactctgtagtcaaaacaagtaagccctggtccagactactctagggcaaaatcccgttgcactgtcccttttgttctgcccatgcattcagttgtagctttcccttttgccagttgacagatagtgacttctttgcaaaacataaccagattaggttatttttagtaaaccaactaaaataaaaaattcttgacattgggaagaagtattttaacagaataatagtaatgtttttattgtgccattgtgattttctataaagaaacacccaatattcattatttatatttttttaaatttacaactctttaactgtatccaacatttcactgccaggaatatagtcaggctcgaagcttttttagaaacccatgatccaatccataccaacacttcctttagtttatggcttctgttcatttgcactgtccagaaaggtactgctaccatttgtagtcactccaaaaaaaagtgtgaactacctaggtataactctcataagacgtatacagcagcatctgtatgctgaaagttaccaaaaaagtattacttgcagatgattttgcaccttagttcccaagtgcccctgtacagaatatggagcttatgtcctgtctctctttgaatgatgagtgatgaaggagcttcagatgttactgggtgagcttgtattgagtgttacaaagagaagtcattctgcctttctttggctctaattgcagaaagtgaagtcactgcttttgctgtcttggatcaagaccagaaagaaattattgataccaatggagctggagatgcatttgttggaggtacagactaatttatttcattcttacttacaagtaaaacattttaacccttgtttctaccatataaccaagatttattcatttagtaacttctaatttcttcttttaaataattaacttctgaagttctttccatatacttctatcattgtcagtattagagggttttaccagaggaaaaatatgtgtttggaaaagataatttgctactatgctgtaccccagtcattttcacaagattaattgtatctgtcagaaaattgcataaacaaactgcatcaagtacagtatatagtatattcatagcccttcaggcttaaatgttaacacatttttgttctttaaaacaagttgtgatgaatattaaacagtatgctaataactaaggatgatgtcttttgatgataatcctttggttaaaacatctgtttcaaacacaatagtggttgtttgttatactaaaaagggttaaatttttgcctatttttggctcaataagaactggcaaattttatgtgaactaatgattttggtaatgaatactcaaaaataaaatcaaaacaatagaagacttggcttgatgacttagattgatctaaaatctgattcaaaaattcttttgataagtctaaattccttctagttaagtgtagttaattaagctagtttatagtctctagaaagctttcgcttcctcacagataccccaaaggggtctttcctggtctctgtttctttctcttaacatcaagccagaccaggttaatttaaaaaaaaaaaaaaaaaagcaagcaagtggagctgatgattgtccctttttctctggaggataatttgaatcatgggaaacttatttaagtttgtgtgatggttttaacttaatattttattttaatagtcttttgccaacataaatttttatttttctttctctaaaactattcatgcccagtcttttttttttttctcccaggctggtgtgcagtggtgcaatctcagctcactgcaacctccacctcccgggttcaaatgattctcctgcctcagcctcccaagcagctgggaccacaggtgcatgcctccacacctggctgatttttgtacttttagtggcgacggggtttcgccatgttgggcaggctggtcatgcccagtcttaaatgaactattaaccattaggatgccccatgcccttgttctttggaaagagtctgtaccacagacaacattctacttcactgttatgattgtgttttttatttccttgctcggaaagtcttcattattgataatattagagtacttagcagccaattttcctattttttactttttagagctatagatgtatgtaggctaaaatattttattctgaatttaaccatattctgtaatacattaagaaaaccctagtgatttcttggttagaaattggtcaaaccaggaatcttagtctagaaacttttaaacttatacactgtatgtacattacttaagtactttaaaatctttaaaacatgaagtattctatttctttgacattcagtgggacacataatgaggccatcatagatttgatggtgacctaaatagccactacctctggccttgggttacttggcttcctggcccggcaacaacagattctgttacagacacctaactatctgtaatgctaccgatactaggtgagaacatgtagactttttgagggagggagaggccattcttaggatactgaggtaggaacagctagctaccatttgtattgtggttacaacgataaataaactacttcatcaaagcaattgggatttttttgttagaggatttttcagcctctttttatcctacttcattatatttattgttggggtatagttaggtaagcaaaaaagaaaaagagtatagaacagggatccacagtcgtcttttttaaaggccaaatagtgactattttaggctttgcaagtcatatacaggctgtattgcatatcttcttgttttgtttgcttccttgtgttttgtttttttacagcacttttaatacgtaaaaacctttcctagctctccagctgtacaaaaacataccataggccagagttggcctacagactatagtttgccaaaccctctttaaatcatgggcagcttcctcactttattcatttctagcatttcaaagctccagacactggatttcactatacattgttgaaatcagaatagagaaagtagaaagcaggtagaaactaggcaggactttactggtaatacaattagatagccatttttctcactttgaacctactcagttcccagggtaatcagatcccaaaacactgggtcatgcaatgagatgaacatcctaatgtcagtttattaatagaatacttatgttgccatctttagcacattctgtcaaatgtgaatcaagctacaaagtaatagcaatagataacttttatacagtacctactaaccaaccaatatcttaaacactttatatatatattaactaatttagtgttcacaaaaacttcttggggtagattatttttacccctattttactgatgaaaaaaacagagacaaagaaaggtgagataatgtgcccatagtctcatggctagagagtagcagagccaggattcaaacccagaaagtctggctccaaagtcagtgcttttactcaccacactaatactgcttctctaaacatttatgtaaatctcaccattagaactgagaaccacagaccagccttcctgacaaaagctggttttgccagagaatcttcctgttatctgagtagatgacttactttattgaaaaggatctgttgtaatctgacagggttctggggactctaaggtaagattgttgaggaaaagaaagaaaaactgaaagggaagagaatccaagaactgtagtccctggtgagtttcaaccaagagctttttgctaagcagtagaatcgattgcactacagagatacagaaagccagatgataaacttgcttggttagcatgggctccaaataagagagttatatgaatcagctgtttaatagtgaagcaggatatttccctaagcccttctcaggcagaaattgcagtgtgtgggcgcaggaactagccagccactttggtgccagcaggagcgaacttcactcactcgcttctccactgctcacaggagggtgagcacacgtgagcaggtgcaggagctgggctgagcgcttttgggcactggtaagagcgaactccataccagaccagtggcagcatctaagggaagctgcccgtgacccctggatccccagaggaagcgttacagtgcccttttagctttgctgtctgtagacagcttaagcattaacagctcagttgagtgaccctccattgtcaccaatgtgacagccctttgcacccacactcatggcacccgagttcttgtccggcatccaggataaatgaggtcacacaaacgagttggagatggtaaatgcaggggattttattgccgatgaaagtggctctcaacaggaaggggagctgaaagggggatgaagcaggaagataatcccctggagtccggtcatccccagccagactcctctccaaagctatgccatcaagctgtccctctgaagtcaagccgcttctctccgatgtccaaccgtggtctacaacatccagctgcttctcctcttctttctctgttggctgagcctggggtttttatgggcacaggattgtgggtggggtgggccatgggtgattttggaaaaggcaacatttgagcaggaaaacaaggatgtaagttctcactttgggccatggtattaggctttttggctttaggatggggcgctcaccagagacctaccctcttctgcccagaaatttgcctgcctcctgtccctatcaatagcacccatctaacaactgatgcatctatcttacaacagaaatggtcttgttagttggaaatactaaaagatccattggttaaaaccccctgctccctctccacaccagcaggagcctttctactgggattggaaataacagctgttggcttgacacagtggctcacacctgaaatcctagcactttgagaggccaaggcaggcggatcacttgaggccaggaatttgagaccagcctgaccaacatggcgaaactctgtctctactaaaaatacagaaaattagctggtcatggtaacatgcacttgtagtcccagctactcaggaggctgaggccctgcccgtatggaaaaattaacaaaatggatcaaagacttaaatgtaagtactaaatcagccaggtgtggtggctcatgcctgtaatcccagcactttgggaggccgaagcatgtggatcacttgaggccaggagtttgagaccagcctggccaacatggtgaaaccccatctctactaaaaatagaaaaattagccgggcatggcgttgcatgcctgaagtcccagcaacttgggtggctgaggcaggagattcacttgaacccaggaggcagaggttgcagtgagtcaagatcttgctactgcactccagcctgggtgacagagtgagaccctgtctcaaaaaaattaattaattaattaataaaataattgtcgttgactccttccaccttgggaatgaatctcaggcagtggcaacttttacatttactatgtagtttatttttcttcgcttcattgcccaattaacatatcttctttctgattgacacattctatatttggatggttaatatattcatcctgtaactttcaagttttgctggcctaagagtatttctgtcttttgtgactttgcatatctatattttagtccactttgtggtaatttaactctctgaaggacaataattttctttgcataaatttcaagttttggataaagtatcactccagctaccatgtgctaattatctatatcagtaccagagtgccatgtgttcctttagccagctaaaaagatatatgactacatcatggattttcatgtataatttaaaaatgagtaacccaaatgtacataaattaaattaaattaaattcgtagttccatctcacgggtttagtgacagtaacaaatccctccagcctctacaagcatcgctccttgttctatttggaggtcttaagcactttgtgatatttgttctttatttgtcactgcccagccctgatagaactaatcttttcacattcttcctcaaaagcccaagtgctaggattgtactcttggaaatggatacaattctataatctctaagtatgatttcctaatttcctaggtcaggaaaaaatttcttcctgttgtcctgctgtgctttgtcacagcaggtctaccttttcatttggaaccctctttgtcactgccatagtaacaaatggaaacattgagaacattttgtgacaggcactgtcattgttcccagtgaaatctcttcccctgtgtcttcccagtaaatgaaactgagaagaaaaatcataacaaataacatgaaagaggacctaatcaatatgttcccactgggctgtcaataccagcctgtgttaatctaatatgatttagtcatatgttttatggcagctgtgggaatatggacaggacctacaaatcatctttagactgaaagtgagtacacctttgacagattatgtgtaggcacttatatacaactctcagataaaagactagagacttcacccaagaaccaacattcttagaattaaaaaaaaaaaaaaacaccttcattaagtatggttaaaagccacgtatagattagaagattttactttgttggttttttttgttttgttttcgtttttgttttgagatggagtcttgctctgtcgcccaggctggagtgcagtgacagaatctcggctcactacaacctctgcctttcaggttcaagtgattctcctgcctcagcctcccaaatagctagaattacaggcatccgccatcacgcctggctaatttttgtatttttagtagagatggagttttgccatgttggccaggctggtctcgaactcctgacctcaggtgatccacctgcctcagcctcccaaagtgctggatttacaggtatgagccactgcacctggccagaatattttatttggaatgataataaagtaactgtgctgactcataatactttttttggagggggagatggggtctcactctgtcacctaggctggagtgcaacagcacaatcatagctcactgcagcctcaaactcctgggctcaagccatcctcccacctcagtctcccgagtagctgggactacagggtttttaaaaaatgtttttgtagagacagagtctcactctgttacccagtctggtcttaaactcttggcctcaagcagtcctcctgcctaggactcccaaagtgctggattacaattgattaaaatgacaattcatttgggattacagacatgagccaccacccccagccagaatactctttattttaaaaatcctcacaacagcttcagcagagaaaatgtattacccttaaaaatattacctataatatgcaaatgactctgaaaaccactcagcaatcacaatgcaaataattctcctatttcccatctaataaaaaggaacactaattacattctctaggctgggagcagtggctcacacctgtaatcccagcactttgggaggccaaggcaggtggacagcttgagctcggcagttcaagaccagcctggacaacgtggcaaaaccccatttctaccaaaaataaaaaaattagctgggcatggtggcataagcctgtggttccagctactccggaggctgaggtgggaggattgctggagcctgggaggtcgaagctgcagtgagctgtgattgcacccctgcactccaggctgggtgacagagcaagaccctgtctcaaaaacaaacaaaaaacaatttcattctctaattcatgtttagaaaagaacattggtttacaaaaaatttttaaagagttttttcagaacaaggatgccacttcctcttcatgtggcacctatctatacttctgagaaccatgaagactctctaattatcttcatattttctatcctcaccttgtttctttggtcccaaacatttatagcttccttccccattcttcttaattgctgcttcattgtgctatgcatagaagtggtgcagaattcttgggatttgttttttctacactacccccttcctttgctctccatctcagaagactagaagacaacttggtaagtgttgaatatattgtttctcagacttcttcactcaaaaaccaaaaccttcatatgacccacatctgctgaggatttacttgatggtgaccaagatgacagctgcccactgctaaacaacccaatgtcaacaactctttttcttgtctttctgctctaatgggacatcttctctgttttatttcttgaacagaaatttttcttaaaaccatcaaatgaacagtgaaattggcttggtcattaggaatatgaaacagaccaggcatggtggctcacacctgtaatcccaacactttgggaggcagaggcaggaggatcacatgaggccgggatttcaagaccagcctgcacagcacagtgagaccccagtctctacaaaaaaaaaaaaaaaaaaaaaaaaaaatagccaggcagggtggcatgtgcctgtagtcccaactactcaagaagctgaggtgggaggatagcttgagcccaaaaggttgaggctgcagtgagctgaggtcacgccactgcactacagtctgggcaacagggggagaccctgtctctacaaaaaaaaaaaaaaaaaggatatgaaacattcaccacagatagtagttcaggttcatgcaacagaaagcaagagagagctatacccttgcacagtgataggatgctttattacatgccacactagtgttatacatccagagtcttagtcaagctgaagctagaccagcaccaaatttcataaacactgtctatgattatttgagccttcgttagttaaaaaaatgtaaagattatcctctccagccatgatttaaaaaaagagagagagaaatcactttgttcatgtgaaatacaggatgattttagagtgaagcctgtaatttctcatcaacgcaaatgttccctcaaagacctaatatcctgaatggccttcatctagaagcaattgtaaatagataatggaattgaaaggagtttatcttctgggaatgtggataagacacagacagtctgaaccatgtaggctatcagactccaaagctcagatgtgaaacttaggtttcttatatttgatgattattgagaaatatttattctaagaaaatgatgttgatatggaaatttttatttagttgcagaggtccacaggaaatgtagtaagtaaaatttctgaagttcattttcttaaacagaattgtgacataacaaaatatatgtgtgttagttccctgacctagaatattggtgagccaattggaagtaatttgaatcctaaaattctctcagctgctattaaatgaatctggtcaattttacctgtctgatacatccaacatgtatcagttagcttttactgcataactaaccactttcaaaacctagttacctaaaataacaactcatttatttagctccacaaatctgtgggttgacagctgggcctgtgcttacctggacagttcctctggccttagagtgttgagagattaagtaatttgcccaaggtcatattgaaagctaagattcaaactcaaaatttggcctcaaagttcttagccctagccattttgctatactcccttttattactacaacatcttagcttcctctctaaaggaggagaaatagccaaagtggttttataaacactggtctgtcgactggtaccagtctatgacataagagttttcatcagtcagtatcaaaatgtaaaaaggcaggggcaagaaagtaaatttccataaaactaaatgtattcagttttaaatcttgcccttcctactttgagggagttcagttttctttctttatgaataatgttggtaatagtggattttttaaaaatgttcttatctagcagaattaaagtttgccagctctgtgtttatccctaaaatcttttgggcaagtttcaatgttctgtgaaatcccaaagtctgggattcactgatcaaccatattttttcataaattctacaaaattatttggccttttttttttaatgccagtaaaaaattactgatgacgtgaatgccattcatgttgggcttttctaatatctggcccacttcttcatataaagaagatgagtataggccaggcgcaggggctcacacctgtaatcccagcactttgggaggctgagacaggtggatcacttgaggtcaggagttcgagaccagcctgaccaacatgatgaaaccctatctctactaaaatacaaaaattagcaaggtgtggtggtgggtgcctataatcccagctactcaggctgaggctggagaatcgcttgaacccaggaggcggaggttgcagtgagctgggatggcaccaccacactctagcctgggcgacacagcaagactccatcccaaaaaacaaaataaaaagtaaagaagacaagtatagaactgtaagttctatacttactgtaaacagatgagtacaggccgggcacggtggctcacgcctgtaatcccagcactttgggaggccaagacgggcagatcacgaggtcaggagatcgagaccatcctggctaacaaggtgaaaccccgtctctactaaaaatacaaaaaaattagctgagtgtggtggcagacgcctgtagtcccagctactcgggaggctgaggcaggagaatggcgtgaacctgggaggcagagcttgcagtgagccgagatcgcaccactgcactccagcctgggcgacagagcaagactccatctcaagaaaaaaaaaaaaaaaatgatgagtacagagcaataagtataatatgatgtgatttgtattttgttaaaaatggtcttatgtgtgtatgttgtaggtatacttataaaagcatataaaagttccaggaagaaacactccaaacagctaacagtggatgtactgggaggtggctgaatgaaataatcactttctactctgtatgtctgaatttttttttttttacaatgtgcccttattggctttgtaattagtgtaatctttaaataaataaaatcacatgtgtgtagcactgatgcagagcctagccaaccttagtacctagcagaaatcttcactgtggtaaataagtcatcagacacagcatttcaaactatacgataatttacataaaacataacctctgatgttttaaggctacttatcagcaaaggtctgaataaaacaaaattagcagcatgattgtcaaattaacagctactctctcttcagatatataagttctgaaaccaggggtataaacacaggcttttaatttatttttcatttaattatccaattaacgttgacattttatagaatttagatatatttctagcccacaaagtaaatggcaaattaaaaactgatttctgtcatcaaatgctcttaaaattttagaaccatcatgctatgagaaattttcagttgatcaaatgtaggtttttgaattgagttaaataataacaaaatgatccttcttatgaattagggcataagcacagcttcacataaacaatgttaccatcatcttatcccagcagctattactttgccccattgaatcttttgtttttaactatatcatttagagtgtttgtgctgaaaggaaaattttaaaaaatcatattttctggttttcagtttccagtagtgaaactcttttcaaatgagatcttatctgaatcagaatgaaatgaacccacaaaaattaaaaattaaaaatgtttttaagaaagaatgaaatgagattaaacaaactcccatttgtccctatccacattttatttggtggctcatgatgtcacgtaggaaaaccatgacctattcaaaagcccctatttgatgaatgaagaaagtaaggcccaaagaaaggtaagatgagttgtccaagggagttaattgcaaatacgagacaagaagccagattactgaattcatgaagcagcagttacttgtgttcataatccaaatgaaagttgtcagttaaggctgagcgcagcagctcatgcctgtaatctcagcactttaagaggccgaggtggacaaatcacttgaggtcaggagttcgagaccaccggccaacacaacatggtgaaaccccgcctctactaaaaacacaaaaaattagccaagcctgatggcgggcacctgtaatcccagctacttgagaggctgaggcaggacaattgcttgaacctgggaggcagaggttgcagtaacccaagatcacgccactgcactccagcctgggcgacagagtgagactccatctcaaaaaaaaaaaaaaaaaaaagttgtcagttaagctgtctgttatttagtcctcttggaaacatataggtcaagagtcaatatcccaaatgcacagaaggaggggttttttgttttgttttgtttttgtcttgatgtttgactttaacaataaacagaagcatacgctaaacttttattttgggaaccacatcaaaagatcacacattagctttaaaatcaaatactgactcagtgttgtacatctatgctccatgaagaagaatgacttttaaagcagtgttttgaaagggattagggtgaaagggcatcttatctatatgagtgcaaaatactgcttagcagtactcttcaagagctttcttccgaaattaagatcatttttaaattgatgggcttttggttttgtttttaattcaaatacaatgtcccataccatgttaacagaacttagtaagcttccatttttagccaccacaaagaaggaataagaagttattctcaaagctgtagctataggacaataaagttattctttcttatagctacagtactgaccacttgcctgtatattacacattgcttctcagttgctcactttatgtgggagggtgtgttgtgctgaactatcttaaagcaacctttgctctaaattgacttcctgtacatgtcaacaattaacaccatctgacaccaattaagctttagttttcttttcttttcttttcttttttttttttttttgagacggagtctagctgtgtcgcccagaatggactgcagtggtgtgatctcagctcactgcaacctctgcctcccaggtttgagtgattctccagcctcagcctcccaagtagctgggactacaggtgtgcaccaccactcctggccaacttttgtatttttagtagagacagggtttcatcatattggccagaatggtctctaactcctgacctcagatgatccacccgccttggcctcccaaagtgctgggattacaggcatgagccactgctcccagcctggttttcattatgcaaatacctgctaggtcagaccttaccctggcaggcacagtagctttttcagttatttcaaaatttaatatttattattttccctgaaaaatcagttttctaaaatttgggtcacaagttgttatttgagttcatgactaattggtagtcaatatgaagtcaaaacaaaattttactaactagactacatagaaaatacaaaaagtttacatctgagcacttttcagcagggggaaaccattactttgtcacatctggatattctaagctagccaaattgaagtgggaatttcctgccagatgttagttctttgagcaacctgtgaacatctaagtaagtgaggggttatgagtccttgtttggtagagctatacccactctggaggcttgctcctaacaggcagcagacattttatatgtactaccaccagtcaggaggttgtgcaacctatttgaagtcaatatgatgtgctcttgttaaatgtcaaaacatccaaggcctcattttgaatgtacaacatcagtcttacagatattatatccagggtgaacattgcattgaaatgtcctcccaaatgtagatgacaaaaattttgtttcattaatagaaagaaggtaagactgaaacaccacaggtattccagataacttggatagggccattttgtaaagtcagtgtagaccaaaatatgtctctaaatatgagggaaataaagaatctgaaatgacatgaaaaataccaagtatttatatcaacctcctgttctagacgcacatgggaattaggaagtgaaaatttcattcagaagagctgtgcacaaaaagtggaaatgcattattcaattgaaacaagtaacatttttaagggggataaaatactttctacatgatctcactggttttgtcgtcctccgtaagggaaaatattgacatttaccagactgtttgctccagctttctgatctcctgcagtttatttttataacaaccttatcgatgggcctcttacccagctctctaggtttaactgagttgagtcgatttgttaccacagcttcaagtagctgttacagaacaagcaagacatcctaataaagctgtaaacgtgtttactcaaacagagtattgattttacttggaggggaagaagccggttcttagcacagtgtcagggtggatgaatttcactgcagtttttcattgtcatctgtcagggttgtgaaacactaagtaaagccatcagaggataattagaagtaccagaagtttagcccctaaaatcagttaaccacttgggagttttgtagcttaattagcttttattaaaactttccctagtattaatagccaagcacttttaatggtatttccaagtagatcaagatatcaagattgtgacttgttaaatatatgaatttaatggctaagggtttttcagaccttttctcactctaaattaggctaccactagaacataattagaaccaaaaccaatgtaaagatacagtgatctgtacttatactagcagaataaatgcatgatttttttttctgaaaaatcaacttaaaagaagtagtaaaacaattataaaataatttaagccaggcgcagtggctcatacctgtaatctcagcactttgggaggccaaggcaggaagattacttgagcctaggagttcaaaatgagcctgggcaacatagtgagactcccatgtctacaaaaaattaataaattagccgggcatggtggtgcacacctatagttccagctactcaggaggccaaagtgggaggatcgcttgagctcaggaggtcaaggctgcagtgagccgtgatcacaccactgcattccagtctgtgtgacaaaacaaagccctgtttcaaaaaacaaaaataaaacatgtctttgtagaaaaatccagtttgcgtctttattacacttaaatgtttttgtaacacaatgtgatctaaacacataaaactgtcaatgccacccttatttttaaataccttgattaaagcagattctaaaatattctagcttactttaagttagtcattgtcttaacaataaaagctgatgcacgttgtgcaaaaggtaagcatcagagtaaggagttgcttaccttctgtagaaactgcattagctactgagcttcatgaaaagcattcatgtgaacactacctgacctcttccaaatgtctagaaaaacaaatcacagttgaaaaaaatcacccacctagaaaatgaacaaaaaaactggaaatttattaaaaataagtttgaccttctctcatgatgctgcagtcaagcaaaaatgaaaaataagtttgaccattatatttaaagtacatcttcccatatctaaataattcatttagtgctttatggtaaactttttatgtcttcttgcactactgcctcggcctgtctaaatgactaataaaaattatgatatctctgggatgaccagttctaaagcctaagggtaacagactctgtcagaaagaacagcaaaagatgttgggttttctttgtctttgaaatgctttgtcacgtgtttatctgtgcatatagttctaagccaaattctaccctgaattgctttaagccacaaagtagcaggttgtaaaatattgttgcataagagggcacctctagagcttgctcttctaatttttctaaaggtagaagaaattgacttttcacaattgtatttagatcattcttccatattaaggtattcaaaaacagaaaacataaaggatatggatttatgattatatcatttttatgtgcatttcaaaaggcccacaatacagtaatttattttattctatgcaattttcttgagaatgacagcatgtgagagagctcgttggatggggaggggcagtatatagtagggtagccatatttgagcttcaaggcactgtttactctgactccttcagtcaaaaggagcataaacccatttcacctagttcaggttaaggaattttttttttgtaaggaagatattataacagtggttaagacactgggtcaaaatatgtggggttttttgtttgtttgttttggttttttttgaggtggtgtctcgctctgttgcttaggctggagtgcagtggcgcaatcccgactcgctgcaagctccgcctcccgggttcacgctattctccttcctcagcctcccgagtagctgggactgcaggtgcccaccaccacgcctggctaattttttgtattttttagtagagacgaggtttcaccatgttagccaggatggtctcaatctcctgcctcctgatctgcccgcctaggcctcccaaagtgctgggattacaggtgtgaaccactgcacctggccccaaaagatgtggttttaagtcctggtaccacattaactagttgtgggactgctgtggtttgaatgtgtcccctctaaaattctagcattgtcaatgtgatagtattaagaggtggggactttaagaggtgattaggccttgatggctcctctctcattaatgggattaaggcccttataaaagaggcttcatgcagcatttggctagcttgctcttccactctggcttacccttccaccctcacaagacaccaaatgccaacagcttgatcttgaacttcaaagctgccataattgtgagacaataaatttctgttctttatgtattacccagtctcaagtattctgttgtagcagcacagactatgagagagactatggaaaagttaattctcttttttgtttgtttgttttttgttttttgtgtttcttttttagatggagtcttgctctgtcaccaggctggagtgcagtggcatgatctcggctcactgcaacctctgcctctcgggttcaagcgattaccctgcctcagcctcccaagtagctggcgactacaggtgtgcgccaccacgcccggctaattttttgtattttagtagagacagggtttcaccatgttggccaggatggtctctatatcctcacctcgtgatccacccgcctcaacctcccaaagtgctgggattacaggagtcagccacagtgcctggccgttacttaacatctctaagcctccgtttcctcatttataaaaatgaagataatgagtacctatctcatttgggttattatgaaagttaaatgaagtaatgtttataaagcacaacacctgatacatagtaaggattcattaagtgttacatattataagaggggtctcaaagaagtctcagacaagagccagaatgacaagttttcactgaaagtatagccagatggtgattgtaggttcaagtcagttctggagacctcagcagcagatactggatcttcactccagttcttcactaattaatcctactcagctgcattacgtgtctgcgtcttactgtctcacagtcagcttcccagcctgtctttgttttccattctggctcctaaaagagaacactgggttattagctcaattcactttttatacaatgtcatcagtaggacactaggagaaccataagttgtttgcccttgaacgagatgcctaccctttgttccatttaatagtaaaggttgaatttacgtgcacaaaacattctgcagtgctggaagtgatttttcttaaaagggtaatacgtggatgggctctataaacattgtgtttgcatgccttgtccactaccttcttcccatatttatagttctgaaaatgttccctacaacgtgatccatctatcatacaatacatggaacatcaaacagcttgtatctcaagctagaaacctagacgcccttcctgagtccttccattccctctctccaaaccgtcagtgagttcttttgattccgctttaaggatgtatctcaaatttgtccacttctatttctctgtcatgactttagcttaggcctgttttccacttactgtagtagtttcctaactgatgtctatgccttcactctttctggaactttattccattttctgtataatagccaaaataatcactttaggaagaagttgaattatttcattcccctgcttacaacctttccgttgcttctcactgcacttagcctaaaaatccaagctcctgtggtgatttaaaaaaatctatatgatctgctatgtttgtatctttatttcattccattttcacctttgcctgcatgatgtagctatactgtcagtcttctttcaggccttagacactttgtacagtggagtttactttgcctagaatgttcctcccctactctttaaaagtcaactcttctgtaatcatcctatctaaaatgggtcccttgactaatattctctcctgttactcagttctttttcatagtagcacttaacactctggaattgtcttatttacttatttgtttacttgtttttgtctatttcccccattacaatgtaagtttcagaagaacaggaactgtaagtgtcttatttaccagcgtatccccgggacccagcacagtgcctagcatagaagactcagtaaatattagttaaataaatgaatatatcaatcatatgcacagctgcaaaccgatttgcccctaccatcaagtaaagaccatttagtcggtatttctaggaatttggttattgaggtatatcataagaaggggttagaataagtcaggaaacagagtaggccatactttaggatcaggtcaacttggtttaagagtaacccacgctaggccaggtgcagtggcttacgcgtgtaatcccagcactttaagaggctgaggtgagacaataaactgagcccaggagttcaagaccaaccagagcaatatcgtgagacccccattggtatcaaaaattaaaaaattagccagacctggtggcaaacacctgtagtcccagttactcaggatggtgagataggaggatctgttgagcccaggaggtcaaggaaacaatgagccataatcatgccactgcactccagcctgagtgtgtatgtgactaatccagaaacagagagactgatcatactacctttagtatcacttaaaataaaggatgctgggctggggggcatggtggctcacgcctgtaatcccagcactttgggaggccgagaccggatcatgaggtcaggagatcgagaccatcctggctaacatggtgaaaccccatctctactaaaaatacaaaaaattagctgggcgtggtggcgggcgcctgtagtcccagctactcgggaggctgaggcaggagaatggcatgaacctgggaggtggagcttgcagtgagccaagatcatgccactgcactccagcctgggtggcagagcaagactctatctcaaaataaataaataaataaataaataataaaataaataataaaggatgctatggagagaatacatgtgttaggaaagaaggtagtatttaataataattgtactaagtagttatagtacagatacaaaaaatttattctcaagatcataatcctgaacatcagttcctgctgtaataggcagtaacatacaggtcagagactccagtcaagatttcataaaatatattaaagttatccagtagatctccaagttgattcctgacatcactctcaagtcccctaatacacacatcacactctcaaacttacaaatttggtttgccaaaatgtccagtgggaagggtttaattcagcagataatagaaccttgccctgtcctacctaggatctttgctgccattccttcgtttataggtgtgagtggggtaaaaagtagctcatccataaaggaggcagtgaaaatctctagtgaagagcactgagcctgggacataacctgtttcattttccacagcttctttacctcaagccacagaattgttcttagctctttaacttttgtcagcacccacatcaaatcaacaaacttgtttatttttcttctttccttactatctatcacccagaatagtggttctcaaacttgagcgtgcatcagaatcatctgaacacttgttaaaagatctgttgctggaccctctcccagggcttctgatttagtaggtccgtgatggggcttaagtgatactgaagcagctggttcagggaacacgctttgtgaaccatttctggaaagaattttacagtagattcccatttgatctctctgcaagcagtctctttcctagtaagttcatattccacacttctgccagagttagctgcccaaaagcaatgtaatatgcctcccctgtatcagagtttggttggctctctatttattatagtataaaatccaaatcaggctgggtgtggtggctcacacctgtaatcccagcaatttgggaagctgagatgggtggatcgcttgaactcaggagtttgttaccagcctgggaaacatggggaaaccccatctctaccaagaatacaaaaaattagtcaggcatggtggcacacacctgtggtccgagctactcaggaggctgaggtgggaggattgcttgagcctggaaggcagaggttgcagtgagctgagatcacaccactgttctccaacctgggtgatagaatgagaccccgtctcaaaaaaagtccatatcacatcatacaagatccttgacgatatgtccccattttgtctttcccgctgtgtccccaactcagctgacctttgactatattgcaaaataagctttgtcctgtcaacagcatggctttttttcctgcttataatgtctatctctgcaaaatgttattcattcaacacccagctcatgtcaccttctccaagatgcatttctaaatgtcccccaattgaggtgttatgttatttttaaagtgcatacgtggctttctctcctaaagctataaaaccctcaaggacaaacactgtgttttatccatctttgactcctttggtgcacccaaagcccagtacctagacattcaatagctgttggttgatggaatgaatccaggtacttctgacagattccagattttcactttcttttgtttcttataataaaaatgtagtatagaagcagtcatggcatgagtctagtaaactgaggattcagatcagtcaaagttataatttatcttattccctttcctaaagcagctagagataatgaaaataaaacctttaaaaagaatgtaacacctttaagttgactgcctcgtgtacactgtggcagcatatatctggtaatcattggtataggaggtaagtttaacaggccagtttaagacagcatataaatcatcactaaaggacagatagctaagaaagatggaaaataaacaaataattgaaaaaccagattgacccagaaatgactaagaacaaagtttgtgcagggagacagggagaattgagtttagtactgttagttgctgtaaaatatatcaggtttgctttaattacatggtaatgcttctaagaacaaaggtaattacatgataacttatgttactactcccatattatctctaaataactatgtaattagcttgtcactactatacagtgtgaagtttgatattactcatggataaagaacattggtaacttaagtgagtgagcaagggtggggtgagggatggaggcagcagggaaatcatagaattattacaatcaggaatgcaaatggttaattagatcattgcacccagtccttaaggatctgagccagagccatggagaataccaaacgagtctgaggtaaattctccatggcttgtcacagtgtcttctgaagaccataaacatacaacaaagtaagttgacaaagcacgcaacagatcaatgagtttgggatataatgcatgtaattttaaacagttccttttatttggggaggtttttcttttaagtaaatactaagaattttttttaattgaaaaatatttcactcatctcattttccaacatcctgaggttatatgtgtggcctatggggtgaggatgtgtagcactgggaactctcatttattgctggtaaaaaatgcaaaatggtaaacaaccactttggaagacaatttggcaatctcttacaaaactaaacatacttttaccatatgatctagcgatcaggctccttcgttgcccaaatgatttaaaaacttacgtcttcacaaaaacctgcatgcatatgtttatagcagttttattcataattgacaaaacttggaagtagctacatatctttcactaggtgaatggataaacattatcgatacaataaaatatgattcagccaacaaaaagtaatgagctatcagctgggcatggtggctcacacccgtaatcccagcattttgagaggcaaaggcgggcagatcacttgaggccaggagttcaagaccagcctggccaacatggtgaaaccctgtctctactaaaaatacaaaaattagctgggcatggtggcaggcgcctataatcccagctacttgggagactgaggcaggagaattgcttaaacccaggaggcgaaggttgcagtgagctgagatcgtgccattgctctccagcctgggcaacaagagcaaaactctgtctcaaaaataaaaaaaagaaagaaggaaagaaatgagctattaagccaagaaaagacatgagggaaccttaaatgcatgttgctaaatgaaagaaggcagtcttaaaggctacatactgtgtgattctaactacagtcatgcaccacataacattttggtcattgacagaccacatatatggcagtggtctcataagattataaaaccttatttttactgtaccttttctatgtttagatatgtatagatacataggtacttaacattttgttacaattacctaaaattcaatagaataacaggctatacaggattgtagcctgggaacaataggctataccatctaggtttctgtaagtacactctgatgttttcacaatgacacaatcacctagtgatccatttctcagaatatatccccgttgttaagcaactcaagactgtatatcacattctagaaaaggcaaaactatggagactgtaaaaaagtcagtagctaccatgggctggagctgtggcgcaaggagagagggatgaataggtagagagcactgaggatttttagagcagcaaaactgttttgtgtgatactttaatggtgtatattattatatttgtcaaatcccacagaatatacaacacaaagtgtaagccctaatgtaaactatagatattatttaatgataatatgtcaataatggctcatcgattgtaacaaatacacccactaactaatgtaacaggttaatcataggtggaactggggagtaaggggatgagggaagatttgggaactctctgtattttctgcttcattgttttgtaaacctaaaactgcccaaaaatataaagtctaatttttttaaacccaagtgggaaaacctttcttcgatccatcttattctactgacatcttgggtgtgtatgatggtctgtgtttcccagtgtcatcaatttcactgccttaaggtgctatggcttagacttgtgtcctgtggccagtgacctcacagtttttaccaaaatacttgttttcattgctatcacgtgatagctactctaagtatgattatccttcttaattctgttaggaatccccccggcattccctgtgagggaagtattagtccttgaatttccgtttcaaaagatgcgtactgatttacttggtatatagcttctgtaagaggaagtttcatttgggaaagaaaggttgtgctaaggttccctcagaaactttctaaattgccttctctaaaattgcctgtgtttccctaagcctaagagtaaaatacaggaaatagtgatgatttttatgtgcttgaggaatcttctaagaagagtgaccaattttattctacttatactgatacttgtactgatttaccttgtggaaaattcatccagtggctacaattactaactcactccaaaggcatgagtgggaaactattaaaataacacatcacttagctgaaactcttgaatggttgctcttaataaccatttttctgaataatttaaagttcccatgttttttaaaaaggtttattgacttagatctgatttgaaaagtgtaatgtagcttattatagaatatttaaaacataagaaaaacaaacaggaaaaaagtcatcccaactctagaaacttaacttttttcaaacacattttttttttttttttttttttttactattttgactaaacatgtttctaaatgtacttcttggatctgactaaagactaaaaatggaaggaaacacaagtagaaattataaagtcaggatcaggccagtgtggtagctcatgcctgtaatctgaaaaccttgggaggctgaggtgggaggatcacttgaggccagaagttggagaccagcctgggcaacctagtgaggccccatctctaccccaaaaaaaaaagaaaaagaaacttatttatttaatttcctctctttaaaggtatcatatgcaaaacagaaggtttgggggttttggggttttttgtttgtttgttttttgagacagggtctccctctgtagtccaggctagagtacagtggcacaatcatagctcactgcagcctcaaactcctgggctcaagcagtccccactaccttagcctcccgagtagctaggactaaaggtttacaccaccatgcccagctaatttttctattttttgtagatacagggtcttgctgtgttgccagggttggtctcaaactcctgggctcaagcaattctcctgcctcaacctcacaaagtgctgggattacaggcatgagctgctgtgcccagccagaagttttcattttagcacagtttaatctttcactttctggtttctgctttttgtgtgtcttatttaagaaatattttctacctctaggacataaagatattttttattttcttctaaaagtcttactatttttccatttacatttaactcattgatagacctggaattctttttttttttaatatagagtgaggtaatgttatttttccaaattgaaaactagttgcctaaacactacttttctaagaagccatcttttccccatgaatttgcaatggcaactctgttgtagctcaagtttccaccttttctctatttatttatagctatgccaacaaacactgcatttattattatagatttttagaagtatttaatctggtaagactagtctctcctatcatttttacttcagtaagtgtatatgcctgttcttgatcctttgctttttcatataaattttagaatcaacttatcaggttcccaaaaacattgttgagactgtgattgaatttgtattgaatgttatcttcttctccaataacccagcatatctctccatttaggtcctttgtaatatctttccataaagttctatagttttctttattagaggctggcataacttgcatcgcttttgtatttttaccaaattacatttttaaaactgttgctcttgtatatatatatgtgtgtgtgtgtgtgtgtgtgtgtatgtgtgtatgtgtgtatatatgtatatgtatatatgtatgtatattctatatacaaagctgctctcaatgaaaatattgacaaatttatttcttcttttacaattcctgtgtatgtgtggggtgtgtgtgtgtgtgtgtgtgtgtgtgtgtgtgtgtgtgaagatctcgcactgttgcccaggatagaatgagtacagtggcatgttcacagctcactacagcctcatccttctgggctcaagcaatcctcccacctcagcctcccaagtagctgggactacagtcatgtgccaccatgcccagataatttctgtattttttgtagagccgaggtttcaatttcttacccaggctggtcttgaactcttgggcttaagcgacctgcccaccttagcctcccaaagtgctggaattacaggcacaaactactgcacccagcctccctttacaattcttaaattttttttagtcttgttactcttgttagggcttccccactatgttaaatagtattgattttttattttattttattttttgatacagagtcttactctgttacccaggctggaatacagtggcacaatctcagctcaacacaacctccacctcccggattcaagcaattctcatcccttagccaaccgaatagctaggattgcaggcacacaccaccacacctggctaatttttgtatttttagtagagatggggtttcaccatgttggccaggctggtctcgaactcctgacctcaagtgatccaccagcctcggcctcccaaagtgctgggattacaggtgcaagccattacgcctggcctgattattattattttatttttattttttatttatttatttttgtttttgtttttgtttttttttgaaacgaactcgttctgtcacccaggctggagttcagtggcccgatctcggctcactgcaagctccacctcccgagttcatgccattctcctgcctcagcctcccgagtagctgggactacaggcacccgccaccacccccagctaatttttttttttgtatttttagtagagacaggttttcaccatgttagccaggatggtctcgatctcctgaccttgtgatctgcccgcctcggcctcccaaagcactgggattacaggcatgagtcaccatgcccagccctcattattatttttaatgggactgtgtatgttttctatttatttgtaattttactgtttccctttttccacattttctgcagttattgggtatgacttttataatcagaaaaacaatattttcacttgctttcttaaaaataaataatctcttagtgaaggcctgaggggtccttataggtgtaatatggatggccatggagctgctatggcttcaggctttatatatatgaggtattgctgtctattcacagtattctctgacctttaaatttatgtggcttaaaatctattttcaatgcataaacatttgtatatttttccaggtgaacaatgtactacctagatgtataataatttaaatttagtgtaaaatgagattttttacaacaaattatatatttccaaaaactttaaaatgtttaaactctacataggcatatggtggtctactatatataaaaggtttctgggaactatttaagaagataaaaatagagccactgacatgtatttgtactgtatctttgggaaaacaatttcagcgtaatatatacttgtaaaaagtgaattagtaaaactattctggccgggcacagtggctcacacctgtaatcccagcactttgggaggctgaagtagaaggattgcttgagcccaggggttcagaccagctgggccacatggtgagactccatttctacaaaaaatagaaaagttagtcaggcatagtggcacacacctgtagttctagctactcaggaggctgaagtgggaggattgcttgagcccaggagtacaaacaaaaacaaaaaaaactttattcctccaagtttaaaaagtgcagcttgcttacttgttgacaagctgctgaatatagaatgaacagtaatagagtctactgggttttaggttccagctaccatgaaaaactattaaggaactataaatagaaaagaaaaaatggactcataaagactttgttcatttccttctaaaatatccctagcttattaagtgtctccattaaggcttccgtacccactgacaatatttcttgattctctgtaaatgacactaagaaaattctagatgctatagctcttctatagtaactacatggaatagacagcttaagttaggaaattacattgccttttgagcacaccagcaatcctacctctgtgtgctttgaggaaactagtgtagcacctcctctttttgtacaactttaacatatgtttcaggtctcatgtcaaataccagatacaatttgtcaatttattgatcacattttgtaacatcagtaaaagtctaaataaaatcaaccagaagataataggctacaccaattgttaatgaacagaggtttatttggaaagattgttccaggattcagagccagctaacaatagctctaggaacccaatttattgtcgatgagagattctcaccttatgcctcgtcagctagaggacctaaagtctataacgtctcctaaagctgggaaaagcctgagaggcccaggttgatacgcctatgtgtaacaggatagagagaaggaaccaaagtaaaaaggcaacaacaactgcctcagcatatgagttcttgatttggaaaaacctgcactgatggttcttgttctctggtgtaatgcctcctatgcctgctctcttggctgtgttgaaaagcatacatacagagctgtgctcttcattttcaagatgatgtactgataaggaccacaagccagtggcactgggaaaaagggatcctaagagactttttcttattaaacatacattcaaagtcagttatttaatattttgctttttggactcttggtaagcccaaatcttgttctaaaaagagcagacttttttgttttgttttgttttgtttgagatagtgtctcactctctctcccattctggagtgcagtggagcgatatggctcactgcagccacaacctcccaggcttgggtgatcctcccacctcagcctcctgagtaagtagctgagactacatgtatgtaccaccacgcctggctaaatttttgaatttttttgtagggacggaattttgccatgttgcccaggctggtctcaaacttctgggctcaaatgatctgggtgcctcagcctccctaagtactgggattacaggcatgagccaccaggcctgacttgtttttgtttttttgttgttgttgttgcccaaactagagtacagtaggctcaatcacagctcactgcagcctcaacctcccacctcaagcagtccttccacctcagcctcccaagtagctgggattgcaggtgcatgccaccacgcccagctaattttttttttttttttatgtagagacgagtctccctgtgttgcccaggctggtttcctgggctcaaatgattctcccatctcagcctcccaaagtgctcagattagaggtgaggcatgagccacccaacctagccttttttttttttttttttttaatacctgcaagccacatttatctgctatagtgtttaccaaccacactctggggcctgaggctgtgtttcagtgaatgaaatattaaaaagtactttgtttacttgctgacacagtacagtatttgtatctattaatagcatattgttattgttggttttttttttcgaaaaacactttattggaataatatacttaaaatgcagggaacttttaaaaatagagtgaggccaggcatggtggctcacacctataatcccagcactttgggaggccgaggcaggcggatcacctgcagtcaggagttcaagaccagcctggccaacatggtgaaacccgtctctactgaaaatacaaaaactagctgggtatagtggtgcatacctgtaatctcagctactcaggaggctgaagcaggagaatcacttgaacgctggaggcggaggttgcagtgagccaagatcacaccagtactccagcctggatgacagaggagactctcaaaaacgataataataattataaaatagagggtgaaagaccaaacatcctatagaaaaataagcaaaagataaaaattaattcacagagagatttgttctttaaagatatataaaaagatgttcagcttcacttaataagagaaatccagattaaaattatactgaaatatttctaacccatcggactggcaaaaattcaaaagctggacagtgtactatattggtgaagttgtggggaaatgggcactcttacattactagtagaaatagaaaatccttaaacctctatgaaggagaatcactaataaaactatgtatgcatatagttactcattaacctagcagttctacttctagaatttatcctgaagatacgcccctaataacacaaaaatacatatgtaaaattttattcattgtagcattgtttatatttccaaaacattggaaactatgtaaatgcccacacataggagatagattaaactacagtgtatttatacatggagatactatgtagctgtaaaaaagaatgaagaaaatctctaccaattgatgtataatgattaccaggagattttggtctctgactacaggagtctcgctctgtcacccaggttggagtgcagtggcgtgatctcggctcactgcaacctctgcctcctgggttcaagcgattcttctgcctcagcctcccaagtggctgggattacaggcacccgccaccacacccggctaatttttgtatttttagtagagacaggatttcaccacgttggccaggcaggtctcaaactcccgacctcaggtgatccacccgcctcagcctcccaaagtgctgggattacaggcgtgagccatggcacccagcctccaagagatacttttaagtggaaaaaaagcaaagtgtaagagagcatatatagtgtattacctccttttgtgttaaaacaaaaaaaaaaagaaaagaaaaagaaagaaaaggaagaaaatgtacatacatctgcttacctttactaaaagaatacaggaagataaaccagaaaacagtgaaagtggttgcttaaagggatggtgaggaggacatggtaaagagagtcactcttctttgagcatatcttttatagaatttttacttttagaaacatgttaatgttctacatattttttaaatattaaatcaataaggatagaatgtaagaaatgggactaaaactgaaagcaaactgaaaaacatgaacccaactatttccaatcttttcttaagtaaaatgagctccccaaagggggtaaaaaagagaaccaatctaagttacatgctgaacacagtatttgactacaccagagaacagaaaattaaccctaaactctttttagtagatttggatttttttcttttaaagttagggatgaagtgacttggaaactattttagatgtattacaaaagtgagtaaacaaataaatttgttgatatttttgggagctaggttctcactataaaagaaggaacatacaaataatgggatgaggaaaggcaagaaagaaccctgtggagatggactagaattggaagtactggtgtcagctcaatttctaaaataggtctctgtacacatgtatacgtatacagttatggatgtaagtgtgtgtgtgtgcatgactatgtatacatgcatacttcccagctctgttcattaacatggtctagaagcaaagagcacagctgccacccagatcttggtctctaataccattctgtgctaaaaagaaccagttatcctcagataaatggctgattccagggcatagtagagcccagaacattatgccagaacataaagaagggatcaaaaataatgtgatggcatatccaatgacacgggagccaccagcctgaacggctcccactggcaaaaactggaatattttaaggaccaaattaattaagggctgtaagggattataaaccattgatttaaaaagaattgtgggccaagcatggtgtctcacacctgtaatcccagcactttgggaggctgaggtgggcggatcaccttaggttgggagtctgagaccagcccgtccaacatggtgaaaccctatctctactcaaaatacaaaaattagccaggcatggtggctcatgtagtcccagctgctacttgggagactgaggcaggagagtcacttgaactggggaggtggaggttgcagtgagctgagatcgtaccactgcactccagcctcggtgacagagcaagactccaccacacaaataaaataaaaataattgtgcattcttattgataataaatagattttaaaataataaatgggagaagaggtaggctcttgtttatggtagaatggtgagggctgactggtaaatgtgaaaatcatttcacagctgcagttggaaaatcatcacagtatgagttgcttcagttaaaaattatgagtggatactcaatctgggagggggttgggacttttgataaagaacagaatatttatgtgatttttttttttttttgagatggagtctctgtcgcctcggctggagtgcagtggcgtgatctcagctcactgcaacctctgcatcccggattcaagcgattctcctgcctcagtttcccaagtagctgggactacaggcacccgccaccatgcccagctaatttttgtatttttagtagagacagggtttcatcatattgaccaggctggtcttgaactcctgaccttgtgatccgcccccctcggcctcccaaagtgctgagattacaggcaggagccaccatggccagcctaatttgatttgaggatttgctcagtctgtcttccttccttctttccttccttccttccttccttccttccttccttccttccttccttcctctctctctctctggtctctttctttcttttttctttttttttgagatggagttttactcttgttgcccaggctggagtgcagtgacatgatctcggctcactgtgacctctgcctcctgagttcaagcagttctcctgcctcagcctcccaagtagctgggattacaagcaagtgccataacacctggcaaatttttgtatttttagtagagacgaggtttcaccatgttggccaggctggtctcaaactcctgacctcatgatctgcctgcctcggactcccaaagtgttgggattacacgtgtgagccaccgtgcctggcctatgtgatcttaaattgtctattcacaaactgcttgttagatgcaagggaaaaaataggtactatacaatggagaagtaggacaacaccttgatcaggtggtcagaattcctatcaccagtgcacagcagatggacatgatgtgcctctaaatgtgacactttgagaaggatccatcataatgtgtgtagtagtctgcctgggtgtgcatagtctgaacttaatcatgagaaaatattagacaaatccaaaattagaatcagtctattaaaaatgggaaaataaataagtaatgggataagcgcgtcagacacagtggctcacacctgtaatcccagcactttaggaggctgaggcgggtggattgcttgagtccaggagttcgagaccagcctgggcaacatgacaaaaccccatctactaaaagtacaaaaaaattagccaggcgttgtggtgtgcacctgtggtcccagctacccgggaggcagaggtaggagaatcacctgagcctagggagttgaggctgcagtgagccaaaaaaaattatgccactgcactccagcctgggcaatcagagtaagaccctgtctcaaataaataacaaataaattaaaaatgaggtgaggtaagttatgactatattcttcaaaaatgtccgtatctcaaaagtcaaaatctgaggaaatgttccagatttttaaaaactataaagataccacagttaaatcctgaactagactctgttccagaggagaaaatttccataaaggatattattgggtaattgactaaattgaaatatggacagtagattagataacagtgttactgaagttgatgttgatgtccacactgtagctatgtaagagaatatccttattctcagaaaagatacactgaagttttcagaagtaaaaagacattgtaaatgtaacttcctctcaaatagttcagggaaataaaattgtatgcagagaaagagtacatgcaaatggtgcaaaatgttaacaatattgtgcacctgggtagatgatatgcagatgctttttgtactatttttattcctgcaacttttttctgaatttggaatccttttcaaataaaatacattttaagcaggctaataattaaaaatctaaactaagattatattgggaaacattatgctaagtgaaataagctagacacaaaaagacaaatattgtatgatctcacttatatgaggtacctagaataggcaaatttatagagacaaaagtagagtagcagttaccaggggctagaagtaaagaggagtggggagttattgtttaatgggtacagagtttcttttggggtgatgaaaaacttctaaaaatgcatagaggtagtagttgcacattgtgaatgtacttaatgtcactgaattgtgcatttaaaatttgttaaaatagtaaattttatgttacgtatatttttcaaaataaaaaagtatcttggggatgtttacttccattataaaaggattccctacaattatttaaatataagctccctttgtttatttaaacaattttatacagctttcaagattcacatcagatactttttgaagattccacttataactgattatgtagtatctgtatttcattttagttggtttttaaaaatagattattgaaaaactgacattcaccttgggcaaaggtcttagcttttttcagcatccaggttctccacttgtcaaagcaaaagattcttcagaatacttcattcatcatctagttctcttagaaaaaggatgctggtggttttgcttcacaaaaatatttcataaacatgagctttttctttttctcacaatgatcataccaggcggaatgaagaaaacagatgttgcttataaggcgtctaatagacatgtttgcattgtaagctgatctgactctgaatttggcatctgctccattcactgtgtggactgagcattttcgcctcacagtttggcagaaaagttaatattgacttttgactgttacctgaaaacttggtgataaaatactcttactaaacctcttgagagagtgattttacagtctcagcaaatgtctttaaaatacatcattctattaaccattttaattttattctttggttgggaatacttatttgtttcatctaatacagagcattccccaaatctgactgggaaaagtctgtgtggtcagaatggtagaagaaggaggacataaatcacttataatgttctctacaggtcattataccacagcttctcaattaaccttcatccccctcaggctgcccagggcctcagggaaggcccagaagcctagctgcagcacagtttctcattattatctgctcttctgagtatttgagtgttaactgcagcagctcagcagctcaggtttcccctaaggggaaggtagcccagattcttctgctcttgacctgtcttatttgcaattatcctttttttcttttttcacagttttattgtggcataatagacatacaataaacggtatgaatctaaagtttacaattgtataactttggacatatgtgtacacccatgaaaccatcactatggacatatccactgctcccatggccttttctaatcatgccttcctgctccttctcatccccttttggattgtttccagtttggggctattacaaataaagctgctgtgaacattcatttacaagtctttgtgtggatatgtgctttcacctaccttgggtaaatacctagaaatagaacggatcatatgatatgcacatgtttagctttttaagactgacagatggtttgggaaagtggtcttagcattttacattcccacaattagtgtgtgagagttccagttgatcacacccttgccaacacttgttatagtcagtcttttcagttttagccattctgcgagtgtgcagtggtatctaattgtgattttaatttgcatttctttaatgaataatgatattgaacattttttcatttgcttatttggcatctatcttctttgctaaaatgttaaatacttttgcctactttgtgttgagttgtttcttgttattgaggtaccaagtatttaattgtgacaaagttcagattattttttcttctataaaagttgcattcttagccaagtgtggtaacttatacatgtaatcccagtgctttgggaggccaaggcgggcagattacttgagcccaagagttcaagaccaacctgagcatctctacaaaaaaatgcaagaattagaggaaagctgaggtgggagaagagcttcagcccagaaggtcgaggctgcagtgagccatgagtgtgccactgcactccagcctgggtgatagtgagacactgtctcaaaaataaataaatttttaaaaaagaaaagttcatactttttacctcttactaagtgatctttagcaaacccaagatcactaagattttcttctatgttttctcctcaagagttttaggattttattccttacatttatgtctgtgattcatttcaagtgaatttttgtagatagtgtaaggtaaaggttgaaatgcttttttttcacacaatttgttaaagtgtcctttcttgatgggattgtttgggcacctgtgtcaaaaatcagttggctatacagaagtaggtttatttctggactctgttcagttccattgatctatttgtctatatgctaataccatagtgtcttggttattatcattctataataaattttgaaatcaggtagtataaatcctctggctttgttcttctttttcaaagttgagtttttgctaacctaggtcctttgaatttccatataaattttagaagcagcttgtcagtttctataagaaaaatctgctagaatttttattagtattccaatgaattaatagaaaaattcctgcagaactgataatattgaatcttctgacctttgaacactttatgtctatttatttaggcttcttttatatttctcagcattgttttgtcattttcaatgtgcaggccctacacaacttctgtcagatttattctaaggtacttcaaatatttgaagtatgtgaagtaccttagaataaatatggataaatattcttaactttttaatcaatttttgtttttgagacagggtcctactctgttacccaggttggggtgcagtgatatgatcatagctaaccacagccgcaaccttccaggcttaagcaatcctctcacctcagcctcctgagtagctaggtctacaggcatgcaccaacatgcatggctaatttttgtattttttgtagagacaggatttcgccatgttgctcatgctggtctcaaactcctgagctcaagcaattcacccatcttggcctctcagagtgctgggattataggcatgagccacgatgcctggcttattcttagtaacttctaattgttcattgctcgtatgtataattatatatacacattaccagtatagataatttacttttgtatttttagtagagacggtgtttcaccatgttgattttgagaccctatcaacatatgcttccctggctgggtgtggtggctcacgcctgtaatcccagcactttgggaggccaaggcaggcggatcacctgaggtcaggagtttgagaacagcctggccaacatggtgaaaccccatctctactaaaaatacaaaaattagctgggcgtgatggaaggcacctgtaatcccagctactcgggagcctgaggcagaagaatggcttgaacctgggaggcagagattgcagtgggccaggatcatgccattgcactccagcctgggcaacaagagtggaactccacctcaaaaaaaaaaaaaaaaaggaagaccagattgacttgatggcaagttgttgtgtctcaacttgagctctttagaataaatattaggggaagctcatgatgtttgggaaaagatctcccgaccgggcacagtggctcaacacctgtaatcccaggccaaggcaggcagatcacgaggtcaggagtttaagaccagcctggccagcatggtgaaaccccatctctactgaaactacaagaattagctaggcatggtggtgcatgcctgtagtcccagctattcaggaggctgaggcaggagaattgcttgaacctgggaggcggaggttgcagtggccaagatgatgccactgtactccagcctgcgtgacagggcaagactccatctcggggaaaaaaaaaaaaaaaaagacctccctaacggtaacgcacaagactttctcttactgtcaaggctgaagaatgagacaggtgcttagatcatatattggtctgacccaatatgacatttctgctgctgttatacaatactcatgtgtttttttttgcctgtgttctaggttttctgtctcaactggtctctgacaagcctctgactgaatgtatccgtgctggccactatgcagcaagcatcataattagacggactggctgcacctttcctgagaagccagacttccactgatggaagagctgaaaacacaagcccaggagtgcagacactgccctaattgcttcctgagaattcccatattaataaagaagaaaattatctgccattttttcctactataataatgctgaatcttaatttagagggtacaagggtatggtaatgcttgtagaatctttattatctcaacaatctaaaaaatgatgtttatttccatagtttgatagtgccacttaaatgccaattaaacaagaatataacatttcaatagaaatttttatttcattttcaattactttgtaaattcgtgtgtatttagtacactgatttgtttttttacatttctgctttgaatgcagatgcaatttaatataatagattttttaatgaattaatcttaacatagtaatctttagctttttatacaaatatatttaatttaggagtatatgtgtgtctatacacacacatacataaatataccacatatacacctgatagtcaaataaggtacagaaattttatcttgtcaattatgccaaataatctctttaatgtgcactcaaacatgtaataaactttggataattaaataatgtgccaaatttaagttgtaccacaatattcaaatcatagtcttatggaactctgtaattggacacaaacaaaaacttgtcatataggaatttttttctgtcttttccctgtgtacagcaaactgaggaagaaagatcattatttaatactgggccctgaaatgacacccaatttgttaatggaattatgaagaacagcaatataatacactgaagaataacttagtatcagagaccaataaatcacttttttaaggatgacaaaatggtataat

SEQ ID NO: 2313 - DNA, 532817 bp, Homo sapiens; identical to SEQ ID NO: 2312

SEQ ID NO: 2314 - DNA, 558121 bp, Homo sapiens; identical to SEQ ID NO: 2311
